United States Patent 11,098,302 (IDENTIFICATION OF POLYNUCLEOTIDES ASSOCIATED WITH A SAMPLE) - sequence listing, part 55

SEQ ID NO: 187791 - DNA, 773 bp, Homo sapiens
  misc_feature: GYAE6OF02HGHDL.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtggggctgaggtggaagacgtccgtgggtcctcgggtgaaggtctcctgcaaggcgtcgtgggggcctaccgttcggcgtaagtttgcctagttacgttgggtgcgacgacggccccgtggaacgacggtctgaggtggacgtgggaggcgtccgtccgtgtcggttgagtacagaactaaacgtacggacagtagtgtacgttacggaagggagacgtacgacgtacggtacgggacggtaacgtaacgtaccggtaccgaccgtaacgacggtacctacgttacggagggtaacggtcgtaaacggtaaacgtaacggtacgtaaacgtaccgtaaacgaaaccggtaaccgtaacccgggtttacccgttaacgtaccgtacggaccggacggaacggaaaccgtaccccggtacccccgggtaacccccccggggtaacggggaaccccggtaaacgggtaacgggttaaccgggttaaacggggggaccggggttaaccgttaaacccggggtttcgggttttaacccgggttacccgtttaaacccggttaacttaaccccgttaagttaaacccggg

SEQ ID NO: 187792 - DNA, 600 bp, Homo sapiens
  misc_feature: GYAE6OF02G00KA.5.64.F09.1.454.CMB.1.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgcctattacgttgggngcgacacggcccctggacaagggcttgngtggagtgggaggactcgtccctgtcgtttggacgcagcaaactcgcacatagtacttcgagggganagtcgaacgtagttacgggcggacgtaatcgtacggaccacgacgcctactcgtaggagtcgtagaacgaacgtagacgacgtagaacgacgaacggtaccgtttacgtacgtcgacgacgacggacgtaacgtcccgacccccggagggacccggaacggacggtacgtacgggtcggggacgtaacgggtcgtttcgggtccttacgtacgtacgtactacg

SEQ ID NO: 187793 - DNA, 625 bp, Homo sapiens
  misc_feature: GYAE6OF02HT9YB.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacttgggtgcgacaggcccctggacaagggcttgagtggagtgggaggatcgtcccgtgtcgtttggagtcagcaaactacgcacatgatttccgaggggagagtcgacgagttacggcggacgaagtcgtacggaccacgacgacctagtcgtaggagtcgtagaacgaacgtgaacgacctagaacggacgaaccggtacccgttttaaccgtaccgtacggacgacggacgacggaccgtacccggacccccccggaacggggacccgaacgggacggtaacgtacgggtcggggaaccgtaaccgggtcggtttcgggacccgtttacgtacgttaccgtacgttaaccgg

SEQ ID NO: 187794 - DNA, 730 bp, Homo sapiens
  misc_feature: GYAE6OF02HNVXT.5.64.F09.1.454.CMB.1.raw
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtctgggctgaggtgaagcgccgtgggtcctcggtgaaggtctcctgcaaggcgtcgtgggggcaccgttcggcaagtttcgcctagttacgttgggtgcgtacgacggcccctggacgaagggcttggaggtggagtgggaggntcgtcctgtcgttggancagacaaactcggcaacntcgatttccgaggggtanagtcacggtacgttacgggcggaacgaatccgtacggaccacgacgtcctagtcgtaggacgtactacggaaacgtaacggtacgaacggaaccgttaggaaacgtaccggtaaccgggttacccgttttaaccgtaccgttacggtaccggtacggtaacggaacggtaacccgtacccccgggaccccccccggggaacgggggaccccggtaaaccggggaacggggttaccggttaaaccgggggtaaccggggggtaacccggtaaccgggggttacccgtttttacgggggtaccccgttttacccgtaaacccggtttaccgttaacccgtttaacccgg

SEQ ID NO: 187795 - DNA, 590 bp, Homo sapiens
  misc_feature: GYAE6OF02FVKSJ.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgcctattacttggtgcgacaggcccctggacaagggcttggagtggatggggaggatcgtcctgttcgtttggagcagcaaactacgcacatgatttccgagggagagtcacgagttacggcgacgatcgtacgccacacgcctagtcgtggacgctagaacgacgtagacgacgtagaacgacgtacggtaccgtttactacgtcgacgacgagacgacgtcccgaccccccggacgggaccggaacggtaggtaacggtacgggtacggggaccgtaaccgggtccgttttacgggacccgtttcgtaccgtacgtacgtaacg

SEQ ID NO: 187796 - DNA, 660 bp, Homo sapiens
  misc_feature: GYAE6OF02I078Z.5.64.F09.1.454.CMB.1.raw
tcagatcagacacgcacgaccggtgctcgatttagcgcgtatacaagggggacatcacataacaaccagattcctcctctaaagaagccccctgggagcacagctcatcaccattggactggacctggaggttcctctttgtggtggcagcagctacaggtgtccagtcccaggtgcaactggtgcagtctgggctgaggtgaagacgcctgggtcctggtgaaggttctcctgcaaggcgtctggggcaccgttcggctaagtttcgcctatttacgttgggtgtcgacgacggccccgtaggacgaacgggcttgaggtggagtgggagggatccgtccgtgttcgtttggagtcgacgacaaacgtacgacgacagtgtactttaccggagggagacgtcaacggtagtaccggcggacgaatacgtaaccggccacgacgacctagcgtaggacgtcgtacgaacgaacggtagacgtacgtacgaacggacgaccggtaccgtttacgtacgtcggaccgtcggaacgacgaccgtaccccggaccccccggaacgggacccggaaccgggtaaggtacggtaacgggtcggggaccgtaacgggttccgtttacgggtcccgtttaccgttaaccgttaccgtaccttaaccgg

SEQ ID NO: 187797 - DNA, 588 bp, Homo sapiens
  misc_feature: GYAE6OF02GZQXD.5.64.F09.1.454.CMB.1.raw
  modified_base (370)..(370): a, c, t, g, unknown or other
  misc_feature (370)..(370): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgcctattacttgggtgcgacaggcccctggacaagggcttgagtggatgggaggatcgtcctgtctttggagcagcaaactcgacacatgactttccgaggggtanagtcacggtagttacgggcggacgaagtcgtacggacccacgacgcctatcgtaggacgctagaactaacgtgaacgactagaagaccgacggtccgtttactacgtcgacgcgacgacgaacgtcccggacccccgaggggcccgaacggaggtaacgtacgggtcggggaccgtaacggtcgtttcgggccgttaccgtacgtacttaccgtaacg

SEQ ID NO: 187798 - DNA, 587 bp, Homo sapiens
  misc_feature: GYAE6OF02G55AJ.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgccgtgggtcctcggtgaaggtctccgtgcaaggcgtcgtggggccaccgttcggcaagtttgcctattacgtgggtgcgacacggcccctggacaagggcttgagtggagtgggaggagtcgtcctgtcgttggagcagcaaactcgcacatgtactttcgagggagagtcagacgttacggcggacgatcgtacggccacgacgtcctatctggagtctaggaacaacggtgaagaccgtagaagacgtacggtaccgttacgtacgtcgcgcgagacgacgccccgaccccccggacgggacccgaacggtacggtacgtacgggtcgggaccgtacgggtcgtttcgggccgtttaccgtacgttaccgtagtaaccg

SEQ ID NO: 187799 - DNA, 620 bp, Homo sapiens
  misc_feature: GYAE6OF02F3D42.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtggggcaccgttcggcaagtttgcctattacttgggtgcgacgaggccccgtggacaagggcttggagtggagtgggaggatcgtccgtgttcttggagcagacaactacgcactatgacgttaccgagggtagacgtcgacgtacgttacggacggacgaacgtcgtaccggaccacgacgcctagtcgtaggacgcgtagaacaacgtgaacgtacctagaacgacgacggtaccgtttacgtacgtacggcgacgacgacgacgtccccgacccccccgggaaggggtaccgaaccggtaaggtacgtacgggtacggggtaccgtaccggttacggtttcgggtccgtttaccgtaccgttacgtacctaaccg

SEQ ID NO: 187800 - DNA, 585 bp, Homo sapiens
  misc_feature: GYAE6OF02FMQTG.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtggggcaccttcggcaagtttgccattacttgggtgcgacaggcccctggacaagggcttgagtggagtgggagggatcgtccgtgtctttggagcagacaaacgtacgcacatgatttcgagggagagtcgacgacgttacggacggacgaatcgtacgccacacgcctatcgtggacgctagaacgacgtagacgactaggaagaccgacggtaccgtttacgtacgtcggacgacgacggacgacgtaccccgccccccggaaggggacccgaacggtaggtacgtacggtcggggacgtacgggtcgtttcgggcctttacgtacttaccgtactaacg

SEQ ID NO: 187801 - DNA, 652 bp, Homo sapiens
  misc_feature: GYAE6OF02F5GUS.5.64.F09.1.454.CMB.1.raw
  modified_base (462)..(462): a, c, t, g, unknown or other
  misc_feature (462)..(462): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctggtgaaggtctcctgcaaggcgtcgtgggggccaccgttcggctaagtttgcctagttacgttgggtgcgacacggccccctggaacgaagggtcttggaggtggagttggggaggtactccgtccgttgttcgttggagctagacaaactacgcaactagtgtacgttcggaaggggtagtacgtcgaacgtacgttaccgggcggaacgtaacgtcgtacgaccgatacgtcctatcgtaggacncgtaagaacgaacggtcgaacgaccgtaagaccgaaccgaccggttaccgtttactacgtcgcgaccgagacgtaccgtaccccggaccccccggtaggggacccgaacgggtaacggtacgtacggggtaccgggaccgtaaccgggtcgttttacggaccgtttaccgtaaccttacgtacgtaccgg

SEQ ID NO: 187802 - DNA, 615 bp, Homo sapiens
  misc_feature: GYAE6OF02H3RBB.5.64.F09.1.454.CMB.1.raw
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggccaagttttgccatttacgttgggtgcgacacggcccctggacgaagggcttgagtggagtgggaggatcgtcctgtctttggagcagcaaactcgcacagtgatttccgagggngagtcgacgtagttacgggcggacgaactcgtacggccacacgcctatcgtaggancgtacgaacaacggtagacgtacctaggaacgacgaaccgggtaccgtttactaccgtacgcggtacgacggacgtacgtcccgaccccccggaagggacccgaacggacggtaacgtacgggtacggggtacgacgggttccggtttacgggtaccgttaccgttacgtaccgttacgttaaccgg

SEQ ID NO: 187803 - DNA, 665 bp, Homo sapiens
  misc_feature: GYAE6OF02GLYZL.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaggtctcctgcgaggcgtcgtggggcctacgttcggactagttcgctattcgtggtgcgacgcggcccgtggacgaggtcttaggagtggaggtgggaggacgtccgtccgttgtcgttggagcgagaccgtaaacgtcgacaacgtatgtacgttaccggagggtagtacgtacgaacgtagttacgggacggaactaacgtaccgtaccggccaacgtaccgtactacgtacgagggtacgccgtaacggaaaccgacggtgaaccgtcgtaacggaacgacgtaaccgggttacccgtttaactcgtaccggcggaacgagacgtaccgtaccccccgggaccccgggagggtaccgaacgggaacggttaacggtcggggtacggggacctaccgggttcggttttcgggaccctttcggtaaccttccgtacgtaaccg

SEQ ID NO: 187804 - DNA, 733 bp, Homo sapiens
  misc_feature: GYAE6OF02H4S7D.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgagacgcctgggtcctcggtgaaggtctccgtgcaaggcgtctgggggcaccgttcggcgaagtttcgccagttacgtgggtgcgacacgggccccgtaggacaagggtcttaggacggtggacgtgggaggtagtccggttaccttgtcgtttggagtcgagaccgtaaacgtaccggacacgtatacgtaacgtttacccgaagggggagaacgttcgaacggtacgttacgggacggaacggtaagtaccgtaaccggaccgaacgtaacggacccttaagtccgttacgggacggtacgtacggtaaaccgtaacggttacggaacgtaaccgtaggaaacgacgtaaccgggtaccgtttaaccgtaaccgtacggtaccggacggtacggaacggtaaccgttaccccggaccccccgggaacggggtcccgggaaacggtacgggttaacgtacggggtacggggaccgtaacgggtccgttttacggggccctttaccggttaaccttaccgttaacgttaacccgg

SEQ ID NO: 187805 - DNA, 1014 bp, Homo sapiens
  misc_feature: GYAE6OF02ITOAN.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcgaaggcgtcgtgggggcaccgttcggctaaggtttcgcctatttacttggggtcgcggacacgggccccctgggaccaaggggtcttggaggtgggagttgggggacgggtacgttccggtccccgttggttccgttttggggacgtacgaacggtaccgaaaaccttaccggaccgtaacctacgttacgggtaacgttttacccgggaagggggggtaacgtaacgggttacccgaacgggttaaacggttttaacccgggggaccgggtaaaccggggtaaacgttacccgggtaaacccggggtaccccgtaaaccggtaaccgggtaccccgttaaacggtttaccggttacggggggtaaaccggtacccgggttaaaccgggaaaacccggttaaaccggggttaaccgggtaaaccgggttaaaccccggttaagggaaaacccgggtaaccggttaaaccccgggggtttaccccggtttttaaacccgttaaccggttacgggtacccgggtaccggggtaaacgggtaaaccggtaacccgggttaccccccggggtaacccccccccccgggggtaaacggggggtaaccccccgggtaaaacccgggggtaaacgggggtttaacccgggttaacgggggggttaacccgggggggtaacccgggttaaacccgggggtttacccgggttttttaccggggggttaacccccggtttttacccggtttaaaccccggtttacccgttaaacccggtttaaaccccggg

SEQ ID NO: 187806 - DNA, 1114 bp, Homo sapiens
  misc_feature: GYAE6OF02G8YBW.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgccgtgggtcctcggtgaaggtctcctgcaggcgtcgtgggggcaccgttcggactaagtttcgcctagtttacgttgggtcgcgacgtacggccccgtaggaccgaagggtcttaggaggtgggagtggggagggtactccggtcccgttggttcgtttagggacgtccgaaggaccgaaaaccgttcggacctaacgtacgtacggtttacgtttacccggaaggggggtaacgtacggttaaccgaaccgggttacggttaacccggggaccgggtaaccggtaaacggtttaccccggtaaacccggggtaccccaaaccccggtaaccggtacccgtttaaacgttacccgggtaacgggtaaccggttaaccggttaaccgggtaaaacccgtaaaccggggtttaaccggaaaacccgggttaaaccccgtaaaggggttaaacccggtaaaccggggtttaacccccgggggttttaaacccccgggttttttaaccccggtttaaccggggtttacccggggtaacccggttaacccgggggtaaaccgggttaaaacccgggttacccccggtttaaacccccccccgggggaacccccccccccccgggggggtaaaaacccgggggggttaaccccccccgggggttaaaaaacccccggggggtaaaacccgggggggtttttaaacccgggggtttaaaacccggggggggggttacccggggggggggttaaaaacccccccgggttttaaaccccggggggggtttttacccccggggggtttttttaaccccggggggttaaaccccccgggttttttaaccccccggggttttaaaacccccggtttttaaccccccgggtttaaaacccgttttaaaacccccggggg

SEQ ID NO: 187807 - DNA, 612 bp, Homo sapiens
  misc_feature: GYAE6OF02G2U4M.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagttttgccatttacgttgggtgcgacacggcccctggacaagggcttggagtggatggggagggatcgtccctgtctttggagcagacaaactacgcacatgtatttccgaggggagagtcacgagttacggcggacgatctacggccacacgcctatcgtggagcgtagaacacgtgagaccgtagaacgacaccggtaccgtttacgtacgtcgcgacgagacgacgtcccgacccccccggacggggacccggaacggtacgggtaacgttacggggtacgggggtaccgtaacgggtccggtttttaccgggtcccgtttaccgttaccgttaccgtacgttaaccg

SEQ ID NO: 187808 - DNA, 683 bp, Homo sapiens
  misc_feature: GYAE6OF02H8SBJ.5.64.F09.1.454.CMB.1.raw
  modified_base (605)..(605): a, c, t, g, unknown or other
  misc_feature (605)..(605): n is a, c, g, or t
tcagatcagacacgcacgaccggtgctcgatttagcgcgtatacaagggggcatcacataaacaaccagattcctcctctaaaagaagccccctgggagcacagctcatcaccatggactggacctggaggttcctctttgtggtggcagcagctacaggtgtccagtcccaggtgcaactggtgcagtcgtgggctggaggtgaagacgccgtgggtcctcggtggaggtctccgtgcgaaggcgtcgtgggggctaccgttcggctaagtttcgacctatttacgttgggtgcgacgacggcccccgtaggaacgagggtcttaggaggtggagtgggaggactcgtccgtgtcgtttggagcgagaccaaacgtcgacactatgtacttcggagggagtaagtcgacgtagtacgggacggaacgtaacgtccgtaccggacccgtaacgacgtaccgtatcgtacggacgtcgtaacgtaaacgtaacggtagaaccgtaccgaggaaaccggtacgtaccggttaccgtttaccgtacgtgtaccgtagaaccgtcgaacccgtccccggaacccccgggtaacgggacccgtaaacggnggttaacggtacgggcggggtaaccgtacgggtttccggttacggtcccgtttacgtaacgttacccgtacgtaaccg

SEQ ID NO: 187809 - DNA, 626 bp, Homo sapiens
  misc_feature: GYAE6OF02G4SEA.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgcctattacgttgggtgcgacacggcccctggacaagggcttggagtggagtgggaggatcgtcctgtcgttggacgcagcaaacgtacgacacagtagtacgtttccgaggggagacgtcgaacggtacgttacgggacggaacgtaacgtaccgtacggccaacgacggacctagtccgtaggacgcgtagaactaacggtcgacgtacgtagaacgacgaacggtaccgttacgtacgtacggcgtacgagtacgacgtcccggacccccggacgggacccgaacggtacggtacgtacgggtacggggaccgtaacggtcggtttacgggtaccttcgtaccgttacgttactaacg

SEQ ID NO: 187810 - DNA, 578 bp, Homo sapiens
  misc_feature: GYAE6OF02F3F9L.5.64.F09.1.454.CMB.1.raw
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtggggcaccgttcggcaagtttgcctattacgttgggtgcgacaggcccctggacaagggcttgagtggagtggggaggatccgtcctgtctttggancagacaaactacgcacatgacgttcgaggganagtcagtatacggcgagagtcgtacggacacagcctatcgtggacgcgtagaacgacgtagacgaccgtagaacgacgacggtaccgtttacgtacgtggcgacgacgacgacgtcccggaccccccggagggacccgaacggagggtacgtacgggtcggggacgaccggttcgtttcgggccttacgtacgtaccgtacgtaacg

SEQ ID NO: 187811 - DNA, 755 bp, Homo sapiens
  misc_feature: GYAE6OF02G2TUH.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgcctgggtcctcggtgaaggtctccgtgcaaggcgtcgtggggcaccgttcggctaagtttgcctattacgttgggtgcgacacggcccctaggacaagggtcttgagtggagtgggaggatcgtcctgtcttggagcagcaaactacgacacagttacgtagtttaccgaggggtagtacggtaccgaacggtacgtttaccggggacggtaaccggtaacgtacccggttaaccgggaccccgaaccgacggtacccttaagttccgtagggtacgaccgtacggaaaccgtaaccggttaggaaccggtaacccgttaaggaaaccggaccgtaacccgggttacccgttttaacccgtaaccgttcgggaccggtaacggtaacgggaccgtaacccggtacccccgggtaccccccccgggaacgggggaccccggaaaccggggtaacgggttaaccggtacggggtacgggggacccgtaacggggttccggttttaccgggtacccgtttaccgttaaccgttacccgtaacgttaaccgg

SEQ ID NO: 187812 - DNA, 626 bp, Homo sapiens
  misc_feature: GYAE6OF02IKDHW.5.64.F09.1.454.CMB.1.raw
  modified_base (321)..(321): a, c, t, g, unknown or other
  misc_feature (321)..(321): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaggtctcctgcaaggcgtcgtggggcaccgttcggctaagtttgcctattacttgggtgcgacaggcccctggacaagggcttgagtggagtgggaggtntcgtcctgttcgtttggacgcgagacaaactacgcacatgtactttccgaagggagacgtcgaacgtacgtacgggacgtaacgaagtcgtacgccgacgacgctatcgtaggagctagaacgaacgtagacgaccgtagaacgacgacggtaccgtttaacgtacgtgccgacgaacgacgaccgtacccggacccccccggaacgggacccgaaccggtaacggtaacggtacgggtacggggtaccgtaaccgggttcgtttccgggtaccgtttaccgtaaccgttaccgtaacgtaaccg

SEQ ID NO: 187813 - DNA, 712 bp, Homo sapiens
  misc_feature: GYAE6OF02JEOR3.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcgggtgaaggtctcctgcgaaggcgtcgtgggggcaccttcggcaagtttgccattacgttgggtgcgacgacggcccctggacgaagggcttggagtggagtcgggagggactccgttccctggttcgtttggacgtcgtacgacaaactacgactactatgtactttccgaggggacgaggtaccaacggtagttaaccggtcggtaacgaacgtccgtaacccggaccgaaccgacgtaccgttacgtacggtacggacgaccgttagaaaccgaaccggttacggaacgaccgttacggaacggtaaccgtaccggtaccgtttaccgtacgtacggcggaccgtacggaacggtccgtaccccggtacccccccgggacggggtacccggaacgggtacgggtaacggtacgggtaccgggggaccggtaaccggttcggttttaccgggtacccgtttaccgttaacccgttaccgttaccttaacccgg

SEQ ID NO: 187814 - DNA, 607 bp, Homo sapiens
  misc_feature: GYAE6OF02JC6V5.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtgggggcaccgttcggctaagtttcgcctattacttgggtgcgacacggcccctggacaagggcttggagtggagtgggaggatccgtccctgttcgtttggagcgagacaaacgtcgcacatgtacttcgagggacagtcgacgagttacgggacgtacgaacgtcgtaccggaccacgacgacctagtcgtggacgctagaacgtacgtacgacgaccgtagaacgacgacggtaccgtttacgtacgtcgacgcgacgacgaccgtacccggaccccccggagggacccgaacggtggtaacggtagggtacgggacgtaaccggtcgtttacggtcccgttacgtacgttacctacgtaccg

SEQ ID NO: 187815 - DNA, 594 bp, Homo sapiens
  misc_feature: GYAE6OF02HNEEN.5.64.F09.1.454.CMB.1.raw
  modified_base (369)..(369): a, c, t, g, unknown or other
  misc_feature (369)..(369): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtgggggcaccttcggcaagtttgccattacttggggtgcgacacggcccctggacaagggcttgagtggagtgggaggatcgtcctgtcttggagcagcaaacgtcgcacatgatttccgaggggtanagtcacgagttacgggcgacgaatcgtacgccacagcctatcgtggacgcgtagaacctacgtagacgacctaggaacgacgacggtaccgtttactacgtcgcgtcgagacgccgtaccccgaccccccgggaggggacccggaaccggtacggtacgtacgggtacggggacgaaccgggttcgttttcgggccctttaccgtacgttaccgttactaaccgg

SEQ ID NO: 187816 - DNA, 764 bp, Homo sapiens
  misc_feature: GYAE6OF02IYG8L.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagtctacaggtgtccacgtcccaggtgctaacgtgggtgcagtgtgggctggaggtgaacggcgccgtgggtcctcggtggaacggttctccgtgcgacggtcgtcggtcgggggtcctaaccggttcggcgtaaggtttcgaccgtagtttacgttgggtcgaccgtaccgacggccccgttaggaaccgtagggtcttaggtaggtcggtaggtaggggacgggtagttcccggttcccgttggtttccgtttgggacgtaccgaacgaccgtaaaacgtcggaccgtacgtaactacggttaacgttacggtaaccgggtaagggtaacgtaaccgtaacgggacgttaaaccgggtacgggaaccggtaaccgtacccgttaccggacccgaacggtacgtaccgttacgtacggttacggaggaccgttggaaacgtacgttacgacgaacggtacagaaccgtaccggtacgttaccgtacgtcgtaccgacgtacgtacgaccgttaccgaccccccggtaccgggaccgggtaaccgtacggtacggacgggtcgggtaccgtacggttaccggttccgttaccgtccgtacttacgtaccgtaccgg

SEQ ID NO: 187817 - DNA, 798 bp, Homo sapiens
  misc_feature: GYAE6OF02HW6JR.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctccgtgcgaaggccgtcgtgggggcctaccgttcggctaaggttttcgaccgtagtttaccgttgggtgacgtaccgacggccccctgggaaccaacggggtccttggacggttagggacgtggggaacggtacgttccgttacccgttggttccggttttagggacgtcgtaacggacctaaacgttaccgacgactaagtggttaactttaccgggaacggggtaagtacggttaccgtaacgggtacgttacggggaccggtaacggtaacgtaccgttaacccggacctaacgacgtacctacgtcgtagggacgtacggtacgtaaaccgtacggtacgaacggtaccgtagtaacggacgtaccgggtaccgttttaccgaacgttcggacccggtacggtaaccgggacgtaaccccggtccccgggtaacccccccgggagggggtaacccgtaaccgggtaggggttaaccggtacggggtaccggggggttaacccgtaccgggtttcggtttaccggggtacctttacccgggtaactttaccggtaccgtttaaccgg

SEQ ID NO: 187818 - DNA, 794 bp, Homo sapiens
  misc_feature: GYAE6OF02H9H9X.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgagacgctggtcctcggtgaggtctcctgcaaggcgtcgtgggggcaccttcggctaaggtttcgccagtttacgttgggtgcgtaacgacggtcccccgtaggaacaacgggtctttggaaggtcggtagtggggtaggacttccggttccgttggttcgtttgggacgtcgaggtacctaaacgtaccggcctatacgttaggtactttccggaagggggtacgtacgtaccgaacgggtaacgtttaccggggaccgggtaacggtaacgttaccgaaccgggtacccaagtaaccggaccgttaacgtccgtacggggaacgtcgtacggtaaacctaaacgggtcgaaacggtacccgtaagggaaaccgaaccggtaacccggtaacccgttttacgttaaaccgtcggtacggaaccggaaggtaccggaaccgttcccccgggaacccccccgggacggggaccccggaaacgggttaacggttaacgggtaacggggttacggggggaacccgtaaaccggggtttccggttttacgggggtacccctttaccgtaacccggtttacccgttaaccgttaacccgg

SEQ ID NO: 187819 - DNA, 637 bp, Homo sapiens
  misc_feature: GYAE6OF02G0YYG.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctcttgtggtggcagcagctacaggtgtccagtcccaggtgcaactggtgcagtctgggctgaggtgagacgctgggtcctcggtgaggtctcctgcaaggcgtcgtggggcaccgttcggctaagtttcgcctattacgttgggtgcgacgaggcccctgggacgaagggcttagagtggagtgggaggactcggtccctgttctttgggagcgagacaaacgtacgacacatgtacttcgagggatacgtcacgagttaccgggacggacgaactacgacggtaccgaacgacgtaccgtactcgtacgggacgtctaggaaccgaacgtagacgaccgtagaacgacgaccggttaccgtttacgtaccgtgtaccgacggtacgacgtaaccgcccggaccccccggaggggacccgtacgggaaaacggtcggtacgggtcggggaccgtaacgggtccggtttacgggtaccctttaccgtaacgttaccgtactaccgg

SEQ ID NO: 187820 - DNA, 593 bp, Homo sapiens
  misc_feature: GYAE6OF02GAPTD.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaggcgtcgtgggggcaccgttcggcaagtttgcctattacgttgggtgcgacaggcccctggacaagggcttggagtggagtgggagggactcgtccctgttcgtttggagcgacgacaaactacgcacatgtactttccgagggagtagtcgacgtagttacggcggacgaatcgtacggcacacgacctagtcgtggacgctagaacgaacgtgagacctagaacgacgacggtaccgtttacgtacgttgacgcgaagcgacgtcccgaccccccgggacgggaccggaacggtacggtagtacgggtcgggaccgtaacggtcggttttcgggcctttcgtacgttacctacgtacg

SEQ ID NO: 187821 - DNA, 723 bp, Homo sapiens
  misc_feature: GYAE6OF02GJ9E5.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagacgtccgtgggtcctcggtgaaggtctcctgcgaaggcgtcgtggggccaccgttcggctaagtttcgcctagttacgttgggtcgcggacgacggccctgggacgaagggtcttcggaggttggagtgggaggtatccggttccgtgttcgtttgggagtcgaacgtaccgaaaacttacgggacctagaagttcgtaacgttttacccgggaaggggtaacgtacgtccgtaaacggtaacggtttaccgggacggtaacgtaacgtacggtaccggaccgaacgacggtaccgtacgttacgtacggacgaccgttaacggaaaccgtaacggtacggaacgtaaccgtaggtaaaccggaacgtaccggtaccgtttaccgtaccgttcggaccgtcgaacgacgtaccgtaccccggacccccggtagggacccgaaggtacggtaacgtacggggcggggtaacgacggttacggttcgggtaccttaccggtacgttaccgtacgtaaccgg

SEQ ID NO: 187822 - DNA, 723 bp, Homo sapiens
  misc_feature: GYAE6OF02JO26Z.5.64.F09.1.454.CMB.1.raw
  modified_base (249)..(249): a, c, t, g, unknown or other
  misc_feature (249)..(249): n is a, c, g, or t
tcagatcagacacgcacgaccggtgctcgatttagcgcgtatacaagggggcatcacataacaaccagattcctcctctaaagaagcccctgggagcacagctcatcaccatggactggacctggtaggttcctcttgtggtggcagcagctacaggtgtccagtcccaggtcgcaacgtggtgcagtcgtgggctgaggtgaagacgcgtgggtcctggtgaagtctccgtgacgaaggtcgttcggnggggtacctaccgttcggactaagttcgcctagttacgttggtgaccgacacggtccccgtggaacgtaagggtcttggtacggtaggaggtggggtaggtacgtccggtaccgttggttacgtttgggacgtaccgagtacccgtaaacgtcgacgtactagttacgtactttaccggaagggtagtacgtacgaacgtacggttacgggaccgggtaacgtaacgtccgtacggacccgacgacggtccttaacgtacgtagggtactccggtagaaaccgacggtacgacgtaaccgtaaggaacgtaccggaaccgttaccgttacgtaacgtcggtaccgtagacgtaaacggtaccctaccccgggaccccggaggacccggtaagggtaaccggtaggtacgggacgggtaaccgtaacggttcgttaccgggtacccttaccgtaaccgttaccgaacgttaaccg

SEQ ID NO: 187823 - DNA, 622 bp, Homo sapiens
  misc_feature: GYAE6OF02H2YQ7.5.64.F09.1.454.CMB.1.raw
  modified_base (180)..(180): a, c, t, g, unknown or other
  misc_feature (180)..(180): n is a, c, g, or t
  modified_base (238)..(238): a, c, t, g, unknown or other
  misc_feature (238)..(238): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctcttgtggtggcagcagctacaggtgtcagtcccaggtgcaactggtncagtctgggctgagtgagacgcctgggtcctcggtgaaggtctcctgcaaggtcgtgnggggctaccttggcagtttgcctattacgtgggtgcgacacggcccgtgacgaaggtcttggacgttggatgggaggatccgtcctgtnttaggngcagcaaactcgtcacgagtcgtattccggaagggtgaactcgacgtagtacggcgaacgtatccgtacggccgtacgtagtcctagtacgtacggagcgttacgaacgtacgtcgactaccgtagaaacgacgaacccggggttaccttaaccgtagtccgacggtccgacgagtaaccgcccggtaccccgggaagggtcccgaacggtacggttaacggtacggacggggtccaacgggttccgttacgggggacctttaccgtacgttaccgtaccgtaacccgg

SEQ ID NO: 187824 - DNA, 803 bp, Homo sapiens
  misc_feature: GYAE6OF02GAINQ.5.64.F09.1.454.CMB.1.raw
tcagatcagacacgcacgaccggtgctcgatttagcgcgtatacaagggggcgatcacataacaaccagattcctcctctaaagaagcccctgggagcacagctcatcaccatggactggacctggaggttcctctttgtggtggcagcagctacaggtgtccagtccaggtgcaactggtgcagtcgtgggctgaggtgaagacgctgggtcctcggtgaaggtctctgcaaggcgtcgtggggcaccgttcggcaagtttgacctagttacgttgggtgcggacagggcccccttagggacgtaaacggggtccgtttaggacgggttacgggtaagttagggggggaacggggtaacgtttcccgggttccccggttagggtttacccgtttttggggtaacggaccgtaaacgggtacccgtaaaaaccggttacggtaacccgaacgtaacgtttaccggaaccgtttttacccgggaaaggggggacggtaaacgggtttaccgaaaccggtaaggtttaacccggggacgggtaacggtaaacgtacccggttaaccgggacccgtaacgacgtaccgttaactacgtcgggtaccgacgttacgaaaccgtaacggtacgtaacggaacgtacggtaaacgcgtaacggtaccgttacgacgttcggacgtacgagacgtacgacccggacccccggtaacggggacccgaacggtaacggtacgtacgggacgggtaccggaacggttccggtttacgggttacccgttacgtacccgtaacgtaccgttaacg

SEQ ID NO: 187825 - DNA, 612 bp, Homo sapiens
  misc_feature: GYAE6OF02FPXSF.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgcctattacgttgggtgcgacacggcccctggacaaggggcttgagtggagtgggaggatccgtcctggttcgtttggagcagacaaactacgcacatgagtttccgaggggagagtcacggattacgggcgaacgatcgtacggccacgacgcctagtcgtaggacgctagaacgaacgtagacgaccgtagaacgacgaccggtaccgttacgtaccgtagcgacgacgaacggtaccgtaccccggaccccccgggacggggacccggaaccgggtagggtaacgtacgggtacggggacgtaacgggttcggtttcgggtccttacgttactacgtacgtacg

SEQ ID NO: 187826 - DNA, 738 bp, Homo sapiens
  misc_feature: GYAE6OF02GFA33.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtggggccaccgttcggctagtttgcctattacgttgggtgcgacacggtcccctaggacaagggcttgagtggagtggggaggagtcgtccgtgttcgttggagcagctaaacgtcgcacatgtacttccgagggagtagtcgacgtagttacgggcggtaacgaatcgtaaccggccaacgacgtccgttaacgtcgtacgggacgtccgtaacggaaaccgtaacggttaggaaccgtacccgtaaggaaacggtaacccggtacccgggttacccggttttaaccgtaaccgtacgggtaccggtaccgggtaaacgacggtaacccggtccccccgggaacccccccggggtaacgggggaccccggaaaccggggtacgggttaaaccggttacggggggtaccgggggtaacccggttaaccgggggttccggtttttaccggggtaccccttttaaccggttaacccgtttaccgtaaccgttaacccgg

SEQ ID NO: 187827 - DNA, 645 bp, Homo sapiens
  misc_feature: GYAE6OF02F0P27.5.64.F09.1.454.CMB.1.raw
  modified_base (283)..(283): a, c, t, g, unknown or other
  misc_feature (283)..(283): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgcctgggtcctcggtgaaggtctcctgcaaggcgtcgtgggggccaccgttcggcaagtttgccattacttgggtncgacaggcccctggacaagggcttggagtggacgtggggacgggatccgtccctggttcgtttggagctagacaaactcgcacagtgtatttccggagggacagtcacggtacgttacgggcggacgaagtcgtacggccacgacggaccttagtcgtggacgctaggaaccgacggtagaacgtacgtacggaacgacgtaccgggtccgtttaccgtacgtcgtcggaccgagacggtacgaccccggacccccccgggaaggggtaccccgacgggtaacggtaaggtacggggtacgggggaccgtaccgggtcggttttaccgggtcctttaccgtacgttaccgttacgtaaccgg

SEQ ID NO: 187828 - DNA, 595 bp, Homo sapiens
  misc_feature: GYAE6OF02GQSRS.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggaggatcggtccctgtcgtttggagcagcaaactcgacacatgtatttccgaggggagagtcacgtattacgtacggacgaagtctacggccacacgcctatcgtggacgctacgaacgtaacgtacgagaccgtagaacggacgaccggaccgtttacgtacgtcgacgacgagacgtacgtacccgaccccccggacggggacccgaacggacgggtagtacgggtacggggacgtaaccgggtcgtttcgggcctttccgtacgttaccgtacgtaaccg

SEQ ID NO: 187829 - DNA, 703 bp, Homo sapiens
  misc_feature: GYAE6OF02HL15Y.5.64.F09.1.454.CMB.1.raw
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctcctgcaaggcgtgtgggggcaccgttcggactaagtttcggacctagtttaccgttgggtcncggacacgggcccctggacgaagggtcttggaggtggagtggggaggtntcgtcccgtgtcgttggngcagacctaaacgtccgcaacgtataggtactttaccggaggggtaacgacgttaccaacggtaacgttaccgggacggtaacgaacgtaccgttaccgggacctaccgagtacccgttatacgttagggacgacgttacgaaacgtaacgcgtaacggaccgtacggaacgtaaccggacggtacccgtttaacgtacgtcggacgtaccgtacggacggtaacctaccccgggaccccccggtacggggacccgtaacgggtacggaacggtacggggtacgggacccggtaacgggttccggtttacgggtaccttaccggtaccttaccgttacgtaccgg

SEQ ID NO: 187830 - DNA, 727 bp, Homo sapiens
  misc_feature: GYAE6OF02HV4LN.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtgtccagtcccaggtgcaactggtgcagtcgtggggctggaggtgaagacgccgtgggtcctcggtgaggtctccgtgcgaaggcgtcggtcgggggcctaccgttcggactaaggtttcgcctagtttacgttgggtcgcgacgacggcccctggacgaacgggtcttaggacggtgggagtggggaggtattccggtcccgttggttcgttttgggacgtcgacgactaaaccgtaccgcaactagtcgtaacgtttacccggaagggggtacgtacggttaccgaacggtacggttaccgggaccgggaacgtaaacgtccgtaaccggaccgaacgacggtacctagtcgtacggtacgcgtacgaacgtaacgtgacgaccgtagaacgacgaccggttaccgtttacgtaccgtacgcgacgacgacgaccgtaccccggacccccggtacgggacccgtaacgggtaacggtacggttaacggggtacggggtaacccgtaaccgggttccggttttaccgggtacccgtttaccgttaccgttaccgttaccgttaaccgg

SEQ ID NO: 187831 - DNA, 822 bp, Homo sapiens
  misc_feature: GYAE6OF02G0BTC.5.64.F09.1.454.CMB.1.raw
tcagatcagacacgcacgaccggtgctcgatttagcgcgtatacaagggggcatcacataacaaccagattcctcctctaaagaagccctgggagcacagctcatcaccatggactggacctggaggttcctctttgtggtggcagcagctacaggtgtccagtcccaggtgacaactggtgcagtcgtcggggctggaggtgaagacgccgtgggtcctcggtggaacggtctacctgcgaaggtcgtcgtgggggcctaccgttcggactaagtttcgcctaattacgtttggggtcgtcggaacgtaacgggcccccgtagggaaccgtaaaacggggtccgtttaggaacgggttgggtaagttacgggggaaggggtaacgttccgggtaccccgttggtttaccgttttggggaacgtccgtaaaggtaccgtaaaaaccgttaccggactaaccgtaacgttagtaacgtttacccggaagggggtaacgaacggttaccaaacgggtaacgttaacgggtacgggtaaacgtaacgttaccgtaaccggtaccgtaacgacggtacccttagtccgtacggagtccgttaaggaaccgaaacgttacggtacgaacgttaggaaacggtaacgaccggttaaccgtttactaaccggtgaccggtacgaacggtacgtaccgtaccccgaaccccccgggaggggacccgtaaaccgggaacggttaacggtaaccggggtacggggtaccgtaaaccggggttccggtttacgggtcccgttacggtaaccgtttaccggttaacctaaccgg

SEQ ID NO: 187832 - DNA, 935 bp, Homo sapiens
  misc_feature: GYAE6OF02HDYZW.5.64.F09.1.454.CMB.1.raw
  modified_base (919)..(919): a, c, t, g, unknown or other
  misc_feature (919)..(919): n is a, c, g, or t
  modified_base (922)..(922): a, c, t, g, unknown or other
  misc_feature (922)..(922): n is a, c, g, or t
  modified_base (930)..(933): a, c, t, g, unknown or other
  misc_feature (930)..(933): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaagtctctgcgaggcgtcgtggggcaccgttcggcaagtttgccattacgttggggtgcgacgacggcccctgggacaaggggtcttggagtggagtggggagggatcgtcccgtgtcgtttggagtcagacgaaactacggcaacagtagtacgttttccggaagggggtactaacggtaccgtaacggtaacggtttacgggaaccgggtaacggtaacgttacccgtaaaccgggtaccccgaaccgtaaccgggtacccgttacggttacccgttaggggtaaccggtaccgttaacgggtaaaacccggttaaaccggttacggggtaaaccgtaaaccccggttaaccggggtaaaaaccggaacccggggttaaaccccgggggttaaccccccgggtttttttaaaccggttaaccccgggttttaacccgggggtaacccccgggggtttaaacccggggggtaaaacccgggggttaaaaaccccggggttaaaacccccccgggttttaccccccccccccggggggggaaacccccccccccccccccccgggggggttttaaaaacccggggggggggggaaccccccccccccggggggtttaaaaaaaaccccccggggggggttaaaaaccccggggggggggttttttaaaaaaccccccgggggggtttaaaacccccgngcngcgtgctnnnncg

SEQ ID NO: 187833 - DNA, 906 bp, Homo sapiens
  misc_feature: GYAE6OF02JDBKU.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagacgccgtgggtcctcggtgaaggtctcctgcgaaggcggtcgtgggggcctaccgttcggtacgtaagtttcgacctagtttacgttgggtacgcgtaccgacgggtcccctagggaccaagggtccttggaggtggagtaggggaggtacgttcggtaccgtggttccgttaggacgtccgaggtacctaaacgttaccgacgtaacgtacgtacgtaacgtttccggaaggggtactaacggtaccgtaacggtacggttaccgggtaccgggtaaaccgtaacgttacccggtaaccgggaacccctaacggtaaccggttacccgtaacggttaccggtacgggtaacgtaccggttaacggaaaccggttaaccggtacgggtaaaccggtaacccgttaaggggaaaaccggttacccgggtaaaccggggttacccgtttttaaccggtaaccgggttaccgggtacccggtaacgggttaaccgggtaaaccggttaaccccgtaccccccgggggtaaacccccccgggttaacggggggaacccggtaaaacccgggtaccggggttaaaccggttacggggggttaacccgggggaacccgtttaaaccggggttccccgggttttttaacgggggacccctttttaaacccggggtaacccgtttaaacggttaaccccgttaaaccggg

SEQ ID NO: 187834 - DNA, 558 bp, Homo sapiens
  misc_feature: GYAE6OF02GTNEY.5.64.F09.1.454.CMB.1.raw
  modified_base (365)..(365): a, c, t, g, unknown or other
  misc_feature (365)..(365): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtgggggcaccgttcggcaagtttgccattactgggtgcgacaggcccctggaccaagggcttgagtggatgggaggatcgtcctgtctttggagcagcaaactacgcacatgattccgaggganagtcacgattacggcggagaatcacggccacacgcctagtctggagctgaacaacgtgacgactgaacgacgaccggtacgttacctacgtgcgcgagagacgtcccgccccccggagggcccgaacggacggtagtacggtcggggacgtaacgggtcgtttcgggccgtttacgtacgttactacttaacg

SEQ ID NO: 187835 - DNA, 645 bp, Homo sapiens
  misc_feature: GYAE6OF02GYX1A.5.64.F09.1.454.CMB.1.raw
  modified_base (502)..(502): a, c, t, g, unknown or other
  misc_feature (502)..(502): n is a, c, g, or t
  modified_base (579)..(579): a, c, t, g, unknown or other
  misc_feature (579)..(579): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctggaggtgaagacgccgtgggtcctcgggtgaaggtctcctgcgaaggcgtcgtgggggcaccgttcggctaagtttcgcctatttacgttgggtgccgacgacggccccgtggacgaagggtcgttaggacggtggagtggggagggacttccggtccgtgttcgtttggagcgagactaaacgtcgacacgtatcgtacgttccggaaggggtatacgtacacggtagttaccgggacggtaacgaagttaccgtaccgggaccaacgacgtacctagtcgtaggacgtctaaggaaccgtaacggngaacgacgtagaacgacgaccgtacgttacgacgtgacgcgaagcgtaccgcccgaccccggacgggaccgaacggnggtaacggtcgggacgggtacgacggttcgtttcgggtccctttaccgaacgttacgtactaacgg

SEQ ID NO: 187836 - DNA, 662 bp, Homo sapiens
  misc_feature: GYAE6OF02FHZON.5.64.F09.1.454.CMB.1.raw
  modified_base (357)..(357): a, c, t, g, unknown or other
  misc_feature (357)..(357): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgcctattacttgggtgtcgacaggcccctggacaaggggcttgagtggatgggagggagtcgtccgtgtcgttggagctagcaactacgcanagtgattcgagggagagtcacgattacgggacggacgatacgtacggccacgacgtacctagtcgtaggagcgtagtaacgaacgtgaacgaccgtaggtaacgacgtaccggtaccggtttaccgtaccgttacggtaccggtacgaacggtaacgtaccgaccccgggtaccccccccgggacggggtacccggaaccgggtaacgggtaacgttaacggggtcggggggtaaccggtaaccggggttccgtttacggggtaccccgtttacgttacccgttaaccgttaccgttaaacccgg

SEQ ID NO: 187837 - DNA, 682 bp, Homo sapiens
  misc_feature: GYAE6OF02JSZJ0.5.64.F09.1.454.CMB.1.raw
tcagatcagacacgcacgaccggtgctcgatttagcgcgtatacaaggggcgatcacataacaaccagattcctcctctaaagaagacccctggagcacagctcatcaccatggactggacctcggaggttcctctttgtggtggtcgagcagctacaggtgtccagtcccacggtgcaactgtgcagtctgggctgaggtgaagacgcctgggtcctcggtgagtctctgcaggcgtctggggcaccgtggcgaagttgccagttacgttggttgcgtacgaggcccctacggacgaagggcgtgaggtggagtgggaggacgtcggtacccgttggtcgtttcgggagtcgtagtacgtaaaccgacgtacgactacgtacgtagtttacccgagggtaacggagttaccgaaacggtacgtttaacccgggaggaacccgtaaagttaccggttaaccggaccccgtaacgacggtacccgtaacgtacgtacggtaacgcgtaacgaacgaaccgtagaaccgacgtaggaacggacgtaccgtaccggttactacgtcgtacgaccaggtaaacgactcccggaacccccggtacgggaccggtaaccggaacggtacgtacggacgggtacgacgggttacttcgggtaccttcggtaacttaccggtattaccgg

SEQ ID NO: 187838 - DNA, 769 bp, Homo sapiens
  misc_feature: GYAE6OF02H2JC1.5.64.F09.1.454.CMB.1.raw
  modified_base (249)..(249): a, c, t, g, unknown or other
  misc_feature (249)..(249): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgacactggtgcagtcgtggggctggaggtgaaggacgccgtgggtccgtcgggtagaggtctcgtgcgaggcgtcgnggggctaccgttcggctaaggtttcgcctagtttaccgtggggtgacgacgacggtccccgtaggtacgaaggggtccttggaggtggagttggggaggtagtcccgttccgtggttcttgggagtccaagaccaaaaccgttcgacctaacagttacgtaacggtttaccggaagggggtaagtaccggtaaccgtaacggtacgtttaaccggggacgggtaaacgtaacgtcggtaacccggcccgtaagacgtacctagtcggtaggacgttgaacggtaaacgtacggttacgaacggtaccctaggaaacggaccgttaaccgggtaccgttttacaaccggtacgaccgggtagaaccgggtaacacccggttacccccgggaccccccgggaggggttaccccggaacgggtaacggtacgggttaaacggggcccgggggaacgttacccgggttaccgggttttacgggacccccttttaacggtaaccgttaccgttaccgttaacggg

SEQ ID NO: 187839 - DNA, 602 bp, Homo sapiens
  misc_feature: GYAE6OF02FSH73.5.64.F09.1.454.CMB.1.raw
  modified_base (371)..(371): a, c, t, g, unknown or other
  misc_feature (371)..(371): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctggtgaaggtctcctgcaaggcgtcgtgggggcaccttcggcaagtttgcctattacgttgggtgcgacacggcccctggacaagggtcttgagtggatgggaggatcgtcctgtctttggagcagcaaactacgcacatgtacttacgagggganagtcgacgtagtacgggcgacgaagtcgtacggccacgacgacgtatcgtggacgacgtagaaactaacgtcgaacgtaccgtaggaacgaccgtaccgggtaccgtttaacgtacgtcggccggtacgaagacgaccgtccccggaccccccggacggggacccgaacggaggtacgtacgggtcgggacgtacgggtcgtttcgggccttcgtaccttactacgtaacg

SEQ ID NO: 187840 - DNA, 850 bp, Homo sapiens
  misc_feature: GYAE6OF02J1ROG.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctcttgtggtggcagcagctacaggtgtccagtcccaggtgcaactggtgcagtctggggctgaggtgaagacgcctgggtcctcggtgaaggtctctgcaggcgtcgtggggctaccgttcggctagttgcctattacgtggtgcgacgacggccccgtggaccgaaggggtccgttaggaggtaggagttgggggaaggggtaacgtcccggttcccccgtgggtttccgtttaggggtacgtccgtaacgaccgtaaaaccgttaccgggacctaacgtaacgttacggttaaacgttttcccgggaaacggggggtaggtaacggttaccggtaaccggttaacgtttaacccgggtttaccgggaaccgttaaacgtaccgttacccgggacccgtaaacctacggacccttaagtcccggttaggggaacgtacgtaacggttaaacctaaacgggttcggtaaacggacccttaacgggaacgtaacccgtaacgggttaaccccgttttacgtaaccggtcggtacggtaccggaagaaccggtacggtaccccccgggtaaccccccccggggaccggggtaacccggaaccgggtaaccggggttaaggttaacggggtacccggggggtaaccgtaacccggggtttccgggtttttacgggaccccgtttttaccgtaacccggtttaacgttacccgttaaaccgg

SEQ ID NO: 187841 - DNA, 655 bp, Homo sapiens
  misc_feature: GYAE6OF02JZTF1.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctcttgtggtggcagcagctacaggtgtccagtcccaggtgctaactggtgcagtcgtagggctggaggtgaaggacgccgtgggtcctcggtggaacggtcctccgtgcgtaaggtggtcgtgggggcctaccgttcggataacggtttcgccgtagttacgttgggtcgcggtacgaccgggccccgttaggacgtaaggggtcgttggtaggtggagtgggtacgggacgtcggtccgtgttcgtttggcgtcgagactaaacgtcgctagactggtacttacggagggagagtcgaacgtagttacgggcgaagtacgtcgtacggccacgacgtcctagtacgtggagcgtacgaaacgtagtggaaccgtatacgggaacgtacggtaccgtacggttacctacgtcgacggtacgagaacgccgtaccccggaccccggagggaccgacgggtaacggtacgtacgggtagggaccgtacggtcgttcggcctttacgtacgtaccgttacctacgg

SEQ ID NO: 187842 - DNA, 736 bp, Homo sapiens
  misc_feature: GYAE6OF02F5225.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagctagctacaggtgtccagtcccaggtgcaactggtgcagtctggggctgaggtgaagacgcctgggtcctcggtgaaggtctcctgcaaggcgtcgtgggggcaccttcggcaacgttgccattacgttgggtgccgacacggccccgtggacaagggtccttggagtcggagtggggaggagtccgtcctagtcgtttggagtcgagctaaacgtacgctaacgtataggtactttccggaaggggtacgtacgtacgtaaccgtaagttaccgggcgggtaacgtaacgttaccgtaccgggtaccaaccggacgtaccgttaagttccggtagggtacgtacgtacggtaaacgtacggttaagacggtaccgttacggaacggtaaccgtaacccgggtacccggttttacgtaaccggttacggtaccggtacggtaacggaacgtaccgtaccccgggaccccccgggtacgggggacccggtaaaccggtacgggtaacggtaccggggtacggggtaaccgtacggggttacgttttcggggtaccctttaccgtaaccggttaccgttaccttaaccggg

SEQ ID NO: 187843 - DNA, 741 bp, Homo sapiens
  misc_feature: GYAE6OF02GOWYR.5.64.F09.1.454.CMB.1.raw
  modified_base (615)..(615): a, c, t, g, unknown or other
  misc_feature (615)..(615): n is a, c, g, or t
tcagatcagacacgcacgaccggtgctcgatttagcgcgtatacaagggggcgatcacataacaaccagattcctcctctaaagaagcccctgggagcacagctcatcaccatggactggacctggagggttcctctttgtggtggcagcagctacaggtgtccagtcccaggtgcaactggtgcagtcgtgggcgtgagggtgaagacgccgtgggtccgtcggtggaagggtctccgtgcgaacggcgtcggtgggggccgaccgttccgggcgtaacgtttgccgtattaccggttgggttcgcggacgtacgggtcccccgtagggaaccgtaacggggccgttaggaggttcgggaaggtggggaagggtacgtccggttcccgttggttcgtttcgggacggtcgtacggaccaaacgtaacgccgaagtagtcggtaacgtttacccggagggggtaacgtaaggttacgaacggtacgttaccgggacgggtaacgaacgtaccgtaccgggaactaaaacgccttaagtccgtagggactcgtaacgaacgtaacgtagacgacagaacgaccgtacggtaccgttacctacggtacgcgacgganacggcggtaccccgacccccgggaagggcccgaaacgggtcggtaacggtaggggtcgggggtaaccaacggggttcgtttaccggggtaccttaccgtaaccggtaacttaccgacgttaacggg

SEQ ID NO: 187844 - DNA, 647 bp, Homo sapiens
  misc_feature: GYAE6OF02FN6XX.5.64.F09.1.454.CMB.1.raw
  modified_base (343)..(343): a, c, t, g, unknown or other
  misc_feature (343)..(343): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagcgccgtgggtcctggtgaggtctcctgcaaggcgtcgtggggcaccgttcggcaagtttgccattaccttgggtgcgacacggcccccgtggacaagggcgttgagtggagtgggagggatcgtcccgtgttcgtttggngcgagacaaaccgtacgcacgtatgacgtttaccgaggggacgtaggtaccgtacgtacgttacgggaccggacggtaaacgtccgtaaccgggacccaaccgacgtacccttacgtccgtaggtacgccgtagaacgtaacgtaggaacgtaaccgagtaacgacgtacgggtaccgtttactacgtaggtccgcgagacgtacgccccggaccccccggagggccgaacggtacggtaacgtcgggcgggtacgtacgggtacgtttcgggtaccgttaccgtacgttaccgtacgttaccg

SEQ ID NO: 187845 - DNA, 720 bp, Homo sapiens
  misc_feature: GYAE6OF02H0EBH.5.64.F09.1.454.CMB.1.raw
  modified_base (529)..(529): a, c, t, g, unknown or other
  misc_feature (529)..(529): n is a, c, g, or t
tcagatcagacacgcacgaccggtgctcgatttagcgcgtatacaaggggcatcacataacaaccagattcctcctctaaagaagccccctgggagcacagctcatcaccatggactggacctggaggttcctctttgtggtggcagcagctacaggtgtccacgtcccaggtgcaacgtggtgcagtcgtgggctgaggtgaagaccgtccgtgggtcctcgggtagacggtctccgtgcgaaggtccgtcggtacggggcctaccgttcggaccgtaaggtttcgccgtaacgttttacggttcggggtcgaccgaccgaccggtcccccgtagggaccgtaaggggtccgttggtacggtagggaggtacgggggagggaccgttccggtccccgttagttccgtttggacgcgacgaactaaccgtacgcaactagtatacgtttaccggagggtacgtgtacgacggtagtaccgggacgacgtaactccgaccggacacgtacgtacgtacgtacgtcggacncgtagaacgtacgtagacgtaccgtagaaccgacgtaccggtaccgtttacctcgtaccgtccggacgacgacggtaccgtccccggacccccggacggggacccgtaacggacgggtacggtacgggtcgggtaaccgtaccgggttacggtttcggcccgtttaaccggtacgttaccgtaccgtacgg

SEQ ID NO: 187846 - DNA, 633 bp, Homo sapiens
  misc_feature: GYAE6OF02GDG0M.5.64.F09.1.454.CMB.1.raw
tcagatcagacacgcacgaccggtgctcgatttagcgcgtatacaagggggcatcacataacaaccagattcctcctctaaagaagccccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgcctattacttagggtgcgacaggcccctggacaagggcttgagtggagtgggagggatcgtccctgtcgtttggagcagcaaactacgcacatgtatttaccgaggggagacgtacacgtagttaccgggacggtaacgaattccgtaccggaccaaccgaacgccttatacgtagggagtccgtaggaaccaacggtcgaagacctagaagaccgacggtaccgtttactacgtcgacgcgaagacgacgtaccccgacccccccggagggacccggtaacggacggtaacgtacgggacgggggtaccgtaaccgggttacgttttcgggtacccttaccgttaccgttaccgtaccgttaacgg

SEQ ID NO: 187847 - DNA, 706 bp, Homo sapiens
  misc_feature: GYAE6OF02JI711.5.64.F09.1.454.CMB.1.raw
  modified_base (252)..(252): a, c, t, g, unknown or other
  misc_feature (252)..(252): n is a, c, g, or t
  modified_base (349)..(349): a, c, t, g, unknown or other
  misc_feature (349)..(349): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtgtgcagtctgggctgaggtgaagacgcctgggtcctcgggtgaaggtctcctgcgaaggcgtcgtgggggccnccgttcggctaagtttgcctattaccgttgggtagcgtacacggccctggacgaagggtctgacgtggagtggggaggatccgtcctgttcgttggngcagccaaacgccgcgacataggagtttaccggagggtaacgacggtaccgtaacggtagtttaacccggggacggtaaccgtaagttaacccggttacccgggaaccccgtaaccgtaacggtacccgttaccgtacgtacgggtacgtccgtaacgaaaccgtaacgtacggaaccgtaccgtagaaccgtacgaccggttaccgtttactaccgttggacgcgaacggtacgtaccgtcccggacccccccgggaagggtaccggaacggacgggttaacgtacggggtacggggacccgtaacggttccggtttacgggtcccgttacgttaaccgttacctaacgttaaccg

SEQ ID NO: 187848 - DNA, 712 bp, Homo sapiens
  misc_feature: GYAE6OF02IM4PS.5.64.F09.1.454.CMB.1.raw
tcagatcagacacgcacgaccggtgctcgatttagcgcgtatacaagggggcatcacataacaaccagattcctcctctaaaagaagcccctgggagcacagctcatcaccatggactggacctggaggttcctctttgtggtggcagcagctacaggtgtccagtcccaggtgcaactggtgcagtcgtgggctggaggtgaagacgccgtggtcctcggtagaagtctcctgcaggcgtcgtggggccaccgttcggtctaacggtttgccctagtttacgtttgggtcgcgacgacggccccgtggaacaagggcgttggaggtgggacgttaggggagggtacgtccgttcccgttggttcgtttagggaggtacgaacgtacaaaaccgttaacgacgaacgacgtagtactttaccggaggggtacgtaagtaccgtaacggtaagttaaccgggacggtaaacggtaaagttacccgtaacgggcctaacgtacgaaccgttatcgtaggacgacgtacgaaaccgtaacggtacgaacgtaacgtacgaaacgacgtaaccgttaccgtttaccgtacgtaggcgaccggagacgaaccgtacccggacccccggacgggaaccgaacggtaacggtacgacggggtacgggaacgtaacggttaccgtttcggtccgtttaccgtacttaccgtacgtaacgg

SEQ ID NO: 187849 - DNA, 596 bp, Homo sapiens
  misc_feature: GYAE6OF02GC744.5.64.F09.1.454.CMB.1.raw
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgctgggtcctcggtgaggtctcctgcaaggcgtcgtgggggcaccttcggcaagtttgccattacttgggtgcgacacggcccctggacaagggcttggagtggagtggggaggactccgtccgtgtctttggngcagcaaactacgcacatgatttcgaggganagtcacgagttacggacggacgaagtcgtacggaccacacgctatcgtggacgctacgaactacgtgacgaccgtagaacgacgaccggtacctttaccgtacgtcggacgcgacgacgacgtccccggaccccccggagggacccgaacggtaacggtacgtacgggtacggggacgtaacgggtcgtttcgggtacctttaccgtacgttaccgtacgtaaccg

SEQ ID NO: 187850 - DNA, 686 bp, Homo sapiens
  misc_feature: GYAE6OF02GZ1PJ.5.64.F09.1.454.CMB.1.raw
  modified_base (401)..(401): a, c, t, g, unknown or other
  misc_feature (401)..(401): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctccgtgcaggcgtcgtggggcaccgttcggctaagtttgcctagttacgttgggtcgcgaacgacgggcccccgttgggaacgaaggggcctttaggaggtgggagtgggggagggtactccggtccttggttcgtttggagcagacaaactcgctacatgattccgagggganacgtcaacgtacgttaacgggtacggaacgtaagtaccgtaccgggaccaacgacgtaccgttacgtacgtaggacgtcgtacgaaacgtacggtagacgaccgtagaacggaacgtaccgggtaccgtttacgtaccgtcggtcgacgaacggacgtaaccgccccggtaccccccggggacggggacccggaacgggtaacgggttacgtaacggggtcggggaccgtacgggttccggttttacgggtacccgtttaccgtaccgttaccgtacgtaaccgg

SEQ ID NO: 187851 - DNA, 744 bp, Homo sapiens
  misc_feature: GYAE6OF02IAH86.5.64.F09.1.454.CMB.1.raw
  modified_base (341)..(341): a, c, t, g, unknown or other
  misc_feature (341)..(341): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtcagtcccaggtgcaactggtgcagtcgtgggctggaggtgaagcgcctgggtcctcgggtagaacggtctccgtgacgaaggcgtcggtgggggctaccgttcggactaaggtttgcctagtttaccgttgggtgcgacgacggccctggaaccgaagggcttggagtggagtgggaggtntccgtcctgttccgttggcgcaggacaaaccgtacgcactagtacgtacgtttaccggaagggggactacgtacgaacggtacgtacggggtacggaacggtaactccgtaccggacccacgtacgtacctacgttacgtagggacgtaccttaacggaaacgtaaacggttacggaacgtaccgttaacgggaaacgaccgtaaccgggttaacccggtttaacgtaccggttcgaccggttaccggaaagaaccgttaaccgaccccggtaacccccccgggaaggggtaaccccggtaacggaaacgggttacggtaccggggtacgggggtaaccgtaaccgggttaccggttttccggggtacctttaccggtaccttacccgttaccgttaaaccgg

SEQ ID NO: 187852 - DNA, 632 bp, Homo sapiens
  misc_feature: GYAE6OF02I8RM6.5.64.F09.1.454.CMB.1.raw
tcagatcagacacgcacgaccggtgctcgatttagcgcgtatacaaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctggaggtgaagacgcctgggtcctcggtgacggtctcctgcaggcgtcgtggggctaccgttggctaagttgcctagtttacgttgggtgtcgacgcggtccccgtggaccgaagggcttaggaggtggtaggtgggagggagtcgtccctgttcgttggagtcagacaacgtacgcacatgtagttcgaagggagagtcaacgagttaccgggcgacgtaactcgtacgcaacagactagtcgtcggagctaggaacaacgtacgacgaactgaaacgaccgacggtccgtttaacgtctacggacgcgacgacggtacctaccccggacccccgggacgggacccgtaaccgggtcggtaacggtacgggtccggggtacgaccgggttcggtttaccggggttccgttaaccgtaccgtaccgttaccttaaccgg

SEQ ID NO: 187853 - DNA, 789 bp, Homo sapiens
  misc_feature: GYAE6OF02I0K12.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgagacgccgtgggtcctcggtagaaggttcctccgtgcgaaggcgtcgtcggggctaccgttcggactaagtttcgcctagtttacgtggtcgcgacgcggccctaggacgaaggcttcggagtggaggtgggacggtacgttccggtcccgttagttcgtttcgggagacgtagtacctaaacgtaccgtacaacgtacgttacgtacgtttacggaacgggggtaataccggtaacgtaacggtaaccggttaaccgggacgggtaaccgtaacgttaccggtaaccgggtcccgaaccgtagtaacccgttacgtaacgggttacgggaaccgtacgtaacgggtaaacgtaacggtacggaacgtaaacccgtagaaccggtaaccgtacgggttaacccgtttacgtaacgtaccggcgtacgtacggtaccgtaaccgccccccggtaaccccggggacggaacccgggtaaacggtacgggttaacccggtagggtaccggggtaaacccggttaacgggtttacccgggtttacgggttaaccccgtttccgtaaacccggttacccgttaagtaacccggg

SEQ ID NO: 187854 - DNA, 620 bp, Homo sapiens
  misc_feature: GYAE6OF02HIERU.5.64.F09.1.454.CMB.1.raw
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgagacgcctgggtcctcggtgaaggtctcctgcaaggcgtcgtgggggcaccttcggcaagtttgccattacttgggtgcgacaggccccctggacgaaggggcttggagtggagtgggagggactcgtccctgtcttttgggagcgagacaaactacgcacatgatttccgaggggagagtcacgagttacggcggacgaatcacggccacngacctatctggancgtagaaccaacgtgagacctagaacgacgtacggaccgttttacctacgttggaccgtcgaacgaggtaactacccgggccccccccggaacgggggaccccggaaacgggtcgggttaagttacgggtcgggggacgtaccggggtccgttttacggggcccgtttaccgtaacgttaccgttacgttaaccgg

SEQ ID NO: 187855 - DNA, 622 bp, Homo sapiens
  misc_feature: GYAE6OF02IMJ7W.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctggaggtgaagacgcctgggtcctcgggtgaggtctcctgcaaggcgtcgtgggggcaccttcggcaagtttgccatttacttgggtgcgacaggcccctggacaagggcttggagtggagtgggaggatcgtcctgtcgtttggagcagacaaactacgcacatgagtttccgaggggagacgtcacgtagttacgggcggtacgaatcgtaaccggccgaacacgacctactcgtaggacgacgtagaacgaacgtagaacgaccgtagaacgaacgacggtacccgtttacgtaccgtcggacgacgaggacgacgtacccgaccccccggacggggacccggaacgggaacggtacggtacgggtacggggaccgtaacgggtcgttttacgggtacccgttaccgtaacgttacctacgtaacg

SEQ ID NO: 187856 - DNA, 773 bp, Homo sapiens
  misc_feature: GYAE6OF02GAHXT.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgagacgcctgggtcctcggtgaagtctcctgcaaggcgtcgtggggctaccgttcggctaagtttcggcctagtttacgtttcggggttcgcggacaacgggtcccccgtaggacgtaacggggcttggagtggagtggggagggactcgtccgtgtcgtttgggacgtcgagccgaaacgtaccgaccaactagttacgtacgtttaccggaagggggtaagacgttacgaacggtacgttaaccgggacggtaacgtaacgttaccgtaccggtaccgaacctacgtacctacgttacgtagggtacggcgttacggaaacgtaacggtacggaaccgtaaccgtacggaaacggtaaccgtacccgggttaaccgtttaacgtaccgttcgggacccggaggtaaacggacgtaccggtacccccgggaacccccccggggaggggtaaccccggaacgggtaacggggttaacggttaccgggggtaccggggggtaacccgtaaccgggggtttccggttttacggggccccgttttaccgttaaccgttacccgttaacgttaacccgg

SEQ ID NO: 187857 - DNA, 689 bp, Homo sapiens
  misc_feature: GYAE6OF02FYPC5.5.64.F09.1.454.CMB.1.raw
  modified_base (243)..(243): a, c, t, g, unknown or other
  misc_feature (243)..(243): n is a, c, g, or t
  modified_base (358)..(358): a, c, t, g, unknown or other
  misc_feature (358)..(358): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagacgcctgggtcctcggtgaaggtctcctgcaggcgtcgnggggcaccgttcggcaagtttgtctattacgttgggtgcgacaggccccgtggacagggcttggagtggagtgggaggatcggtccgtgtcgtttggagcagacaaactacgcanatgtagtttacgagggagagtacgacggtacgtacgggacggaacgtacgtacgtaccggaccaacgacgtaccgtacgtcgttaggacgtccgttaggaaacgtaacggtacgaacgtaaccgtaggaaacgaccgtaaccggttacccgtttacgtaccgtacgggccggtaacggaaggtaacggaccgttacccccgggacccccccgggaacgggggacccggaaaccgggtaacgggtaacggtaacgggggtacggggaaccggtaaccgggttcggttttaccgggtccgtttaccggtaaccttaccgtaccggttaacccg

SEQ ID NO: 187858 - DNA, 732 bp, Homo sapiens
  misc_feature: GYAE6OF02I09HB.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgtccgtggtcctcggtgaaggtctcctgcaaggcgtcgtggggccacgttcggactaagttgcctaatttacgttgggtcgcgacgacggcccgtggacgaagggcttgaggtggacgtggggaggattccggtccgttcgttgtttagggacgacaacggactaaaccgtacgacaacacgttaggtacgttaccggtaagggggaagtcggtacgtacggaacggttaccgggacggacggtaatacccggtaacgggaccctagacggtaccctacgtacgtaaggtccgtcgtaacgaaacgtaacggtcggaagtaccgacggtacaaccgggtaacccggttaccggttaaccttacggtggtaccggacggaaggtaccgaaccgttcccccggaaccccgggtacggggggaacccgaaccgggtaacggttaaccggtagggtaccggggtaacccggacggtttcccgggtttacggggttaccttaccgtaaccgttaccgttaaccttaacccgg

SEQ ID NO: 187859 - DNA, 790 bp, Homo sapiens
  misc_feature: GYAE6OF02JSBUO.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttccctctttgtggtggcagcagctacaggtgtccagtcccaggtgcaactggtgcagtctgggctgaggtgacgacgcgtggtctcggtagacggtctcctgcaacggcgtgtggggcctaccgttcggctaaggtttcgacctagttaccgttgggtcgcgtaacgacggtcccccgtagggacaaggggtcttaggacggttggaacgttgggggacggtacgttcccggtccgttggttacgtttcgggacgtacgtacggaactaaaaccggtcgtaaccgactaagtcggtaacgtttccgggaagggacgtagtacgaacggtagttaccgggacgtaacggtaacgtaccgtacggaccgaacgacgtctacgtagtgacgtagtacgaaacgtacgacgacgtaccgtagaacgtaacgtaccggttacgttaaccgtacgtacggtacccgtacggaacgtaaccggtacccgttaccccggaacccccccggggtacgggtaaacccggtaacccggggtaacgggttaaccgggttaacgggggtacccggggggtaaacccggttacccggggttaacccgggtttttaccgggtaaccccggtttaccgtttaacccggttaacccggttaacccgttaaacccgggg

SEQ ID NO: 187860 - DNA, 738 bp, Homo sapiens
  misc_feature: GYAE6OF02IKMYQ.5.64.F09.1.454.CMB.1.raw
  modified_base (400)..(400): a, c, t, g, unknown or other
  misc_feature (400)..(400): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctccgtgcgaggcgtcgtgggggccaccgttcggctaagtttcgccgtagtttacgttgggtcgcgacgacgggtcccctagggaaccgtaagggtccttggacggtgggagtggggaaggtcgttccggtcccgttgttccgtttggagtacgacgaccgtaaacgtaccgngaactagttcgtacgtttaccggaagggtacgtacgtaccgaacgtacgttacgggaccggtaacgtaacgtaccgtaccggaccctaacgaccgtacccttagtcgtagggtacgtacgtacgaaacgtaacggtacggaacgtaccgtacggaacgacgtaaccggttaccgtttacgtacgtcggaccgtacgagacgtacccgtaccccgggaacccccgggacggggacccgaacgggtacggttaaccggtacggggtaccggggtaaccgtaaccggggtttccgtttacgggttccctttaccgttacccgttaccgtaccgttaaccgg

SEQ ID NO: 187861 - DNA, 681 bp, Homo sapiens
  misc_feature: GYAE6OF02JQ4F3.5.64.F09.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (589)..(589): a, c, t, g, unknown or other
  misc_feature (589)..(589): n is a, c, g, or t
tcagatcagacacgcacgaccggtgctcgatttagcgcgtatacaaggggcatcacataacaaccagattcctcctctaaagaagcccctggagcacagctcatcaccatggactggacctgaggttcctctttgtggtggtcagtcgagctacaggtgtccagtcccaggtgcactggtgcagtctgggctgaggtgaagcgtcngggtcncggtgtagtcnctgcaggcgtcgngggctccgtcggcgtagttgcctagttctgggtncggacgacggtcccgtggacgtaacggggcttcggtaggtggacgtgggtacggtacggtccgtaccgttgttcgtttacggacgtcgaacgtcaaacgtacggactacgatcgtacgtttacgacggggtacgtacgtccgtaacggacgttacggggaccgtacgggtaaacctcggtaaccgggacctacgaacgtaccgtagtacgtaggacgtactacggtaaccgtaacgtacgaaccgtacgtagaacgttccggaaccgtccgttaccgtacgtcgtacggacaggacgtaccgtcccggtaaccccccgngggaacccgaacggtcggaagtacgggtacggggaccgtaacggttacccgggtttggtacccgttaccgtaacgtacgttacccgtaacgg

SEQ ID NO: 187862 - DNA, 634 bp, Homo sapiens
  misc_feature: GYAE6OF02G2607.5.64.F09.1.454.CMB.1.raw
  modified_base (377)..(377): a, c, t, g, unknown or other
  misc_feature (377)..(377): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgagacgctgggtctcggtgaaggtctctgcaaggcgtcgtgggggcaccgttcggcaagtttgcctagttaccgttgggtgcgacacggtcccctggacgaagggcttggagtggagtgggaggagtcgtcctgtcttggagtcgagacaaactacgcaacatgtacttcgaggggtanagtacacgtaacgtacggacggtacgaacgtccgtaacggaccgtaacgaacgtaccttacgtacgtacggacgtaccgtagaaaccgtaaggtcgaacgtaccgagtaacgaccgtacggtaccgttacgtacgtacgcgacgacgtacgacgtcccgacccccggacgggaccggaacggacggtaagtacgggtacggggaccgtaacgggtcgtttacgggtacccgttacgtaacgttaccgtagttaaccg

SEQ ID NO: 187863 - DNA, 625 bp, Homo sapiens
  misc_feature: GYAE6OF02IA5IB.5.64.F09.1.454.CMB.1.raw
  modified_base (242)..(242): a, c, t, g, unknown or other
  misc_feature (242)..(242): n is a, c, g, or t
  modified_base (405)..(405): a, c, t, g, unknown or other
  misc_feature (405)..(405): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
  modified_base (570)..(570): a, c, t, g, unknown or other
  misc_feature (570)..(570): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtgggctgaggtgagacgcctgggtcctcggtagaggtctctgcgaggcgtcgnggggcaccgttggctaaggtttcgcctatttacgttgggtgccgacgcggtcccccgtaggacgaagggtcttaggtaggtgggagtggggagggtaacttccggtacccgttggtcgtttggacgcgagacaaaccgtcgacacatgtacttcggaaggggntagtcacggagtacgggacgaacgtagtaccgtaccggccgaacgacgtaccgttagtccgtagggactacgtacgaaacgtacggtagacgttacgagaacgacgtacgttaccgtttacncgtgaccgngagacgccgtcccgaccccggaggaccgaacggnggtagtcgggacgggtacgacggttcgttcggtccttaccgtataccgtatacgg

SEQ ID NO: 187864 - DNA, 797 bp, Homo sapiens
  misc_feature: GYAE6OF02FULY3.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtcctcctgacgaggcgtcggcggggcctaccgtcgacgtagttcgactagttacggttggtgaccgacgacggtccccgtaggaacgaagggtcgttaggaggtacggtaggtaggggacggtacgttcccggtacccgttcggtttaccggtttaggacggcgtaacggaacctaaaaccggtcgaccgtaacgtagtacggtttaacgtttaccggggaaggggtaacgtacgtaccgaacggttacggtaaccggggacggaaacgttaccgtaccggtaacccgaccgtaacgacggttaaccgttacgtaccgggttaacgggaccttacgtaaccggtaaaccgtcgggttacggaacgtacccgaaggaaccggtaacccgttaacccgggttacccgttttaagccggtaccggaccgttaccggaagaccggttacccggtcccccccggaacccgggggtacgacccggtaaacgggttcggtaacgggtacggggtaccggggtacaacccggggtttcgttttaccgggaccctttaacggtactaccgttagtaccgg

SEQ ID NO: 187865 - DNA, 646 bp, Homo sapiens
  misc_feature: GYAE6OF02HNCM0.5.64.F09.1.454.CMB.1.raw
  modified_base (363)..(363): a, c, t, g, unknown or other
  misc_feature (363)..(363): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtgtccagtcccaggtgcaactggtgcagtcgtgggctggaggtgaacgcgccgtgggtccgtcggtgaggtctccgtgcgaggcgtcgtggggcctaccgttcggctaagtttcgcctagtttacgttgggtcgcgacgtacggcccctaggacgaagggtcttggaggtggaggtgggacggtatccgtccgtgttcgttggancgagacgaaaccgtcgtacacagtacgtacgttacggaggggacgtacgtacgaacgtacgtacgggacgaacgtaacgtccgtaccggacccgtacggtcctaagtcgtaggacgtacgtagaaccgtacgagtacgactagaacgaccgtacggtaccgtttactacgtgccggaggagacggccctaccccggacccccggagggcccgaaggtacggtaggacgggtacgggacgtaacggttcgtttcggccgttacgtacgttactacgtactacgg

SEQ ID NO: 187866 - DNA, 759 bp, Homo sapiens
  misc_feature: GYAE6OF02JN32P.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctcttgtggtggcagcagctacaggtgtccagtcccaggtgcaactggtgcagtcgtgggctgaggtgaagacgtcgtgggtccgtcggtgaaggtctcctgacgaaggcgtcgtaggggccaccgttcggactagttcgacctattacgtgggtgcgtacacgggtcccctggacctaagggcttagacggttggaggtgggagggtacttccggtccgtaggttcttgggacggtcgagtaccgtaaacgtacgactaacgtattacgggtaactttccggtaaggggtacgtaacggtcgaacggtacgttaacgggacgggtaacgaacgttaccgtaccgggaccaaccggtaacgtaccttacgtcgtacgggacggtctaaggaaccgtaacggttacgtaacgaccgttaggaacgtaacggtaccgtacgttaaccgtacgtcggaccgtaggtacgacggtaacccgttccccggaaccccccgggtacggggaaccccggaaaccgggtaacgggttaaccggttacggggtaccggggggtaacccgttaccggggttaccggttttccggggttacccggttaccgtttaccggttaaccgttacccgtaaccgg

SEQ ID NO: 187867 - DNA, 679 bp, Homo sapiens
  misc_feature: GYAE6OF02GI5ZA.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtggggctggaggtgaagacgccgtgggtcctggtgaggtctcctgcgaggcgtcgtggggcacgttcgctaagttgcctagttacgttgggtcgcgacgaccggcccgtaggacgaagggtcttggaggtggagtggggaggtactccggtcccgtgttcgttggagtacgagaccaaacgtcgacacgagtgtacgttcggagggagtacgtcgaacggtagtaccgggacggtacgtaacgtccgaacggccaacgacgtaccgtagtccgtaggtacgtacgtagaaacgtacgttaggactaaccgtaggaaccgacgtaccggtaccgtttactacgtcgacgacgaagacgtaaccgtccccccgggaccccgggtaacggggacccgtaacgggtaacggttacgggtacggggcggggtacccggttaaccgggtcggttttaccgggaccctttaccgtaacgtttaccgtaccgtaacgg

SEQ ID NO: 187868 - DNA, 718 bp, Homo sapiens
  misc_feature: GYAE6OF02G6WDW.5.64.F09.1.454.CMB.1.raw
  modified_base (244)..(244): a, c, t, g, unknown or other
  misc_feature (244)..(244): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtcgcaactggtgcagtcgtgggctgaggtgaagacgccgtgggtcctcggtgaaggtctcctgcaggcgtcgnggggccacgttcggctaagttcgctattacttggggtgcgacacggccccgtggaccgaagggtcttaggaggtggaggtcggggaagggtactccggtcccgttggttcgtttgggacgtcgacggaacctaaaaccgtaccggaccaacgtagttacggtacgttttacccggaagggggtaagacggttccgaaacggtacgtttaccgggacggtaacggtaacgtccggtaccggaccctaaccgacggtcccttagtccgtacgggacgtacgtaacgaaaccgtacggtacgaacgaccgtacgaacgaaccgtaccggtacccgttttacgtaccgtaggccgacggacgacgtaccgtccccgggaccccccggacggggacccgaacgggtacggtaaggtacgggtacggggaccgtaaccggtcggttttaccggtccttaccgtacgttaccgtactaacg

SEQ ID NO: 187869 - DNA, 729 bp, Homo sapiens
  misc_feature: GYAE6OF02HLZ6I.5.64.F09.1.454.CMB.1.raw
  modified_base (293)..(293): a, c, t, g, unknown or other
  misc_feature (293)..(293): n is a, c, g, or t
  modified_base (443)..(443): a, c, t, g, unknown or other
  misc_feature (443)..(443): n is a, c, g, or t
  modified_base (610)..(610): a, c, t, g, unknown or other
  misc_feature (610)..(610): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgccgagtcgtggggctgaggtgaacgacgccgtgggtcctcggtgaaggtctccgtgcaacggcgtcgtgggggctaccgttcggacaagttcgacctatttacgttgggngtcggaacgaccggtccccgtagggaaccgtaagggtccgttggaggttaggaggtaggggtacgggtactcccggtccttgggttacgttgggacgtcgaagtacgtaaaaccgtacgcactagttcggtaacgttaccggaggggtanacggtacgacgtaggttaccgggcggtaacgaacgtcccggaacggtaccaacgtacgtcccagtcggtagacgtctaggaaacctacggtgaaccgtacgtagaacggtaccgtccgggtaaccggtttacaccgtacggtaccgaacggtcgtaaacggtacccncccccggggaacccccggagggggtaacccggtaacggggacggttaaccgggtaaggggtccggggacgtaaccgggttcggtttccggtaccttacgtccttaacgtacgtaaccgg

SEQ ID NO: 187870 - DNA, 648 bp, Homo sapiens
  misc_feature: GYAE6OF02GRPSQ.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtctggggctgaggtgaagacgcctgggtcctcggtgaagtctcctgcaggcgtcgtggggcaccgttcggcaagtttgcctattacgttgggtgcgacgacggccccgtaggacaagggtcttgagtggagtgggaggtatccgtcccgtgtcgtttggagcagaccaaacgtacgcacatgtacgtttccgaggggagtagtacgaacgtagttaccgggcgacgtaactccgtacggccgaacgacgtaccgtagtcgtaggacgcgtacggaaccgtacgtacgacgaccgtagaacgtacgtaccggtaccgtttacgtaccgtgtaccgacgacgacgaccgtaccccggaccccccgggacggggacccgaacggtacggtaacggtacgggtacggggtaccgtacgggttccggtttcgggtacccttaccgtaccgttaccgtaccgtaaccg

SEQ ID NO: 187871 - DNA, 752 bp, Homo sapiens
  misc_feature: GYAE6OF02G6E85.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtagcgagtcgtgggctggaggtgaagacgccgtgggtcctcgggtagaaggtctccgtgacgaaggcgtcgtgggggccaccgttcggacgtaagtttcgacctagtttacgttggggtcgccgacgacggccccgtaggacaaggggtcttggaggtaggaggtggggacggtgtccggtcccttgttcgtttggagcgaagactaaacgtccgacatagtgtacgttcgaggggatacgtcgaacggtagttaccggtacggtaacgtaacgtaccgtaaccgggaccaacgacgtacctacgtcgtaggtacgacgtaagaaccgtaacgtggaacgtaccgtaagaacggaccgtaaccgggttacccgttttaacgtaccgttcggaccggtaaccgtacgggtaaccgtaacccggttaccccccgggaacccccccggggaacgggggacccggtaaaccgggtaacgggtaacggtaccgggggtaaccggggtaccggtaacccgggttacgggttttcgggtaccccgtttacggttaccttaccggttaaccctaaccggg

SEQ ID NO: 187872 - DNA, 747 bp, Homo sapiens
  misc_feature: GYAE6OF02G34FC.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtagaagaccgccgtgggtcctcggtgaacgtcctccgtgacgaacggcgtcgtgggggcctaccgttcggactagttcgcctatttacggtgggtcgcgacgacggtcccccgtagggaaccgtaaggggtcttaggacgggttaggacgggttacggggaggtacgttcccggttcccttgggttccgtttagggacgtaccgtaacggtaacccgtaaaacgtaccgacgtaactacgttaggtaaccgtttccgggaaggggtacgtaaccgtaccgtaaggtaacggtttacccgggaggtaaccgtaacgtcccgtaacggacccgtaacgacgtacctaagtccgtaggtacacgtaacgaacgtaacgtgtaaacgccgtagaacgacgtaccggtacctttacgacgtcgacgcgaacgtacgacccgtccccggaaccccgggagggtacccgaacggtacggtaacggtacgggtacgggtaacgtaaccggtttcggttaccgggtaccttaccggtaacttaccgtacgtaaccg

SEQ ID NO: 187873 - DNA, 639 bp, Homo sapiens
  misc_feature: GYAE6OF02GEXWM.5.64.F09.1.454.CMB.1.raw
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagatcagacacgcacgaccggtgctcgatttagcgcgtatacaagggggcatcacataacaaccagattcctcctctaaagaagccccctgggagcacagctcatcaccatggactggacctggaggttcctctttgtggtggcagcagctacaggtgtccagtcccaggtgcaactggtgcagtctggggctgaggtgaagacgccgtgggtcctcggtgaaggtctcctgcgaggcgtcgtgggggcaccgttcggccgaaggttttgcctatttaaccgttgggtgtcggacacggccccctggacaagggcttggaggtggtagtgggagggtatccggtaccgtcggtctttggngcgagactaaactaccgcactatgtattccgaggggtagagtcacgtagttacgggnggaccgtataccgtacggacccacgtacgacctactacgtggagaccgtgtaaactacggtgaacgacgtagaaacgcgacggtacccgtttactacgtcgtcgtacgacgagtactccggaccccccggaacggggcccgaacggtacggtaagtacggggtcgggtaccgtaacgggtcgtttaccggggtaccttcgtaccgttactacgtaaccgg

SEQ ID NO: 187874 - DNA, 777 bp, Homo sapiens
  misc_feature: GYAE6OF02JIBZI.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtgggctggaggtgaagacgccgtgggtccgtcggtgaacggtctcgtgcgaaggcgtcgtggggctaccgttcggactaagtttcgcctagttacgttgggtgcgacgacggccccgtggaccgaagggtcgttggaggtggaggtaggggtagggacgtccggtcccgttggttccgtttaggacgtcgaaggtacaaaccggttacacgacgtacgttacgttacgtttaccggaagggggtacgaacggttaccgtaaccggtacggttaaccgggaccgggtaacggtaacgtaccggtaaccggaccgaaccgtaccggtaccgttacggtacgttacgggaccgtacgtaacgaaacgtaacggtacgtacgacgtacggaacggacgacccgggttccttaacgtccgtacggccgtacggaacggtaccggtaccgtaccccgggaccccccgggtacggggacccggtaaccggtaacgggttaacggtacggggtaccgggggtaacccgtaacggggttaccggtttaccgggttaccccgtttaacggtaacccgttaccgttaccgttaaccggg

SEQ ID NO: 187875 - DNA, 781 bp, Homo sapiens
  misc_feature: GYAE6OF02IWQLV.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctcctgcaaggcgtcgtgggggcaccgttcggccgtaagtttcggcctattaccgttgggtcgcgacgacggtcccccgtaggacgaaggggcgttggacggtgggacgtagggggacgggatccggttccccgtggttcgtttgggacgtcgacgtaccaaaccgtaccgaccacgacttacgtacgtttacccggaggggtaacgtagtaccgtaacggtaggttaaccggggtacgggaaccggtaacgttacccggtaacccggtacccgtaaccgtacggtaccccttaaggttaccgtaggggtaccgtaccgtacggtaaaccgtaacggttcggaaccggtaccgttaaggaaacgtaaccggtaccgggttaccgttttaaccgacgttcggaccggtaccgtaacggacgtacccggtacccccggtacccccgggaacggggacccggtaacgggtaacggttacggacggggttaccggggtaccgtaacgggttccggtttacgggtacccgtttacgtaaccgtacgttaccgtaaccgg

SEQ ID NO: 187876 - DNA, 769 bp, Homo sapiens
  misc_feature: GYAE6OF02FO571.5.64.F09.1.454.CMB.1.raw
  modified_base (252)..(252): a, c, t, g, unknown or other
  misc_feature (252)..(252): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgcctgggtcctcggtgaaggtctcctgcgaaggcgtcgtgggggcnccgttcggcagtttgcctattacttgggtgcggacaggcccctggactaagggcttgagtggatggggagggagtcgtcctggttcgtttggagcaggacaaacctacggcacgatagtattttccgagggggtaagacggttacgacggtaacgtttaaccgggacgggtaacgaacgttccgtaaccggggcccaaccgaacggtacccgttagttccgttagggtaacgtcgtaggaaaccgtaaacgtaggacgtacccgttacggaacggaaccgtaaccgggtaccggttttaacccttaacgttacggaccggtacggaaacgggtaacggaaccgttccccgggaccccccccccgggaacggggggtaccccgggaaaccgggtaaccggggttaaccggttaacggggtacgggggggtaaccccggtaaccgggggtaccgggttttttaccggggtaccccggtttacccggtttaacccgtttaccgtaacccgtttaacccgg

SEQ ID NO: 187877 - DNA, 695 bp, Homo sapiens
  misc_feature: GYAE6OF02IDO81.5.64.F09.1.454.CMB.1.raw
  modified_base (351)..(351): a, c, t, g, unknown or other
  misc_feature (351)..(351): n is a, c, g, or t
  modified_base (555)..(555): a, c, t, g, unknown or other
  misc_feature (555)..(555): n is a, c, g, or t
tcagatcagacacgcacgaccggtgctcgatttagcgcgtatacaagggggcatcacataacaaccagattcctcctctaaagaagcccctgggacgcacagctcatcaccatggactggacctggacggttcctctttgtggtggcagcagctacaggtgtccagtcccaggtgcaactggtgtcagtcgtggggctggaggtgaagacgtccgtgggtcctcgggtgaggtctctcgacgaaggcgtcgtcgggggctaccgttcggctaagtttggcctattacgttggtgcgaacgcggccccgtggactaaggggcttaggacggttaggaggttggggaacggtntccggttccgtgtcgtttggaacgtcgaacgacaaactacggctaacagttcgacgtttcggaagggtacgagtccgacgtagttacgggaccggacgtaagtacgtaccggcctacgacgtcgttactacgtcggacgcgtaagaacggaacgtacgacgacgtagaacgtacgtaccggtaccgtttacgacgtcgcgacgnggaacgtccgtacccggcccccgggtaacgggaccggtaaacggtaacgggtaacggtacggggtacgggggtaccgtaaccgggttccggtttacgggtacccgtttaaccggttaccgttaacccgttacttaaccgg

SEQ ID NO: 187878 - DNA, 747 bp, Homo sapiens
  misc_feature: GYAE6OF02HGYPK.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcgtcgggtcctcggtagaaggtctcgtgcgaaggcgtcgtggggcaccgttcggctaagtttcgacctagttacgttgggtcgcggacgacggtccccgtaggacgtaacgggctttaggaggtaggacgtggggaggtacgtcgttcccgtagttcgtttcgggacgtcgaagtaccgtaaacgttacgactacgtagtacgtacgtttaccggaaggggtacgtacgttacgacgtaacggttacgggacggaacgtaacgtaccggtaccgaccgaacgacgtaccgtacgtcgtacggtacgacgtaagaaacgtaacggtacggtacgtaacgtacggaacggtaacgtaccggttaacgtttaacctacgttacggaccgtacgacggtaacgacccgtacccgggtaccccccgggaggggaacccggtaaccggggtacgggtaacggttacggggaacggggtacggttaacccgggttacggtttaccgggtccgtttaacccgttaaccggtacccgttacgttaaccgg

SEQ ID NO: 187879 - DNA, 741 bp, Homo sapiens
  misc_feature: GYAE6OF02JGA55.5.64.F09.1.454.CMB.1.raw
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtcgtccagtcccaggtgcaacgtggtgcaggtcgtggggctggaggtgaagacgccgtgggtcctggtagaggtctccgtgacgaggcgtcggtcggggcctaccgttcggacgtaaggtttcgcctagtttacgttgggtcgcgacncggccccgtggactagggtctggacggtggngtgggaggacgtcgtcccgtgttcgttggacgcagacaaacgtcgtcagtatcgtagttaccggagggagtacgtacgaacggttacgtacgggtcggaacgaacgttccgtaaccggccgaacgtacgtaccgttagttccggtaggtacgtacgtaacgaacgtaacggttacggaacgtaccgtaacggaaaccgtaaccggtacccgggttaccgtttaaccgtacgtacgggtaccggtacgaacgggaacgtacccgggttaccccgggacccccccgggaacgggtacccgggtaaaccgggtacgggttaacggtaccgggggtaacggggaccgttaaccgggttcccggtttacgggttcccgttacgttaacccttacggttaccttaaccggg

SEQ ID NO: 187880 - DNA, 728 bp, Homo sapiens
  misc_feature: GYAE6OF02ID0JY.5.64.F09.1.454.CMB.1.raw
  modified_base (438)..(438): a, c, t, g, unknown or other
  misc_feature (438)..(438): n is a, c, g, or t
  modified_base (565)..(565): a, c, t, g, unknown or other
  misc_feature (565)..(565): n is a, c, g, or t
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcaggtcagctacagggtctccgacgtcccgaggtcgacgaacgtggtcgcgtagttcgtcggggctggagggtagaacgccgtccggttcggtcccgtgggttacggaacgttccgtcccgtagaccggtacggtcgtaccggtcggggaccgtacccgttccggaacttaaggttcgcccgttagttacgttcgggtggaccgtacggtaccggtcccggtagaccgagggtccttaggagtcggaggtcgggaggtacgtccgttcgtgtacgtagcgacgagaccaaacgcncgtaactcgtagtcgtaccggaggtaacgtcgtaccgaagttaccgtacgggacgtaacgtaacgttccggtaccgtacccgagtaccgtacctacgtacggtagacgtaaccgtagaacgtcgtanaacggtaccgaagacccggtacgtaccgttaccgttacgtacgtacgacgtacggacgtacgtcccgtaaccccgacccggtacgggacgtaacggtacggtaacgtacgggtaccggacggtacgttacggtccgttaccttacgtactacccgttagtacg

SEQ ID NO: 187881 - DNA, 710 bp, Homo sapiens
  misc_feature: GYAE6OF02IVEV4.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagacgccgtgggtcctcggtgaaggtctccgtgcgaggtcgtcgtgggggccaccgttcggcgtaagttcgcctagttaccgtgggtgcgacgacggccccgtggaaccgaagggtctgaggtggagtgggaggagtccgtccgttgtcgtttggacgtacacgacaaacgtaccgacgacgtagtagtctttaccggagggagtaaggtccgaacgtagttaccgggacggtacgtaaactcgtaacggcccaaccgacgtaccctacgtacggtacggagtccgaacgaaacggtaacggtacgaacggtaccgtaaggaacgaacgtaaccggttacccgttactaaccgtgtccgacggaacgtaccggaaccgtacccccgaacccccgggaacgggtaccccggtaagggacggtaaaccgggtagggtaccggggtaaccgtaaccggggttacgtttccgggttacccttaccgtaacccgtttaccgtaccgttaccgg

SEQ ID NO: 187882 - DNA, 742 bp, Homo sapiens
  misc_feature: GYAE6OF02JB6N2.5.64.F09.1.454.CMB.1.raw
  modified_base (179)..(179): a, c, t, g, unknown or other
  misc_feature (179)..(179): n is a, c, g, or t
tcagatcagacacgcacgaccggtgctcgatttagcgcgtatacaagggggcatcacataacaaccagattcctcctctaaagaagcccctgggagcacagctcatcaccatgactggacctggaggttcctctttgtggtgcagcagctacaggtgtccagtccaggtgcaactggtncgagtcgtcgggctagaggtacgaaagcgtcccggtggggtccttacgggtcggtaaggtctaccctggcaagggtcgtcggtggggctaccgttcggctaagttcggcctattacggttggtcgacgacgtaccggcccctggaccgtaaggggtcgttaggacggttaggaggtaggggacggtacgtccgtccgtgttccgttaggcgtacgacgacaaacgtaccgtcaacacgtacgttaacgttcggagggacgtacgtcaacgtaggtccgacggaacgtactaccgtacggaaccagtactaccgttacgtcgaggtacgtcgtaacggaacgtaacgtcggaacctaccgtagaacggtaccgacggtaccctttaacgcgttacgacggacgtaacggaccgtaacccgtccccgtaacccccggggaccggggtaaccggtaacggggtaacggtttaaccggtaggggtaccggggggtaaccggttaaccggttccgggtttccgggtaacctttcccgggtaaacgttacccggaaacgtttacccggg

SEQ ID NO: 187883 - DNA, 934 bp, Homo sapiens
  misc_feature: GYAE6OF02GJJJW.5.64.F09.1.454.CMB.1.raw
tcagatcagacacgcacgaccggtgctcgatttagcgcgtatacaagggggcgagtcacataacaaccagattcctcctctaaagaagcccctgggagcacagctcatcaccatggactggacctggaggttcctctttgtggtggcagcagctacaggtgtccagtccccaggtgcaactggtgcgagtcgtcggggctcgaggtgaacgacgccgtgggtcctcgggtgaaggtctcctgcaaggtcgtcgtcggggcaccgttcggctaaggtttcgacctagttaccgttggggttcgccggtacgaccggccccttagggacgtaagggtctttggacgtgggacgtgggggagggtatcccggtcccttgggttccgttttaggggacggtacacggtacctaaaaccggtcgtaccgaactagttacggtaacgttttcccgaaggggggtaactacggttaccgaacggtaacgttttaaccggggaccggtaaaccggtacgttaaccgttaaccgggtacccctaacggtaaccggttacccgttaacgttacccggttaacggggtacgtaacccggttaacgggtaaaccgtaaaccgggttacggtaaccgggtaaacccgtaccgggaaacggtaaccggttaacccgggttacccggttttaaccggtttaaccggttaacccgggtccgggtaacccgggtaaccgggtaaacgggtaaccccgttacccccggggtaacccccccccggggtaaccggggtaacccgggtaacccgggtaaacggggtttaaccggttaacggggggtaacccgggggtaacccggttaacccgggggtttaccggttttaccgggggtttacccccgttttaccggtttaaaccccggtttacccgtaaccccggtttaaacccgg

SEQ ID NO: 187884 - DNA, 763 bp, Homo sapiens
  misc_feature: GYAE6OF02F5MEI.5.64.F09.1.454.CMB.1.raw
  modified_base (161)..(161): a, c, t, g, unknown or other
  misc_feature (161)..(161): n is a, c, g, or t
tcagatcagacacgcacgaccggtgctcgatttagcgcgtatacaagggggcatcacataacaaccagattcctcctctaaaagaagccccgtgggagcacagctcatcaccatggactggacctggaggttcctctttgtggtggcagcagctacaggtntccagtcccaggtgcaactggtgcagtcgtgggctgaggtgaagacgccgtgggtccgtcggtgaacggtctcctgcgaaaggtcggtacgtggggggtccaccgttcggcctaaaggtttcgcccgtaatttaccgttggggtcgaccggtaacgacgggtccccccgtaggtaaccgaaagggggtcctttcggaagggtcgggaagttggggaaggtaacgttccggtacccgttgttccgtttagggagtccgaaggaccgtaaaacctcgacctaacacgttaggtaacgtttcccggaaggggaagtagtaccgaacgtaaggttaccggacggaacgtaaacgtacgtaaccggaccaacgtacgtccgtatacgtaggacgtacgtaacggaaactacggtagaaccggtacgtaaggaaacgacggaaccgtacccgtttactaacgtcgaccggacggaacgtacggtaacctacccgggaccccccgaggggaacccggtaaccggtaaacggttaacgtaagggtaccgggaacggaacggttcggtttacgggtaccgtttacccgtaccgttaaccgtacgtaaccgg

SEQ ID NO: 187885 - DNA, 796 bp, Homo sapiens
  misc_feature: GYAE6OF02GFB95.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacagtgtccagtcccaggtgcaactggtgcagtctgggctgagtgaagacgcctgggtcctcggtgaaggtctccgtgcaaggcgtcgtggggccacgttcgctaagtttgcctattacttgggtgcgacacggccccgtggtacaacgggcttagaggtggagtgggagggactcggtccctaggttccgtttggagccgagtacaaacgttccgctaacatagtactttaccggaggggaagtacggtaccgacggtaacgttttaaccgggccgggtaacgtaagttaccgtacccgggttacccaaacggtaccgaaccttaacgttaccggttacgggaacggtaccgttaacggaaaccgtaaaccggtacggtaaccgaacccgttaaggaaacgtaaacccggttaccgggtaacccgtttttaaaccggttaccgtacggtaccggaacccgggttaacggaaacggtaccgttacccccggggtaaccccccccgggtacgggggacccggtaaccggggtaaacggtacgggtttaacggggtaccgggggttaacccggtaaccgggttcccggtttttacggggtaccccgtttaacgtttaacccggttaccggttaaccgttaacccgg

SEQ ID NO: 187886 - DNA, 913 bp, Homo sapiens
  misc_feature: GYAE6OF02IZ4O8.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtcgtaccacgtcccaggtcgcaaacgttggtcgcagtcgtggggtctggaggtgaagacgtccgtggtccgtacggtgaacggttcctccgtgacgtacgggcgtcggtcggggcctaccgttcggacttaaggtttcgaccctagtttacggttgggtagcccggtaaccggtaccggtacccccgtggaaaccgtaaggggtccgttcggtaacggggtggtaacgggtagggggaaccggggttaccgttaccccggttacccgtttaggtttccggttttaacggggacgtaccgtaacggtaaccctaaaaacggtcccggtaacctaacgttacgttacggttaccggtttacccgggtaagggggtaaccgtacggtaccgtaaccggttaacggttacccggggaaccgtaacggtaacgttccgacccgggtaacccgtaacgtacccggttacctacgtccgtaagggtcccgtacgttaaccggtaaacgttaccgtacggtaacccgtaaccggttaacgaaacgggtaacccggtacccgggtttaaccggttttacccgtacgggtacggtaacccggtacggaaaccggttaccggtaaccccgggtccccccgggtaacccccggggaacggggtacccggtaacgggtaacgggttaacggtaccggtaccggggtacgtacccgggttcggtttaccggttacccgttaccgttaccggttaccgtaccgttaaccgg

SEQ ID NO: 187887 - DNA, 755 bp, Homo sapiens
  misc_feature: GYAE6OF02FTJ22.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgacaactggtgcagtcgtgggctggaggtgaagaccgccgtcgggtcctcggtgaacggtcctcctcgacgaggcgtcgtgggggccaccgttcggatagtttcgcctattacgttagggtgaccgacgacggccccgtaggaccgaagggtcttagaggtggagtggggagggtatccgtccttgttacgtttggacgcagtaccaaactaccgacactagttacgtacgtttacggagggagtagtaccgaaggtacgttacgggacggtaacgtaacgtaccgtaccgggacccaacgtacgtaccctacgtccgtagggtactaccggtaacgtaaaccgtaacggttacgaaccggtacccgtacggaaaccggtaccgtaacccgggttaaccgtttaaccgtaacggttcggaccggtacgaacggaccgtacccgtacccccggaaccccccggggtacggggtacccggtaaacggtacgggttaaccgtacgggggttacggggaacccgtaaccgggtttaccggtttaccgggtaccctttacccggtaaccgttacccgtaccgtaaccgg

SEQ ID NO: 187888 - DNA, 730 bp, Homo sapiens
  misc_feature: GYAE6OF02HBL9I.5.64.F09.1.454.CMB.1.raw
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttggtggtggcagcagctacgaggtgtccagtcccaggtcgcaactggtgcagtcgtgggctggaggtagacgacgcgtgggtcctgggtcgaggtctcgtgcgtaaggcgtcggtggggctaccgttggactaagttcgctagttacgtgggtnccgacgcggccctggacgacggcttggagtggagtgggaggtctccgtcctgttcgttgagcctagactaactcgacancgttagtcgttacggagggtagtaccgtcgacggtaacgtacgggacggtaacgtaacgtacccgtacggacccgaacgtacgtaccttaagtacggtggaacgtaccgtaggaaaccgaacgttacgaacgtaccgtaacggaaacggtacccgtacgggttacccgttaacgtacgtaccggtccgaacgacggtaaaccgacccgtaaccccggaccccccggggtaacgggacccggtaaccgggtaacggttaaccgggttaagggggaccggggttaaccggttaacgggttttcccggtttaaccggggttcccgtttaacccgtaacggtttacccgttaaccgttaaaccgg

SEQ ID NO: 187889 - DNA, 729 bp, Homo sapiens
  misc_feature: GYAE6OF02GKP82.5.64.F09.1.454.CMB.1.raw
  modified_base (281)..(281): a, c, t, g, unknown or other
  misc_feature (281)..(281): n is a, c, g, or t
  modified_base (431)..(431): a, c, t, g, unknown or other
  misc_feature (431)..(431): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtgtccagtcccaggtgcaacgtggtgcagtcgtggggctgaggtgaagcgcgtggtctggtgagtctctgcaggcgtcggtggggcctaccgttggcgtaagttcgacctagttacgttgggngtaccgacgtacggccccctaggaacgtaacggggtcttaggaggtcggagtcgggaggtactccgtccgtacggttcgttagggacgtacgaagtaccgtaaacgtaccggtacaaccgtagtcgttacgtttaccggagggggtaacncggtaaactacggtaacgtttacccgggtaacggtaacgtaaacgtaccgttaccggacctaaccgtaccgtaccgttacgtaccggtacggtaccgtacgtaacggtaaacgtacggtacgaacgtaccgtacgaacgtaacgaccggttaccgttacgtacgtacggacgtacgtaagaccaccgtaccccggaccccggtacggacccggtaacggtacggtaccggtaacggggtacggtacggtaacggtttcggttacggtacccgttaccgttacgtaccgtacgtaaccg

SEQ ID NO: 187890 - DNA, 741 bp, Homo sapiens
  misc_feature: GYAE6OF02I5J1D.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccgaggtcgcaacgtggtgcagtcgtggggctggaggtggagacgcctgggtctcggtgaggtctccgtgcaggcgtcgtggggctaccgttcggctaagtttcgacctatttaccgttgggtggaccggacgacggccccgtaggacgaagggtccgttaggaggtgggacggtgggggacggtacttccggtcccgttggtttcgtttgggaagtccgtaacgaccgtaaaccgtacgacgacgtacgtagtaacgtttccggaaggggtacgacgttaccgaacggtacggttaccgggacgggtaccgtaacgtaccggtaccggtaaccgacgcggtacctagtacgtacggacgtacgacggtaaacgtaacggtacggaaccggtaccgtaaggaaaccggccgttaaccgggtacccgtttacgtacgtcggcggtaacgaggaacgaccgtaccccgggacccccggacgggggccgaaccgggaaggttaacggtacgggggtccgggtaccgtacgggttacgtttcgggtacccttacggtaaccgttaccgtacgtaaccgg

SEQ ID NO: 187891 - DNA, 755 bp, Homo sapiens
  misc_feature: GYAE6OF02I7191.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgagacgccgtggtcctggtgaacggtctccgtgcgaaggcgtcggtggggcctaccgttcggcgtaagtttcgacctagttacgttgggtacgccgacgtacggtaccccctgggaaccgaaggggtccttggaaggtggacggtggggtaagggtcgttccggtcccgttaggttcggtttagggacgtcgacgtaccgtaaaccgtacgaccacgtacgtacggttaacttaccgggaaggggtacgtacggtactaccggtaacggttaccggggacggtaaccggtaacgtaccgtaacccgggccgaacgtaccgtaccgttacgttccggtaggtaccgtcgtaacggtaaaccgtaaggtacggtaccgaccgtacggtaaaccgaacccggtacggttacccgttaaccgtacgtcggaccggtacgaacgtacggtaccccggcccccggaacccccgggacgggaccgtaacggtaagggttacgaccggggtcggaacgtaccggttccgtttacggtaccttcgtaacgttccgtacgtacgg

SEQ ID NO: 187892 - DNA, 796 bp, Homo sapiens
  misc_feature: GYAE6OF02FHXLI.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggtacggttccctctttgtggtggcagcagctacaggtgtcccagtcccaggtgcaacgtggtgcagtctggggctggaggtagacgaccgtcgtcggtccgtcggtggtaacggtcctccgtgacgacggtccgtcggtcggggtcctaccggttcggaccgttaaggtttcgacccgttattccggtttgggtcggacggtacgtaccgggtcccccgtggaaccggtaagggtccttaggacggttaggtaagtacgggggagggtacgtcccgtacccgttggttacgtttggacgtaccgaacggtacctaaaccgttacggaccgtaactagttacgtactttacccggaaggggacgtacgtaccgtaacgtacggtttaccgggaccggaacgtaacgtccgtaccggaccaacgtacgtacctaagtccgtagggacgtaccgtacggaaaccgtaacggtggaaccgtaccgtaggaaccgtacggtaaccggttaccgttttaccgtaccgttcggaccggtacggaacgtacggtacctacccccggaccccccgggtaggggaccccaaacgggtaacggtaacgtacggggtaccggggtaaccgtaaccggttcggttttacgggccctttacgtacccgttacctaaccgttaaccg

SEQ ID NO: 187893 - DNA, 824 bp, Homo sapiens
  misc_feature: GYAE6OF02H540A.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggtctggaggtgaagacgccgtgggtcctcggtgaaggtcctccgtggacctaagggccgtcggtcgggggctacccgtttcggacgtaaggtttcggcctatttacgttagggtgcgaccgtacgccccgtaggacgaacgggtcttagaggtggataggggtaggtagtcccgttccgtggttcgtttaggagtcgaagaccaaaacgtaccgacgacgtaagttacggtacgtttaccggaaggggtacgtaacgtacgaacggtaacggtttaccgggaaccggtaaacggtaaacttaccggtaaccgggtacccaacgtaaccggtaccgtaacgttacggtaacggtacgtacggtaacggtaaaccgtaaacggttaacggaacggtaaccgttaacggaaaccggtaaccggtaacccggttaaccgtttaaccgttaaccggtacggacccggtaacggtaacggaacggtaacccggttacccccggaaccccccgggtaacggggtaacccggtaaaccgggaaggttaccgggtaacggggtcggggtaacccgtaaccgggttccggtttaccgggttacccgtttacggttaaacccgttaaccgtaccgttaaccggg

SEQ ID NO: 187894 - DNA, 690 bp, Homo sapiens
  misc_feature: GYAE6OF02JXR6T.5.64.F09.1.454.CMB.1.raw
  modified_base (126)..(126): a, c, t, g, unknown or other
  misc_feature (126)..(126): n is a, c, g, or t
tcagatcagacacgcacgaccggtgctcgatttagcgcgtatacaagggggcatcacataacaaccagattcctcctctaaagaagcccctgggagcacagctcatcaccatggactggacctggnggttcctctttgtggtggcagcagctacaggtcgtccagtcccgaggtcgcaacgtggtgacgagtcgtgggctggaggtgaagaccgcgtgggtcctcggtagacggtctcgtgacgaaggtcgtcggtggggacctaccgttcgacgtagttgacctagttacgtggtcgacgacgacggtcccgtggacgagggtctggagtggaggtgggtaggtacgtccgtccgtgttcgtacggacggcgaacgacgtaacgtacgacgatagttacgtacggttcggagggtacgacgtacgtaacgtacggttacgggaccgtaagtacctacggtaccggaccctacgacgtccgtaacgtccggtagaacgtcgtacgaaacgtacggttagaccgtaacgtagaaaccgtcggtaaccggttccgttaacgcgttacggcgtaacgtaccggagtaaccccgtcccgggaaccccggagggtacccgaaggtacggtacggttcggggtaccggacgtaccggttacggttcggaccttaccgtacgtaccgtacgttaacg

SEQ ID NO: 187895 - DNA, 838 bp, Homo sapiens
  misc_feature: GYAE6OF02GZH76.5.64.F09.1.454.CMB.1.raw
  modified_base (194)..(194): a, c, t, g, unknown or other
  misc_feature (194)..(194): n is a, c, g, or t
tcagatcagacacgcacgaccggtgctcgatttagcgcgtatacaagggggcatcacataacaacctagattcctcctctaaagaacgcccctgggagcacagctcatcaccatggactggacctggaggttcctctttgtggtggcagcagctacagtgtccagtcccagggtcgcaacgtggtgcagttcgnggggtctggagggtgaaggaccggccgtggggtcctcgggtggaaggtccctccgtggaccgaagggtccgtcggttgggggacctcccgttacgggcgtaaaggttttcgacccgtatttaccgttaggggtcgaccggtaacccgaccgggtcccccgttaagggacccgtaaaggggggtccttggtaaggtaggggtacgggtggggtaaaggggtccttaccggttcccgttagggtttacggtttacgggcgtaccggaacgtaacccgtaaaaacggttccggaaccgtaaacgacgtttacggtaacgttttaccggggaagggggtactaacggtactaaacgggttaccgtacggggaaccgtaccggttaaactccgtaccggaccacgtaccggtctaacggtacgcggtacgacgttacggaacctaaccgggtagaaccgaccgtaaagtaacgtaaccgtaccggttaccgttaacgtaccggacgtccgacggaacggtacgtaccccgcccccgggaacccccgggtaggggaacccacggggtacgtacgggttaaacgggtccgggggtacctaacgggtttcgtttacccgggtccgtttacctaaccggttccctaagtccgg

SEQ ID NO: 187896 - DNA, 577 bp, Homo sapiens
  misc_feature: GYAE6OF02IXXQO.5.64.F09.1.454.CMB.1.raw
  modified_base (338)..(338): a, c, t, g, unknown or other
  misc_feature (338)..(338): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtggggcaccgttcggcaagtttgcctagttacttgggtgcgacacggcccctggacgaagggcttgagtggatgggaggatcgtcctgtctttggngcagcaacgtacgcacatgattccgagggtagagtcacgtagttaccggcggacgaactcgtaccggccacgagcctatcgtaggacgctagaaacacgtgacgactacgaacgacgacggtaccgtttacgtacgtcgacgcgacgacgacgtccgacccccgagggacccgaacggacggtacgtaggtacggggacgtacggtcgtttcgggccttacgtacgttaccgtactacg

SEQ ID NO: 187897 - DNA, 721 bp, Homo sapiens
  misc_feature: GYAE6OF02FMEI9.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgccgtgggtcctcggtgaaggtctccgtgcgaaggcgtcgtggggctaccgttcggctaagtttcgcctagttacgttgggtgcgacgacggtcccctggacgaagggtcttgaggtggagtgggaggtatcgtcctgttcgttggagcacgacaaacgtacgcactagtgtacgtttaccggagggtagtagtacgacggtaacgttaccgggacggtaacgtaacgttccgtaaccggtaccaccgacgtacctacgtcgtaggacgcgttacgaaacgtacggtacgacgtaccgtaggaacgtaccgtaccgggtaccgtttacgtaccgttagaccgggtaccgaagggtaaccgtaccggtacccccgggacccccccgggtaagggggaccccggtaaacgggtaaccgggttaacggtaaccgggggtacgggggtaaccgtaaccggggttccggttttaccgggtacccttttaacggtaacccgttaaccgttaccgttaacccgg

SEQ ID NO: 187898 - DNA, 721 bp, Homo sapiens
  misc_feature: GYAE6OF02GVR13.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaagtctcctgcaaggcgtcgtggggcaccgttcggactaagtttcgcctagtttcgttgggtcgcgacgacggccccgtaggacgaagggcttggacgtggagtggggaggtacttccgtccgtggttcgtttagggagtacgacgactaaaccgtacgaccgtaatacgttacgtaacgtttaccggaaggggtagtacggtaccgaacggtaacgttacggggacggtaacgtaacgtaccgtaccgggaccaacgtaccgtacctacgtcgtcggacgtcgtaacgaacgtaacggtacgacgtaccgtacgtaaacggaccgtaccgggttaacccgtttacgtacgtcggaccgtcgaacggacgaccgtaccccgggtaccccccggacggggacccgaaccgggtaacgggttacggtacggggtacggggacgtaccgggttacggttttccggtaccgtttacccgttaacgttaccgtaccgttaaccgg

SEQ ID NO: 187899 - DNA, 720 bp, Homo sapiens
  misc_feature: GYAE6OF02GJ1RU.5.64.F09.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagcgccgtggtcctcggtgaaggtctcctgcaggcgtcgtggggcaccgttcggactaagtttcgcctatttacgttgggtgcgacacggcccctaggacgaagggtcttggagtggagtggggaaggntccgtcctgtcgtttggancgagacaaacgtcgacactagtcgtacgtttccggaaggggagtagtaccgaacggtagtttaaccggggacggaaccgtaagttaccggtaacccggaccaaccgtacgtacccgttaacgtccgtacggacgtaccgtacggaaaccgtaacggtacgaaccgtaccgtacggaacggaccgtaccgggttaccgtttaaccgtacgtacggaccgacggaagaacgtaaccgtacccccggacccccccgggtaacggggacccgaaccgggtaacgggtaacgtacgggggtaccggggtaccgtaaccgggttcggtttaccgggtacccgtttaccggttaaccgttaccgtaccgttaaccgg

SEQ ID NO: 187900 - DNA, 677 bp, Homo sapiens
  misc_feature: GYAE6OF02IBSBJ.5.64.F09.1.454.CMB.1.raw
  modified_base (390)..(390): a, c, t, g, unknown or other
  misc_feature (390)..(390): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgagtgagacgcgtgggtcctcggtgaggtctcctgcaaggcgtcggtcgggggcctaccgttcggactaaggttttcgcctagtttacgttgggtcgccgacgacggtcccccgtggacgaagggtccttggaggtaggagtggggagggtacgtcgttccttggtccgttttggagccgtagacctaaactccggntaacgattaggtaactttccggaaggggtacgagtcgaacggtagtacgggacggaacgtaacgtacgtaccggacccacgacgtaccgttatacgtacgggcgtcgtacggaacgtacggtagacgtaccgtggaacgacgtaccggttaccgtttaacgacgttcggacgtcgtaacggacgtacccggtcccgaccccccgggacggggaacccgaccgggaggtacgagggtcgggacgtaaccggttcggtttcggtccttccgtacgtaccgtactaaccg

SEQ ID NO: 187901 - DNA, 865 bp, Homo sapiens
  misc_feature: GYAE6OF02G3159.5.64.F09.1.454.CMB.1.raw
  modified_base (139)..(139): a, c, t, g, unknown or other
  misc_feature (139)..(139): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgnggtggcagcagctacgaggtgtccagtcccaggtgacaacgtggtgcagtcgtgggctggaggtagaagacgccgtgggtcctggtagaacggtcctccgtgacgaaggcgtcggtcggggcctaccgttcggacgtaacgtttcgacccgttaatttacggttggggtacgtaccggaacgtaccgggtacccccgttagggaaccggtaaacggggtccgtttaggacgggttacgggtaagggtacgggggaagggtacttcccgggttcccgttacggtttacggtttacgggaacggtaccgaacgtaaccgtaaaaccgttaccggacaacgtaagtacggttaactttaccgggagggtacgaacgttacgacgttaacggtaccggaacgggtaacaacgttacccgaaccggacctaacgtccgaacgttacgtacggtacggtacgtaccgtaagaaaccgtacggtacgtaacgtaccgtaacggaacgtacccggttaacggttaaccgttaaccgtaggtaccggtacgaacgtaccggtaaacgtacccggtacccccgggaacccccggggtaacgggggtaacccggtaaaccggtaaccgggttaacggttaaccggggggtaccgggtaaaccggtaccccggggttttacgtttacccggggtacccttttaaccggtaacccgttaaccgtaccgttaaaccgggg

SEQ ID NO: 187902 - DNA, 841 bp, Homo sapiens
  misc_feature: GYAE6OF02HLQVO.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtgtccagtcccaggtcgcaacgtggtgcagtcgtgggctgaggtagaaggaccgccgtcgggttcccgtcgggtaggtaacggttcctccgtagccgaacgggccggttcggtcgggggtacctaccggttccggtacgtaaggttttcgaccccgttaagtttaccggttggggtcgtaccggaccgtaacgggtccccccgtagggaaccgtaacggggtccgttaggaggttgggacggtgggggaggtaccgttccgtccgtgttcgttgggacgcgacgtacaaaccgtacgactaacgtagttcgtacgttacgggaaggggtacgtacgtccggaacggtaccggttaccgggaacccggtaacggtaaccgtacggtacccggacctaaccggtaggtaacccttgttaccgggtacggtacgtaccgttacggtaaaaccggtacggttacggaaccgtaccggtaacggaaaccggtaccgttaacccgggttacccgttttaaccgacccggtttacgggaccggtacgtaacgggaaccggttaccccgcccccgggacccccgggaacgggacccggtaacgggtaacgggttaccggtacggggtacgggtaccggttacgggttaccggtttacggtacccgttacgtaccgtaccgttacgtaaccg

SEQ ID NO: 187903 - DNA, 881 bp, Homo sapiens
  misc_feature: GYAE6OF02JHQRU.5.64.F09.1.454.CMB.1.raw
  modified_base (184)..(184): a, c, t, g, unknown or other
  misc_feature (184)..(184): n is a, c, g, or t
  modified_base (250)..(250): a, c, t, g, unknown or other
  misc_feature (250)..(250): n is a, c, g, or t
tcagatcagacacgcacgaccggtgctcgatttagcgcgtatacaaggggcatcacataacaaccagattcctcctctaaagaagcccctgggagcacagctcatcaccatggactggacctggaggttccttctttgtggtggcagcagctacaggtgtccagtcccaggtgcaactggtgcngtcgtgggctgaggtgaagacgtccgtcgggtcctcggtgtacggtctccgtgcgaaggcgtcggnggggcctaccgttcggctaaggtttcgcctaagtttacgttggggtcgacgaccgaaccggtccccgtaggaaccgtaaggggtccttaggtacgggtggtaaggtggggaacggtacttcccggttcccgttagtttaccggtttgggacgtccgaacggaaccgtaaaccgtaaccgacctaacctaaggttcgtaaccggtttaccggaaggggtaggtaaccgtaccggtaaggtacggttaaccggggacggtaaccgtaaccgtacccggtaaccggacccgaacgtaccggttaaccgttacgtaccgttagggtaacgtccgtaaaggtaaaccgtaacggtaacggtaacgtaaccgtaacggtaaaccgtacccgggtaccgggttaaccccgttttaccgtaacccggtcggaaccggtaccggtaaaggtaacccggtaccccgttaccccccggggaacccccccggggtaagggggtaaacccggtaaacccgggttacggggttaaacggttaacggggggtaccggggtaaccggtttaacccggggtttaccccggttttagggttaccccccgtttaacgtttacccggttaaccgttaccccggtaaaccgg

SEQ ID NO: 187904 - DNA, 782 bp, Homo sapiens
  misc_feature: GYAE6OF02JAQ7V.5.64.F09.1.454.CMB.1.raw
  modified_base (156)..(156): a, c, t, g, unknown or other
  misc_feature (156)..(156): n is a, c, g, or t
  modified_base (595)..(595): a, c, t, g, unknown or other
  misc_feature (595)..(595): n is a, c, g, or t
tcagatcagacacgcacgaccggtgctcgatttagcgcgtatacaaggggcatcacataacaaccagattcctccgtctaaagaagccccgtgggagcacagctcatcaccatggactggacctggaggttcctctttgtggtggcagcagctacnggtgtccgagtcccaggtcgcacgtggtgcgagttccgtgggctaggaggtcgaaggtaccgccgttgggtccgtcggtacggacggtcctccgtggccgacggtcggtccggtggggcctaccgttccggtagtaacgtttcgaccgttatttaccggttggtcgaccgtacggaccggtcccccggttaggaccggtacgggtacgttaggtacggtacggtaaggtaggggaacggtcgtacccggttcccgttaggttcggtttacgggacacgtaccggtaaccttaaaaccggaccgtacctaacgtcgtacgggttacgtttacccggagggtacgtacgtacgaacgggtacgttacggacggagtacctacgtacgtaccgaacgagtccgtaacgttcgcggtacgtacgtacgaacgtcgacgtaacncgacgaacgtacgtacgtaccgttacgcgtacgacgacgtaacggaccgtaccggtacccccggaccccgggtagggtaaccgtaacgggaaccggttacggtaacggggtccgggtaaccggttaacccgggttccggttcgggttaacccgtttaccgtaaccggtttaccgtaaccggttaacg

SEQ ID NO: 187905 - DNA, 748 bp, Homo sapiens
  misc_feature: GYAE6OF02IGOCX.5.64.F09.1.454.CMB.1.raw
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
tcagatcagacacgcacgaccggtgctcgatttagcgcgtatacaagggggcatcacataacaaccagattcctcctctaaagaagcccctgggagcacagctcatcaccatggactggacctggacggttccttctttgtggtggcagcgagctacgaggtcgtccacgttcccgaggttcgaccaacgttgggtcgcgtacggtcggtaggggtccgtagggagggtacggaacggaccggtccggttcggggttacccgttcggggtaacggtacggttcctaccgtacggacgaacgggtccggttcggtcgggggacctaccggttccggacttaaggttcgaccgttagtttacggttcgggtcgccgacgaacccgggtcccgtaggacgtagggtcttgaggtggagngggagtctcgtccgtgtgtgcgtcacgacactcanactagtcgttcgttaggagggacgtactacgacggtacgtacggacgtacgtactcggaacccgcaacgtcgcttagccgtaggacctagtaacgacctaagcgaaccgtcgaggaccgaaccggtccgttaaccgtttcaccggtacggacggtcgaaacggtcgtaaccccgggtcccccggacccggggaaccggtacggtaaccggtaacgggttacgggtacgggggtaccgggttacctccggggtttcgttaccggttccttaacccggtaccttaccggtacttacggg

SEQ ID NO: 187906 - DNA, 706 bp, Homo sapiens
  misc_feature: GYAE6OF02IR3BA.5.64.F09.1.454.CMB.1.raw
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
tcagatcagacacgcacgaccggtgctcgatttagcgcgtatacaagggggcatcacataacaaccagattcctcctctaaagaagcccctgggagcacagctcatcgaccatggactggacctggaggttcctctttgtggtggcagcagctacaggtgtccagtcccaggtgcaactggtgcagtctggggctgaggtgaagacgcctggtcctcggtgaaggtctactgcaaggtcgtcgtgggggcctacgttcggacgtaagtttcgacctagttacttgggtgacgacacggtcccctaggaccgaaggggtcttacggaggttggagttgggaggtacgtcgtacccgtgtactttagggacncgtaacgacgtaaacctcgactacncgtagtacgtttaccgaggggtaactcggtaaccaccggtaggttaaccggcggtaaacgaacgtacgtaaccggaccgtaactacggacccttacttacgtacggagtacgtacgaaacgtaagtacggtaacgaccgtaagaccgacgtacgtaccgttaactcgtaacgcgacgacgtacgtaccgacccgggtaaccccccgaggggaacccgtaacgggtaaccggtaccggttaacgggtccgggtaacgtaccgggtacgtttacgggtacccgttaccgttaccgttaccgtacttaacccgg

SEQ ID NO: 187907 - DNA, 880 bp, Homo sapiens
  misc_feature: GYAE6OF02HJPHK.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgagtgaagcgctgggtcctcggtgagtctaccgtgacgaggtcgtcgtggggcctaccgttcggactaaggttttcgacccgtaatttaccggttggggttttcgaccggtaacgaacgggtccccccgtgggaacgtaaacgggcgtttaggacggttagggtaacggtggggacggggacttccggttcccgtgttcgtttggacgtcagacgtaaaacctcggtacctacgagtgtaacgtttccgaaggggactaaggtccgtaagtacggttacgggccgggtaacgtaacgttaccgaccggtaacccgtaacggtacgtacccgttaacgttacggtacgggtaacgtaccggtaacgtaaaaccgtaaacggttaaccggaccgtaaaccgttagggaaaccggtaacccgaaacccgggtttaacccggttttaaacccgtaaccgttagggtaacccggaacccggtaacgggtaaaccggtaaccccggttacccccgggtaacccccccccggggaacgggggtaaccccgggtaaaacccgggtaacggggtttaaccggtaacgggggggttaccggggaacccgggttaaaccggggtttccgggttttaacccggggtacccgtttaacccggtttaaccgtttaacccggttaaacccggttaacccggg

SEQ ID NO: 187908 - DNA, 925 bp, Homo sapiens
  misc_feature: GYAE6OF02HXI9N.5.64.F09.1.454.CMB.1.raw
  modified_base (195)..(195): a, c, t, g, unknown or other
  misc_feature (195)..(195): n is a, c, g, or t
tcagatcagacacgcacgaccggtgctcgatttagcgcgtatacaagggggcatcacataacaaccagattcctcctctaaagaacgcccctgggagcacagctcatcaccatggactggacctggacggttcctcgtttgtggtggcagccaggctacgaggtcgtccgacgtcccaggtcgacaccgtggtcncagtcgtgggtctggaggtacgaacgcgtccgtagggtcctcgggtacgtacggttctccgtagtacgacggccgaccgggtcgggggtacctaccggttcggtacgttaacgtttcggaccttacgtttacggttgggtcgtaccggaccgtaccgggtacccccgtagggaaccgtaacggggttcttacgggtacgggtagggtaacggtacgggggtaccgggtacgtttcccggtttacccggttttggtttaccggtttacggggacgtaccggtaaacggtaaccgttaaaacccgtccggtaaccgtaacggtaacgttacggttaaccggtttaccgggaaacggggggttacgtaacggttaacccgtaacgggttaaccgggtttacgggaaccgggttaaaccgtaacggtcccggttaaccgggacccgtaaaccgaccggttaccgttaaacgtcgggtaaccggtcgtaaccggtaacgaaaccggttaccggtacgtaaaccggtacgtacggaaacccggtcggtaacccggtttaccgttaacgtccggtaacgtcccggtaaacggtcgaaacccggtccccgttaacccccggggacccccgggacgggtaccggaaacccggttaacgggtacggtaaccggggtccgggtaccgtaccggttttacggttcccggtaccttaccggtaactttaccggaccttaccgg

SEQ ID NO: 187909 - DNA, 885 bp, Homo sapiens
  misc_feature: GYAE6OF02G0L3N.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttccttctttggtggtaggcaggcacgctacgaggttcgtcccgacgtccccgtaaggtcgaccaaacgtgggtcgcgagttccggtggggtcgtggtagggtaggaacggaccggtccgttcgggttcccgttcgggtacggtaaggttccctccgttacggacgtaacgggtcgttacggtacggggggtaccgtacccgttcgggtactaacggttttcgaccgttaacgtttacggttcggggttcgccggtaaccgtacccgggtcccggtaacggaaccggtaacgggtccgttaggtacggtagggaacggtgggggaggtacgttccgttaccggttcggttacgtttagggacgtcgaacgtaccgtaaaccgtcgacgtaacgtacgttacgttaacggtttaccggaaggggtaacgtacggtaacgaacgggtacgttaccggggacggtaacgtaaccgtaacgtaccggaccgtacgacgtacgtacgtacgggtagaaccggtacgtaacgaacggttaacggtacggaacgttaccgtacggaaccgaccggttaaccggttaccgtttacgaccggttacgacgtacggtaaaccgacgtaacccggtaccccggtaacccccgggacgggtacccggtaacgggtaacggttaacggggtacgggtacccgggtaacggttaaccgggtttacggttcccggtttaaccttacggttaacccgttacgtacgttaccgg

SEQ ID NO: 187910 - DNA, 714 bp, Homo sapiens
  misc_feature: GYAE6OF02JOQOQ.5.64.F09.1.454.CMB.1.raw
  modified_base (123)..(123): a, c, t, g, unknown or other
  misc_feature (123)..(123): n is a, c, g, or t
  modified_base (233)..(233): a, c, t, g, unknown or other
  misc_feature (233)..(233): n is a, c, g, or t
tcagatcagacacgcacgaccggtgctcgatttagcgcgtatacaagggggcatcacataacaaccagattcctcctctaaagaagcccctgggagcacagctcatcaccatggactggaccnggaggttcctctttgtggtggcagcagctacaggtgtaccagtcccagggtgcaactggtgcagtcgtggggctgaggtgaagcgtcgtgggtacctcggtagaaggtcnccgtggccaaggcgtcgtggggcaccgttcggactaagttcgccaagtttaccgttggggtcgccgtacgacggtcccctagggaacgtaagggggtccttggacggtacggagttcggggggacggtacttccggttaccgtgtttaccgttagggacgtacgtacgaactaaacgtccgacgtaccaggtacgtacgttacgggagggtacgtagtacctaggtaacggttacgggacgtaacgtaacgtacgtaccgacgtacacgtccgtagacgtaggacgtcgagtacgaacgtagacgacgtaacgaagtaccgacgtacgttacgagtcgacgacgtacggaagacccggtcccgaacccccgggagggtacccgtaaacggggtacgttaacggtacggggtcgggtaaccgttaaccgggtccggtttaacgggtacccttacggtaaccgttaccgttaacgtaaccggg

SEQ ID NO: 187911 - DNA, 736 bp, Homo sapiens
  misc_feature: GYAE6OF02GGVYY.5.64.F09.1.454.CMB.1.raw
  modified_base (139)..(139): a, c, t, g, unknown or other
  misc_feature (139)..(139): n is a, c, g, or t
  modified_base (717)..(717): a, c, t, g, unknown or other
  misc_feature (717)..(717): n is a, c, g, or t
tcagatcagacacgcacgaccggtgctcgatttagcgcgtatacaagggggcatcacgataacaaccagattcctcctctaaagaagcccctgggagcacagctcatcaccatggactggacctggaggttcctcttgnggtcggcagcagctacaggtgtccagtcccaggtcgacaactggtgcgagtccgtgggctggaggtagaacgtacgccgttagggtcctcggtaggaacggttcctccgttagcgaacgggtccgtcggtcgggggcctaaccggttcggtacgtaacggttttcgcctacgtttacggtttgggtcgtaccgaaccgtacgggacccccgttagggaaccgaaaggggtccttaggaggtagggtaacggtcgggggacggtacttaccggtcccgttggttcccgtttgggacgttaccgacgaacgtaaacgtaccgacgacctagtacgtacgtttcggaagggtagtacgtacctacggtaacgtttaccgggaaccgtaacgtacgtacgtaccggacctacgacgtccgtaagtcgtagcgtcgtagacgtacgcgtacgcgtagacgacgtcggtaccttacgtacgcgtcgacgtcgacgtaccgtaccccgacccccgggtaagggcccgaacggtccgggtaacgtacggggtaccggacgttcgggtaccgtttcggacccgttanaccgttacgtacgtaccgg

SEQ ID NO: 187912 - DNA, 819 bp, Homo sapiens
  misc_feature: GYAE6OF02HXY2N.5.64.F09.1.454.CMB.1.raw
tcagatcagacacgcacgaccggtgctcgatttagcgcgtatacaaggggcatcacataacaaccagattcctcctctaaagaacgccccgtgggagcacagctcatcaccagtggactggaccgtggtaggtttccttcgtttggtggtcgcaggctagcctagaggttcgtcagtcccgtaggtcgactacgttggtgacgtaggtcggtgggcgtggaggtagaacggaccgtccgttcggtccgtgggtagtacgtctccgtgacgaggtcgtggcggcctacgtcggcgttagttccgtactagtttagtcgggtcgacgtaccgtaccggtccccggtacgggaacgtacgggttgtttacgggtaaggttacggggtaggtacggggtaccggtaccgtttccgggttaccggtttagttacgtttaacgggcgtaaccgtaccgtaaccgaaccgtttaccgaccgtagttaacggttcgttaaccggttcgggaaagggtcgtacgtaccaacgggttaccgtacgggaacgtacgtaacgttacccggacaaccgtacgacgtaccgttagccgtaggtacaccggttaagaaccggttcgaagtaccgttaacgacggtaacgaacccggttccgtttaaccggtaaccgttaccggacgaccgggaaccgtgtacccggaaccccgggtaccccgaacccccggggagggaacccgtacggtaacgggccggtcgggtaacgggacggttaccggtttccggtttaccggttaacccgttcgtaaccgtaccggttacgtaaccggg

SEQ ID NO: 187913 - DNA, 831 bp, Homo sapiens
  misc_feature: GYAE6OF02GKAQ6.5.64.F09.1.454.CMB.1.raw
  modified_base (246)..(246): a, c, t, g, unknown or other
  misc_feature (246)..(246): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtagcagcagctacaggtgtccagtcccaggtgacaacgtggtgcagtcgtgggctgaggtgagacgcctgggtcctcggtgaggtctccgtgacgaaggcgtcgnggggtccaccgttcggctaagttcgcctagttacgttgggtcgaccgacgacggccccctaggacgtaacgggtccgttggtacggtggacgtggggaggtacgtccggttcccgtggttcgtttcgggagtaccgaggtaacctaaacggtccgtaacgaccgtagttacgtaaccgtttaccggaagggggtaactaggtaaccgtaccggtacgttaccggggacggtaaccgtaacgttccgtaaccgggtaccgaaccgtacggtacccgttacgttaccggtcgggtaactccggttaacggaaacccggttaaacgggttccggttaaaccggaacccgttaacgggaaaaccggttacccgggtaaccgggttaacccggttttaaaccgtaccggtttaccgggacccggtttaggaaccgtaccggtaaccggtaccccccgggtaaccccccgggaagggggacccgtaaaccggggtacggtaacggttacggggtaccgggggtaaccgttaaccggttcgggtttaccggtacccgtttaacccggtacgtttaacccgtacgttaaccgg

SEQ ID NO: 187914 - DNA, 750 bp, Homo sapiens
  misc_feature: GYAE6OF02IIROY.5.64.F09.1.454.CMB.1.raw
  modified_base (118)..(118): a, c, t, g, unknown or other
  misc_feature (118)..(118): n is a, c, g, or t
  modified_base (124)..(124): a, c, t, g, unknown or other
  misc_feature (124)..(124): n is a, c, g, or t
  modified_base (455)..(455): a, c, t, g, unknown or other
  misc_feature (455)..(455): n is a, c, g, or t
  modified_base (570)..(570): a, c, t, g, unknown or other
  misc_feature (570)..(570): n is a, c, g, or t
  modified_base (615)..(615): a, c, t, g, unknown or other
  misc_feature (615)..(615): n is a, c, g, or t
tcagatcagacacgcacgaccggtgctcgatttagcgcgtatacaaggggcatcacataacaaccagattcctcctctaaaggaagcccctcgggagcacagctcatcaccatggacncggacnggaggtctcttgtaggtgcagcagctaccaggtcgtcacgtacccaggtcgactaacgtggtcgcgacgtcgtggggctggagtgaagacgcgtggtcctcggtagacggtcgtcctagcgaaggtcgtacggtcgggggtccaccgttcgggacgtaagtttcggactaacgtttacgtcggggttgccgaacggtaccggtcccggtacgggtaaccgtaaagggtccggttaggtacgggttacgggaacgttgggtaacggacgtcggtcccgttacggttcgtttacggacgtacgacgtacgtaaactcggtaacaccgttaagngtacttacggaagggtaactacgtacgaacggtcgtaacgggtccggaaagtacgtaccgacggtaccaagtcgaaagtcgtacggtacgacgttagtaaccggaaacgtcggtnaaaaccggcgttaaacgacggtaaaccgtcgttaccgttaaaccncgggtacgtacaacggggtactagtaccgtaccccgggaacccggtacgggaccgtacggtaactaagggcgggtaagggttcgtacggtttaccgtacggggttccttaacctacgtaaccgttactaaccggg

SEQ ID NO: 187915 - DNA, 778 bp, Homo sapiens
  misc_feature: GYAE6OF02H82K6.5.64.F09.1.454.CMB.1.raw
  modified_base (387)..(387): a, c, t, g, unknown or other
  misc_feature (387)..(387): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgccgtgggtccgtcgggtgacggtcgtcctgcgaaggcgtcgtcgggggcaccgttggctaagttgcctattacgttgggtgcgacgcggccccgtaggacaagggtcttaggtacggtgggagtaggggaggagttccgtccgtggttcgtttggagtcgagacgaacgtacgctacgntagtactttccggaagggtgtacgtcgaacggtacgttaccgggacggtaacgtaacgtaccgtaccggaccgaacgacgtacctacgtccggtaggtacggtaccgttaacggaaacgtaaccggtaggtaacgtaaccgtaggaaaccggtaccggtaaccggttacccggtttaaccgtacgtacggtccgtaacgtacgggtaacgtacccggttacccccggggaaccccccgggtaccggggaaaaaaaacccggtcggggtaaacggttaaccggggtacggggggtaacccggggggtaacccgtaccggggtttaccggttttaccggggttaccccgtttaccggtttaaacccggttacccgttaccggtttaaacccgg

SEQ ID NO: 187916 - DNA, 771 bp, Homo sapiens
  misc_feature: GYAE6OF02J1HLA.5.64.F09.1.454.CMB.1.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
tcagatcagacacgcacgaccggtgctcgatttagcgcgtatacaagggggcatcacataacaaccagattcctcctctaaagaagcccctgggagcacagctcatcaccatggactcggacctggaggttcctctttggtggtggcagcagcctacgnggtcgtccagtacccgaggtcggacgacgtgggtacgcgacggtcggtgggctaggaggngaacgaccggccgttcgggtacctcggtacgaacggtcctcgtggcggtaggcggtacggtcggggtctaccggttggtacctaggttcgacttacgtttacgtgggtacgcgaaacggtccggtcccgagaacggtaggcgttgtaaggtggacggtaggggtcgacgtcggtcccgttagtcggttacggacgacgtcgtaaactaaccggtctaccggattacggttacgtacgttacgggaagggtcgaagtaccggtacggtacggtaccgacggtaacgacgtacgacccgcgtaacgtcgacgtcgtacggtacgtacgacgtaacgacggacgtcgaaccggctaacgggaaccgtgtaacccggttacttagtaccgtaacgtcggaaccgattaccggaccccgtaaccccggggtacccggaaggggtccgttaaacgggggcttaacgggtaccgggggtaaccggtaacccgggtttaccgggtttccggttaaccgtacccgttttaacccggtacgttaaccgtaacccgttacggg

SEQ ID NO: 187917 - DNA, 722 bp, Homo sapiens
  misc_feature: GYAE6OF02HZUKQ.5.64.F09.1.454.CMB.1.raw
  modified_base (545)..(545): a, c, t, g, unknown or other
  misc_feature (545)..(545): n is a, c, g, or t
  modified_base (570)..(570): a, c, t, g, unknown or other
  misc_feature (570)..(570): n is a, c, g, or t
tcagatcagacacgcacgaccggtgctcgatttagcgcgtatacaagggggcatcacataaacaaccagattcctcctctaaaagaagcccctgggagcacagctcatcaccatggactggacctggacggttcctctttgtcgggtggcagtcagctaacaggtgtccagtcccgaggtcgacaacgtggtcgcagtcgtgggctggacggtagaacgacgccgtgggtccgtcggtaggaacggttcctcctcgacaacggtcgtcgtcggggtccaccgttcggactaaggttcgacctagtttaccgttggggtcgaccgacgtcgggtccccgtaggaacgtaaggggtcttacgggacggtggacggtaggggaggtacgtccgtacccgtgttaccgttagggacgtactacggacctaaaaccgtcgaccacgtacgtcgtaacgttccggaaaggggtactacgtacgaaacgtacggttacgggaacggtaacgtaaactccggtaacggccaacgtaccggtactaagttccgnggacgtacgtaacgaaacgtaacgngaacgtacctaggaaccacgacggtaccttacgtaacgcgacgcgaagtacgaccgtcccggaaccccggacgggacccgtaaggcggtagtacgggtccgggtactacgggttcggtttacggtccttaacgttaccgtacttagtaaccg

SEQ ID NO: 187918 - DNA, 539 bp, Homo sapiens
  misc_feature: GYAE6OF01DQ2IT.42.39.D06.1.454.CMB.1.raw
  modified_base (160)..(160): a, c, t, g, unknown or other
  misc_feature (160)..(160): n is a, c, g, or t
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttangctgactcagccccatctgtgtcggggtctccggggaanacggtaaccctctcctgccacccgnagcagtggcagcatgccaanaactatgtgcagtggttgcagcagccgcccgggcacgttccccccacactgtgatctatgaagataancaaacgccctgtcgggtccctgacttcggttctctggcctccatcgactacgttccnccaactctacgccctccncacctatcctgtgactgaagactgagacgaggctacgacttactctgtactagttcttagtgaatacgcagtccgtagttgggtacgttcgggacgggtacggacgaagcccgtacgacccgttacgacggtacaccgacccgagggtcccc

SEQ ID NO: 187919 - DNA, 536 bp, Homo sapiens
  misc_feature: GYAE6OF01D19NB.42.39.D06.1.454.CMB.1.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (467)..(467): a, c, t, g, unknown or other
  misc_feature (467)..(467): n is a, c, g, or t
  modified_base (522)..(522): a, c, t, g, unknown or other
  misc_feature (522)..(522): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggccaattttatgctgactcagccccactctgtgtcggggtctccggggaaagaccggtaaccctctcctgccacccgcagcagtggcagcattgaccaanaactatgtncagtggttgcagcagccgcccgggcacgttcccccacnctgtgatctatgagtataanacaaaanccctcgtcggggtacctgacgttcggttctctggcctaccatccgtacncgtttcccactaactctcgtccctccctaccacctatcctcgttcgactagaacgactgaggacgaggctgacctactatcgtactagttcgttangtatagacagtctacgttggtgtcgggacggaggacagccgtgaccgtcgtagtnacgccgacgtcccg

SEQ ID NO: 187920 - DNA, 574 bp, Homo sapiens
  misc_feature: GYAE6OF01DSER8.42.39.D06.1.454.CMB.1.raw
  modified_base (156)..(156): a, c, t, g, unknown or other
  misc_feature (156)..(156): n is a, c, g, or t
  modified_base (221)..(221): a, c, t, g, unknown or other
  misc_feature (221)..(221): n is a, c, g, or t
  modified_base (401)..(401): a, c, t, g, unknown or other
  misc_feature (401)..(401): n is a, c, g, or t
tcagtgacgtatgtcacgaccggtgctcgatttagtgacatctcgcagttctttggggtggtagctcaggaagcagagcctggagcatctccactatggcctgggctccactactctcacctctcgctcactgcacagttcttggcctaattttangctgactcacgcccactctgtgtcggggtctccggggaagacggtaaccctctcctgccacccgnagcagtggcagcattgccaacaactatgtgcaggtggttgcagcagcgcccgggcacgttcccccacactgtgatctatggacgataatcaaaacgccctgtcggggtccctggattcggttctcgttggactccaatcgactacgtttcccaccaacgtctgcccttcccctcaacctnttcgtcgtggaacttagaaacgcgtaggaacggtaccgaaggtccttagaacctttacgtaccttaaggtcctaaggttcttaagtggaattagcaagtcctagttggggtcgtcgggcgggtaagggaccaaggctggaccccgttcgtacggcaacggcccaaggtccccg

SEQ ID NO: 187921 - DNA, 602 bp, Homo sapiens
  misc_feature: GYAE6OF01EVKU5.42.39.D06.1.454.CMB.1.raw
  modified_base (384)..(384): a, c, t, g, unknown or other
  misc_feature (384)..(384): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaatttttatgctgactcacgccccactctgtgtcggggtctccggggaagacggtaaccctctcctgccacccgcagcagtggcagcattgaccaaacactatgtgcagtggttgcagcagccgccgggcacgttcccccaccactgtgatctatggacggaataactacaaaacgacccctgtcggggtccctgtacttcggttctcgtggcctccatcgactgtttcccncaactctcgccctccctcacctactcctcgtcggactgaacgacgtaggaacggtacggaggtcctagaacccttacttacgtcgtacgtagttacctttagtagtaattacggactaaggccttaacggtttagggttcgggtttacgggacggggtaacgggaccgtaacggccgtacggacccgttcgtacggtacgacgcccgaaggtccccgg

SEQ ID NO: 187922 - DNA, 604 bp, Homo sapiens
  misc_feature: GYAE6OF01EWFJP.42.39.D06.1.454.CMB.1.raw
  modified_base (118)..(118): a, c, t, g, unknown or other
  misc_feature (118)..(118): n is a, c, g, or t
  modified_base (158)..(158): a, c, t, g, unknown or other
  misc_feature (158)..(158): n is a, c, g, or t
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
  modified_base (405)..(405): a, c, t, g, unknown or other
  misc_feature (405)..(405): n is a, c, g, or t
tcagtgacgtatgtcacgaccggtgctcgatttagtgacatctcgcagttctttggggtggtagctcaggaagcagagcctggagcatctccactatggcctgggctccactacttcncaccctcctcgctcactgcacaggttctggccaattttangctgactcacgccccactctgtgtcggggtctccggggaagaccggtaaccctctcctgccacccgnagcagtgcagcattaccaanactatgngcagtggtncagcagccgcccggctaccgttcccccacactgtgtactctaatgaagataataccaaaagtcccctagtcggggtccctagacgttcgttctctggcctccatccgactacgttccctaccacttctcgtccctcctccaccntctcgtagactgaacgtacgtgacggacgacgtctacgtaacttacctacgttcgtccgtagtttaccttaagtagtacttaacgcgtacgtcgtaacggtttcggggttcggttccgggaacggggtacggaaccgaaggttccgtacgacccggttacgtacgggtaccaccgggacccgacggtcccgtacccccg

SEQ ID NO: 187923 - DNA, 793 bp, Homo sapiens
  misc_feature: GYAE6OF01BKUKW.42.39.D06.1.454.CMB.1.raw
  modified_base (160)..(160): a, c, t, g, unknown or other
  misc_feature (160)..(160): n is a, c, g, or t
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggcctaattttangctgactcacgccccatctgtcggtcgggtctccggggaagaccggtaaccctctcctgccaccgnagcaggtggcagctattcgaccaaactactatcgtncgtaggtggttcgcagcacggtccggcccgggctacccgttcccccactacgtggtacacgttctagtaggaagtaactaacgtaaccgtaaaaccgtccgttacgggttccgggtcccgtaggttacgttccggtttctcgtcggtcctaccgtacgtaccgtacttaaccgttcccctaacctaacctccgtcccgttaccctccccgtacctaccttacttccgttacgtaacggtaccttaacgggaaccgtaacgggtacggaacggggtaaccgtcggttaccgtaacgttaacccttacgtacgtttacgtaccttaacgggttactttaacgtgggtaactaccggtacggtaacgttaccgggttacggggtttaccggggtttccgggggtaacccgggtaaccgggggttaacgggaacccggttacgggttaaccccggttaccggttaacccccggggttacgttacccgggtaaccccggtacccggtaaccccgggtaacccggggtttcccccgg

SEQ ID NO: 187924 - DNA, 790 bp, Homo sapiens
  misc_feature: GYAE6OF01A6OQT.42.39.D06.1.454.CMB.1.raw
  modified_base (314)..(314): a, c, t, g, unknown or other
  misc_feature (314)..(314): n is a, c, g, or t
  modified_base (469)..(469): a, c, t, g, unknown or other
  misc_feature (469)..(469): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactcgcacgtacggttcgttcgggaccttaatttttagtcggtctcgtaacctccgaccgtccccctacttcgttcgggttcggtccgggggttccggtaccggggaacgtaccggttaaccctctccgtcgccacccgcaggcgaggtcggcaggtctagttccgacaacaacgttagtcgngtacgtgggttagtcgacgacgcgacggtcccggcccggtacctaccccgttacccccaactcggtgtacgtacgtacttaggacggtaacgaaactacgtaaacgtaaaccgttccccggtcggttccggggtcctacggtcgtttaccggttnccggttcgaccctacgtactcgtacttaccgtcctaccgtacctcgtaccctcccttaccctacgtaccttacgtccgttacggtacgtacgtaaccgtagtaaccgtacgggtacggggactacgggtacccgttaacgttaaccgttaccgttacggtaccgttaacgttacgttaaccgttgtacgtactacgtaccgaacgttcggttacgggttcggtaccggggttacgggacgtaacggttacccggtcggttaaccgtaccgtaccggttacccggtacgaaccccggtaccgtaccggtaaccgtccccggg

SEQ ID NO: 187925 - DNA, 654 bp, Homo sapiens
  misc_feature: GYAE6OF01D1SL7.42.39.D06.1.454.CMB.1.raw
  modified_base (160)..(160): a, c, t, g, unknown or other
  misc_feature (160)..(160): n is a, c, g, or t
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
  modified_base (525)..(525): a, c, t, g, unknown or other
  misc_feature (525)..(525): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttangctgactcagcccatctgtgtcgggtctcggggaanaccggtaacctctctgcaccgcagcagtgcagcatgaccaacaacttangtgctagtggtcncancgagccgcccgggctacgttccccactactgtgactctatggagtataacacaaagtcccctagtcgggtaccngtacgttcggttactcgtcgtacctccgaactcgtaactacgttccctacccaaactttccgttccgccccttaccctacccgaaccctacttcccgtacgttacggtaaccgtagaacctacggtaggtaaccggacggtacgtactacggaacttactactgtactacgttcttagtcgtatacggtnaacgtctacggttacgggttcgggttaccgggacgggtaaccggggtaacctacggtacccgttccggggaaaccccgtttcgggtaacccgggtcgaaacccgggtaccccgtaaggttccccccggg

SEQ ID NO: 187926 - DNA, 904 bp, Homo sapiens
  misc_feature: GYAE6OF01AH5IL.42.39.D06.1.454.CMB.1.raw
  modified_base (118)..(118): a, c, t, g, unknown or other
  misc_feature (118)..(118): n is a, c, g, or t
tcagtgacgtatgtcacgaccggtgctcgatttagtgacatctcgcagttctttggggtggtagctcaggaagcagagcctggagcatctccactatggcctgggctccactacttcncaccctcctcgctcactgcacgtacggtttcgttcgggaccttaatttttagtgtccttagacctccgaccgccccactccgtggttcggtcggggtcgtaccggggaacgaccggttaacccgtctccgtcgacccgacccgcgacgtcgacggcggccaggactacgttcgacccaaactaccgttaagttcggtacgaccgttaagggttcgggtacgtaccgacggccgaaccgggccccgggaccccgggtacctaccccggtaccccccgaccgttacgtggtacgtacttacgtacggtacggtaacgttaacttaactaaccgtaaaccggtcccgtccgggttacgggttcccgtacgttaccggttccgggtttacctcggttaccgtaccgtaccgttaacggtacccgtaccgtttaccgtttaccccgtacccgttaacccgtccccgttcccgttacccctaccccgttaaccgttacccctacgtttaccccgttacggttaaccgggttaactaaaccgggtaaacccggtttagggaaacccggggttacgggtaccggtaccgggttaacccttaacccggtttactaacccgggttttatacccggtttacgttaacggtttaaccttagttaacggaacgttaaccgacggttaaccggttcgggttaccgggtttaccggggttacgggaccggtaacgggtacgtaacggaccggttcgaaccccggtttacgtacgcgtacccgccggtacgtccggtccccg

SEQ ID NO: 187927 - DNA, 753 bp, Homo sapiens
  misc_feature: GYAE6OF01CW111.42.39.D06.1.454.CMB.1.raw
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
tcagtgacgtatgtcacgaccggtgctcgatttagtgacatctcgcagttctttggggtggtagctcaggaagcagagcctggagcatctccactatggcctgggctccacttacttctcaccctctcgctcactgccacgtaggtttcttgggaccctaaatttttatcgcttcgacctcacgcccctactctggttcggtaccggggtccgtaccggggaacgaccgttaacccgtcttccgcgccgacccgtcagcctaggtcgcgagtctagtttcgaacaaactaactagttcgtagtcgtagttaggttcgcgaacgcgtcgcccgggtccggaccgtacccgttaccccccaacgtacgttcgcgtaactccgtaagtaggtaacggtaaactaaacgaaccgtaaaccgtccccgttcggtcggttccctggtaccgttcgttaccgtcgtacgtccacgactaccgtctacgttacccaccgttactccgtcctcccgttaccncctactacttccgtcgtcggtaanacggtacgtacgtaggacggcgacgttcgaaccttactacgttactccgtaacttcgttacgttatacgacttaccggacttacggtccgttagggttaccggggttacggtacccggggacgggttaaacggaccctaagggttcccccgggttaaacgttacccgttaaccgtaacggttaccccgaaacgttcccggacccggtttaccccgg

SEQ ID NO: 187928 - DNA, 768 bp, Homo sapiens
  misc_feature: GYAE6OF01BZTLI.42.39.D06.1.454.CMB.1.raw
  modified_base (161)..(161): a, c, t, g, unknown or other
  misc_feature (161)..(161): n is a, c, g, or t
  modified_base (232)..(232): a, c, t, g, unknown or other
  misc_feature (232)..(232): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacgaggttcttgggcctaattttangctgactcacgccccatctgtcggtcgggtcctacggggaacgaccggtaaccctctaccgtgccacccgnagctagtgcagctagtcgaccaacatatgtacgcgtaggttggtcacgacggccgacggtcccggacccggacctacccgttccccccgaactagttcgtacgtacttacgtaggtacggaagtaactaaacgtaacgaaacccggtacccgttggtacccgggttacctaggtaccgttccgggttacttccggtacggtccctaacgtaccgtaccggtaaccgtttcctttaccccgtaacccttaacgtcccgtaccccggttccccttacccccggtaacctacccggtttaccttcggtaacccggtagtaaccgttacgggaaccttgggaaccgggtacggaccggtacggttcctaacgtaaccttaccgttacggtcgttacttacggtccttaagacgtactcgacgtacgttcggtacgggtttcgggtccggttaacgggcggggtaactaaccgtcggttccggtaacccgggttacccttacgggttaccgacccgtaaccggtaccgccggttaccccgg

SEQ ID NO: 187929 - DNA, 755 bp, Homo sapiens
  misc_feature: GYAE6OF01EJGD0.42.39.D06.1.454.CMB.1.raw
  modified_base (163)..(163): a, c, t, g, unknown or other
  misc_feature (163)..(163): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcactaggttcttgggcctaatttttangtctgtacctcacgccccactcgtgtaggtccggggtcgtaccggggaagtaccggtaccctctcctcgccacccgcagccaggtcggcagctattcgaccaaacaactagtggtacgcgtaggtcggttgcacgtcgaggcccggcccgggctaacccgttcccccacgtacgttgtcgtactacgtagtaggaaggtaataaactaaccgaaaacgtccccgtacgtccggggttcctacggtacgtttccggttaccttcggtcggtccgtaccgtaccttacggaactaccggtttaccctacctaaccgttcctcccgttcccctacccttaccacccgtcttccgttcgtaacgtaactaacggtaacggtacgtagggaacggacggtaacgtacggtacgtaacttaacgtacgttcggtacgttaccgttagttaagttacgtaacgtacgtaacgtacgttaccgggttcggttacggggtttaccgggttacgggggaaccgggtaaccgggtacgaaaccggtccgttaacggacccggtttacggaccggtaagaccgtaccccgggtcggtacccccg

SEQ ID NO: 187930 - DNA, 511 bp, Homo sapiens
  misc_feature: GYAE6OF02IOQ47.42.39.D06.1.454.CMB.1.raw
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttatgctgactcagccccactctgtgtcggggtctccggggaagacggtaaccctctcctgcacccgcagcagtggcagcattgccaacaactatgtgcagtggttgcagcagcgcccgggcacgttcccccaccactgtgatctatgaggataatcaaagacccctcgtcggggtccctgatcggttctctggctccatcgacagttccctccaactctgccctccctcaccatctctggactgaagctgagacgagctgactactactgtcagtcttatgatgcagctagttgggtgttcgggcggagggaccaagccgtggacccgttcgtaggtccaggccccaaggtccc

SEQ ID NO: 187931 - DNA, 527 bp, Homo sapiens
  misc_feature: GYAE6OF02GZDGF.42.39.D06.1.454.CMB.1.raw
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttatgctgactcagccccactctgtgtcggggtctccggggaagacggtaaccctctcctgcacccgcagcagtggcagcattgccaacaactatgtgcagtggttgcagcagcgcccgggcagttcccccacactgtgatctatgaggataatcaaagaccctcgtggggtccctgatcggttctcgtggctccattcgactagttcctccaactctcgccctccctcaccatctctggactgaagactggaggacgaggctgaactactactgtcagttcttagtcgtatacgcagctacgtttgggtgtttccgggcgggaaggaccaaggctcggaccgtccgtaggtccgacgtcccgaggtcccg

SEQ ID NO: 187932 - DNA, 538 bp, Homo sapiens
  misc_feature: GYAE6OF02H4Q3N.42.39.D06.1.454.CMB.1.raw
  modified_base (436)..(436): a, c, t, g, unknown or other
  misc_feature (436)..(436): n is a, c, g, or t
tcagtgacgtatgtcacgaccggtgctcgatttagtgacatctcgcagttctttggggtagctcaggaagcagagcctggagcatctccactatggcctgggctccactacttctcaccctcctcgctcactgcacaggttcttggccaattttatgctgactcagccccactctgtgtcggggtctccggggaagacggtaaccctctcctgcacccgcagcagtggcagcattgccaacaactatgtgcagtggttgcagcagcgcccgggcagttccccaccactgtgatctatgaggataatcaaaagccctcgtggggtcccctgatcggttctctggcttcatcgactagttccctccaactctcgccctccctcaccatctctggactgaagctgaggacgaggctgactactactgtcagttcttatnatagcaagctacgttgggtcgttacgggcggaacgggaccaaggtccgtacggaacccgttccgtaacgggtccaacggaccccaacgggtcctaccccggg

SEQ ID NO: 187933 - DNA, 545 bp, Homo sapiens
  misc_feature: GYAE6OF02HLGG1.42.39.D06.1.454.CMB.1.raw
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttatgctgactcagccccactctgtgtcggggtctccggggaagacggtaacctctcctgcacccgcagcagtggcagcattgccaacaactatgtgcagtggtgcagcagcgcccgggcacgttcccccaccactgtgatctatgaggataatcaaaagtcccctgtgggtccctgatcggttctcgtggctcatcgactacgttccnccaacttctcgccctccctcaccatctctgactgaanctgacggacgaggcctgacctacgtactcggtacagttcttaagtgtaatagactagactacggttgggtcggtttccggggcgggaacgggaacctaggaccgtagacccggttcgtacggtcaacggtcccgaaggtcccg

SEQ ID NO: 187934 - DNA, 641 bp, Homo sapiens
  misc_feature: GYAE6OF02HU5A9.42.39.D06.1.454.CMB.1.raw
  modified_base (285)..(285): a, c, t, g, unknown or other
  misc_feature (285)..(285): n is a, c, g, or t
  modified_base (390)..(390): a, c, t, g, unknown or other
  misc_feature (390)..(390): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggccaattttatgtctgactcacgcccccactctgtggtcggggtccgtaccggggaagaccggtaaccctcgtccgtcggccacccgcagccagtggcagcattgaccaaacaactatgtgacagtggttgcagcgngccgcccgggtcaccgttccccccacaccgtgtcgatcctagtgaacggtataaactacgaaacgacccctggttccggggtaccctggtacgttcggttctcgnggtccctacgtaagtccgaacttaccgttccctacccaactttcccgtcgtcccccttcccctcaaaccctctccttcgtacggtactagaacgtctaggaggtaccgnggtccgtaacnctaactcgtgtacctgttacctagactatagctaacgtcctaggttcgggttcgggtacgggccgggtaacgctaaacggcgttaccggaccgtaccgttaacgggccgtaaccggcctaacggggtcccc

SEQ ID NO: 187935 - DNA, 669 bp, Homo sapiens
  misc_feature: GYAE6OF02GS5CF.42.39.D06.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttatgctgactcagccccactctgtgtcggggtctccggggaanaccggtaaccctctcctgcacccgnagcagtggcagcattgccaacaactatgtgcagtggttgcagcagcgcccgggcacgttccccccaccactgtgactctagtgaggataatacaaacgaccctcgtcgggtccctagtatcggttctcgtcggctccatcgactacgttcctccgtaactctaccgtccctaccctacctacccgtaacttccctcgttacggtaacctacggaaacgtaccgtagggtaacggtaccggagggtccgttacgtaaccgttacccgttaaccgttcgttaccgttacgttaccgttagtacgtacttaacggacctaacggtaccgttacggtttggggttaccggttacggggcgggaaccggggtaacccaagggtccgttaaccgggtacccgttacccgggttacggtaccggtacccggacccggtacggtacccccgg

SEQ ID NO: 187936 - DNA, 630 bp, Homo sapiens
  misc_feature: GYAE6OF02I2T4W.42.39.D06.1.454.CMB.1.raw
  modified_base (399)..(399): a, c, t, g, unknown or other
  misc_feature (399)..(399): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttatgctgactcacgccccactctgtgtcggggtctccggggaagaccggtaaccctctcctgccacccgcagcagtggcagcattgaccaacaactatgtgcagtggttcgcagcagcggcccgggcacgtcccccaccactgtgatctatgagataactcaaacgccctcgtcgggtccctggtactcggtttctcgtacggcctccgactacgacctacggttcccctacctaaccttcncgtcccctccctaccacctacttcctcgtacgacttaagaacgtacgtagacggaacgtacggactacgtaacctacttacgttagttcctaaggttaccttagtacgtattaacgctaagtacttaccgggtttgggttcgggtaccgggacgggtaaccgggacctaaacggtccggttaaccgtcccggttaccgtacggaccgtaccggaccccgtacggtccccgg

SEQ ID NO: 187937 - DNA, 622 bp, Homo sapiens
  misc_feature: GYAE6OF02IA6WU.42.39.D06.1.454.CMB.1.raw
  modified_base (158)..(158): a, c, t, g, unknown or other
  misc_feature (158)..(158): n is a, c, g, or t
  modified_base (198)..(198): a, c, t, g, unknown or other
  misc_feature (198)..(198): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttggccaattttangctgactcagccccactctgtgtcggggtctccggggaanaccggtaaccctctcctgcacccgcagcagtggcagcattgccaacaactatgtgcagtggttgcagcagcgcccgggcagttccccccacacctgtcgatctatgaggataaatcaaagaccctcgtcggggtccctgacttcggttctctggacttccatcgaactacgttccctccaacttctcgtccctcccctacacccagtcctctcggactaggaacgtacgtaggaacggacgaggtcctagaacctaccttactcgttaccaggttcctttaagtgtaattacggactaacgtactacgttttgggggttacgtttacgggggaccgggtaacggggtaaccctaaaggtcccggttacggtaacccggttacccggttaagggtcccgtaacggtaccccgaaagggtccccgg

SEQ ID NO: 187938 - DNA, 661 bp, Homo sapiens
  misc_feature: GYAE6OF02IQDGH.42.39.D06.1.454.CMB.1.raw
  modified_base (157)..(157): a, c, t, g, unknown or other
  misc_feature (157)..(157): n is a, c, g, or t
  modified_base (216)..(216): a, c, t, g, unknown or other
  misc_feature (216)..(216): n is a, c, g, or t
tcagtgacgtatgtcacgaccggtgctcgatttagtgacatctcgcagttctttggggtggtagctcaggaagcagagcctggagcatctcactatggcctgggctccactacttctcacctctcgctcactgcacaggttcttgggccaattttangctgactcagcccactctgtgtcggggtctccgggaagacggtacctctctgcacccgnagcagtggcagcattcgcaacaactatgtgcagtggttgacagcagcgccgggcacgttccccacactgcgatctagtcgagaataatacaaacgtccctcggtcggggtccctgacgttccgggttctacgtcggacctctagtaccgacgtacgttaccctaccgtaaacctcgtaccgtcccttcccctacaccctacttacccttcgtacgacttaggaaacgtacgtacggtacggacggtacggtacctacgtaaccttactaacgttaccgttacttaacgggtttaccttaagttggaaacttaaacgggcctaaaccgggtccttaacgggttttcgggggtcgttttaccgggggccggggtaaacgggaaccgtacggccgtaccggttaccggttaccgtagggttacccgacggtacccgacggtaccccgg

SEQ ID NO: 187939 - DNA, 625 bp, Homo sapiens
  misc_feature: GYAE6OF02H0B87.42.39.D06.1.454.CMB.1.raw
  modified_base (160)..(160): a, c, t, g, unknown or other
  misc_feature (160)..(160): n is a, c, g, or t
  modified_base (242)..(242): a, c, t, g, unknown or other
  misc_feature (242)..(242): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggccaagttttangctgactcagccccactctgtgtcgggtctccggggaagacggtaccctctcctgcaccgcagcagtggcagcattgccaanaactatgtgcagtggttgcagcagccgccggcacgttccccccacactgtgactctatggaacggataatacaaacgtccctacggtcgggtccctgtacgttccggttctcgtcggtcctccagtccgactacgttccctccaactctaccgtcctccctacacctctctcgtcgactgaacgcgtaggacggacgtagccgtagtactaaccttacgtcgttacctaggtttaccttaaggtagtaacgtacgacgtacggtaccgttaccggttaggggttaccggtttaccggggaacgggtaacgggacccgtaacggtaccggtaccggtacccggttaccgtacgggttaccgacgtacccggaacggttccccgg

SEQ ID NO: 187940 - DNA, 607 bp, Homo sapiens
  misc_feature: GYAE6OF02H370L.42.39.D06.1.454.CMB.1.raw
  modified_base (158)..(158): a, c, t, g, unknown or other
  misc_feature (158)..(158): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (509)..(509): a, c, t, g, unknown or other
  misc_feature (509)..(509): n is a, c, g, or t
tcagtgacgtatgtcacgaccggtgctcgatttagtgacatctcgcagttctttggggtggtagctcaggaagcagagcctggagcatctccactatggcctgggctccactactctcacctctcgctcactgcacagttcttcgggcctaattttangctgactcacgcccactctgtcggtcgggtctaccggggaagacggtaaccctctcctgcacccgcagcagtggcagcattgaccaaataactatgtgctagtggttncagcagcgccgggncgttcccccacactgtagatctatgaaggattaanactaaacgacctcggtacggggtccctgacgttcggttctacgtcgctccgatcgactacgttcctacacgtcncgtcctacccncaccgtactctacgtcggactagaaacgaccgtggtaacggacgtaacgggtctaagaccttactaacgttcgtacctaagtttcctttaagaggtaacttggactaanccgttacggtttgggttaacgttcgggtaagggaccggtaacgtaacggtcgtacggttccggttaccgtacggttcccaacgtcccgaaggtcccgg

SEQ ID NO: 187941 - DNA, 625 bp, Homo sapiens
  misc_feature: GYAE6OF02HUPXD.42.39.D06.1.454.CMB.1.raw
  modified_base (161)..(161): a, c, t, g, unknown or other
  misc_feature (161)..(161): n is a, c, g, or t
  modified_base (223)..(223): a, c, t, g, unknown or other
  misc_feature (223)..(223): n is a, c, g, or t
  modified_base (312)..(312): a, c, t, g, unknown or other
  misc_feature (312)..(312): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggaccaattttangctgactcacgcccatctgtggcgggtctccggggaagacggtaccctctcctgccacccgnacgcaggtggcagctattgacccaaacaacgtatgtcgcaggttgttgcagcaggccgccgggctaccgtcccccacactgcatctagngtaggaataataccaaacgacccgtgtccgggtcctgacgttcggtctacgcggtcctcatacgactacgttcccacctactcctcgtccccttcccacgtacctctcctcgtacggtacctaggaacgtacgtaggaacggaaccgaggtcctagtaaccttaaccttcgtacgttacgtaacgttctttaacgtactaagtcgtactagtaccgttcggttaggggttcggtcggggaacgggtaaccggacgtaacggtccgacggtacccgttaccgtaggtacccgacggttacccggacgttcccgg

SEQ ID NO: 187942 - DNA, 620 bp, Homo sapiens
  misc_feature: GYAE6OF02HP92I.42.39.D06.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaattttatgctgactcagccccactctgtgtcggggtctccggggaanaccggtaaccctctcctgccacccgcagccagtggcagctattgccaacaactatgtncaggtggttncagcagccggcccgggcaccggttcccccactactgtgaactctaatggaaggtataactacgaacgtacccttggtccggggtcctgtacgtcggttctcgtcgcttccagtcgatccgttccaccctaactctccgcccttaccctacgtacctacttcctcgtacggacttacgaaacgtcgtaggaacggacgagtccgtacgtaccttacgtactcggtacttcggttacttagtctaagtagtcgtacgtcgttacggttgggttcggtccgggaggggtacggtaccgtaacgtccggtacgtaccggttcggtaacgttccgacggttacccggacggttcccg

SEQ ID NO: 187943 - DNA, 759 bp, Homo sapiens
  misc_feature: GYAE6OF02JUGVF.42.39.D06.1.454.CMB.1.raw
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggcctaattttatgctgactcacgccccactctgtggtcgggtctccggggaagaccggtaccctctctcgcaccgcagcacgtggcagctagttcgaccaaacaactagtgtgcgtaggtggttcgacgagacgacggccggcccggggactaacccggttccccccaccgtaccgtggtcgtactctaagttcggaaggtaataacgtacgtaaaccgtcccgttcgtcggggttccctaggtacgttccggttcttccggttacggtccctaccgtagttccgaccgttaccgtttacccgtaccctaaccgtttcctcccgggtaccccttaccccgtaccgacccttagttcctacgtacggtactaggtaaccgtacggttagggaaccggtaggtaccgtccgttaagtacccgtttaaccgtacgtttcgtacgttaaccgtttagttaaccgtaggtaacgtaaccgtcggaaaccgtttccggttaacgggtttcggggtttaccggtaccggggtaacccggggtaaggtaacccggtaaaggttccgtaccgtacccggttacgggttcgaaccggtacgtcccggaaccgttccccgg

SEQ ID NO: 187944 - DNA, 655 bp, Homo sapiens
  misc_feature: GYAE6OF02I76C8.42.39.D06.1.454.CMB.1.raw
  modified_base (161)..(161): a, c, t, g, unknown or other
  misc_feature (161)..(161): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggccaatttttangctgactcacgccccactctgtggtcggggtctccggggaagaccggtaaccctctcctgccacccgnagcagtgcagcattcgaccaacactatgtgcagtggttncagcaggccggcccggctaccgttcccccaactacctgtcgatctagtggaggaataacacgaaacgtacccgtcgtcgggtcctagtacgttccggtttactcgtacggtccctacgactaccgtactaaccgtttcccctacctaaccttctccgtcccctccctacctaacctactcctcgtacgtaactacggtaacgacgtaggaacggtacgacggcctaacgtaaccttaccggtaacttcggtacttacgtttaccttagtagtaacctaggacctagtaccgttcggtttaggggttcggttacgggcggggtaacggacgaacggtccgttaggtacccgttaccggtacggtacgtaccggccgtaacggtccccg

SEQ ID NO: 187945 - DNA, 595 bp, Homo sapiens
  misc_feature: GYAE6OF02HDNRN.42.39.D06.1.454.CMB.1.raw
  modified_base (160)..(160): a, c, t, g, unknown or other
  misc_feature (160)..(160): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggcctaattttangctgactcacgccccactctggtgtcggggtctaccggggaagaccggtaccctctcctgccacccgcagctaggtgcagcagttcgaccaaacactatgtgcgtaggttcggttgcgagcacggccggcccgggactaaccgttcccccactacgtgtcgatctagtcggaagtaattaacgaccgaaacgtacccgttcgggttccgggtccctagtacgttccggtttctcgtcggtcctccgtataccgaccttcgttcccacctactctccgaccctcctacacctctctcgtcgactaggacacgnggacgacgcgntacgactcgtctcgtacgtgttactatcgatagacagtcgtcggtggttcgggtcgggaggcgacgtaacgcgtacggtacccgttaggaccgacgccgtacgaccgtcccg

SEQ ID NO: 187946 - DNA, 595 bp, Homo sapiens
  misc_feature: GYAE6OF02HHZK4.42.39.D06.1.454.CMB.1.raw
  modified_base (160)..(160): a, c, t, g, unknown or other
  misc_feature (160)..(160): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggcctaattttangctgactcacgccccatctgtgtcggggtctccggggaagaccggtaaccctctcctgccacccgcagcagtggcagctattcgaccaacactatgtgcgagtggttgcagcagccgccggcaccgtccccacactgagatctatgacgtataatacaacgacctcggtcgggtcctagtacgtcggttctcgtcgtctccatcgactacttcctactaactctccgccctccctacacctactctcgtacgacttacgaacgtcgtaggacggacgacgtcgtacgtaccttactcgtagttccgtattcgttacagtactacgacgagttacgtaccgttgggttccggtacgggtaccggacgggtaaccgacggtaccgtacgtacccggtacggttacggacccgtaaccggacccggtacggtccccgg

SEQ ID NO: 187947 - DNA, 579 bp, Homo sapiens
  misc_feature: GYAE6OF02FHTQH.42.39.D06.1.454.CMB.1.raw
  modified_base (197)..(197): a, c, t, g, unknown or other
  misc_feature (197)..(197): n is a, c, g, or t
  modified_base (399)..(399): a, c, t, g, unknown or other
  misc_feature (399)..(399): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggcctaattttatgctgactcagccccatctgtgtcgggtctcggggaanacggtaaccctctcctgccaccgcagcagtggcagcattcgaccaaacaactatgtgctagtggttgcagcaggccggcccgggcacgttcccccactactggtagactctatggaggtataactacaaacgtccctgtcggggtccctggacttcggttctcgtcggctcgatcgactcgttccacaactctcgccctccncacctatcctcgtgtactagaacgacgtggacggacgaggctacgtactactcgtacgtactagttacttagtagactacgctacgtcgttacggtttgggtcggttcgggacgggtaacggacccgtaagtcccgtacgtacccgttacgttaggacccgacgtacccggaagtccccg

SEQ ID NO: 187948 - DNA, 550 bp, Homo sapiens
  misc_feature: GYAE6OF02JNVQY.42.39.D06.1.454.CMB.1.raw
  modified_base (160)..(160): a, c, t, g, unknown or other
  misc_feature (160)..(160): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcactaggttcttgggccaattttangctgactcagccccatctgtgtcgggtctacgggagacgtacctctcngccaccncagcagtgcagcatnccaacactntgtncagtgtgcagcagccgccggtcaccgttcccccactactcgtancttctaagtggaagtactaactacgaaacgtccccgtcgtacgggtcccgtagtacgttcgtttacgtctacggntacccgntcgacttcgttccctaccacgtctccgccctccctacaccgtctctctgactagactacngacgagacgctagtactactactcgtacttgtattacgtntagtacgtacnctacgtaggttcggtggtcggacggtacgacctacgcgtcgaccgtcggttaacgctacgcgtacgtccg

SEQ ID NO: 187949 - DNA, 663 bp, Homo sapiens
  misc_feature: GYAE6OF02HKG5Z.42.39.D06.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcacaggttcttgggcctaattttatgctgactcacgcccactctgtgtcgggtctcgggagcgtacctctctgcnccnagcagtgcagcatcgaccaacaactatgtgcgtagttggtgcgacgcgacgccggccggccgtaccgtccccactacgtgtagtactctagtagaggtaataactaacaacgtccgtacggtcggtccgtagtacgtcgtctcgtcgtctacgtacgtacgactacgttacctacctacctccgtcctaccctccctacctacctacttccgttcgtacggtacgtaacgtaacgtacgtacggaacgggtacggtacggttactacgtaaccgttacgttacgttacgttacgttagttacttagtacgtactaacggtacgtaacggtacgttacgggttcggggttacggtacggggtaaccgggtaacggtaccggtaacggtccgttaacggttaccggttaccggtacggtacccggtaaccggtacccggtacgggtacccg

SEQ ID NO: 187950 - DNA, 688 bp, Homo sapiens
  misc_feature: GYAE6OF02G04N7.42.39.D06.1.454.CMB.1.raw
  modified_base (584)..(584): a, c, t, g, unknown or other
  misc_feature (584)..(584): n is a, c, g, or t
tcagtgacgtatgtcacgaccggtgctcgatttagtgacatctcgcagttctttgggggtagctcaggaagcagagcctggagcatctccactatggcctgggctccactacttctcaccctcctcgctcactgcacgaggttcgttgggacctaattttatgctgactcacgcccctactcgtgtggtcgggtcgtccgggaagtaccgtacctctccgtcgccacccgcacgcgtagtcgcagactattcgaccaaactatacgtgtagctaggtggtggacgagaccgacggccggtcccgggacctacccgttacccccactaccgtgtcgtacttcgtagtaggaacggtaagttaaactaccgtaaaaccgtacccgttcggttacccggggtcctaggtactttccggttacttcgtcggccttaccaacgtccgtaacgttaccgttcctacctaaccgttcgtcccgtaccctcccgtacctacctactccgtacgtagtaaccgaagtacgtaggacggtacggacgtcgagttaccacgttactacgtcgtagttacctagttgaatcgtacncgttaacgtcgttgggtcgtacgggtaccggaggtaacgtacccgtataaccgggtaccgttaccgtcgtacgacgaacccggacgacggtcccctaccccggg

SEQ ID NO: 187951 - DNA, 703 bp, Homo sapiens
  misc_feature: GYAE6OF02JTRXA.42.39.D06.1.454.CMB.1.raw
  modified_base (222)..(222): a, c, t, g, unknown or other
  misc_feature (222)..(222): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggcctaattttactgctgactcacgccccatctgtggtcggtcgtacgggataccggtacctctctgccaccgcngacaggtgcagcctagttcgacctaacgaactgtgtcgacgtagtggttcgcgacgcgcgccggcccggtaccacccggttaccccccactaccgttagtacgtacttcgtagtacggaaggtaactaacgtaacgtaaaccgacccgttcggtccggggttacctcggtacgttcgggtttcctacggtacgtccgtacctagtacggtactaccggtttcccaaccgttaaccttcccgtaccgtccctaccctacccgtaaccctacctactccgtacgtacgtacgtacgtacgtacgacgggactcgggggggggggtactacgactacgtacgttaccgtacgtacgttcttacgtgtaacgtcgtacgtccgtacgttacggttgggtacgggttcgggtcgggtacggtaaccgtaacgtaccgtaccgtccgttaccggtaccgtaccggtacgaccggtaccggtacccgg

SEQ ID NO: 187952 - DNA, 806 bp, Homo sapiens
  misc_feature: GYAE6OF02HMUFH.42.39.D06.1.454.CMB.1.raw
  modified_base (159)..(159): a, c, t, g, unknown or other
  misc_feature (159)..(159): n is a, c, g, or t
  modified_base (226)..(226): a, c, t, g, unknown or other
  misc_feature (226)..(226): n is a, c, g, or t
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggccaattttangctgactcacgccccatctgtcgtcggggtctccggggaagaccgtaacctctccgtgaccacccgnacgctaggtcggcagcctagttcgaccctaaacgaactatgttcgcgtaaggttcggttagacgtacgcgacgggcccggccccgggggtacctacccggttacccccccaccgtaccgttggtcgaacgttcttaacgtaggaacgggtaactaaacgtaaccgtaaaaaccggtccccttagggttcccgggggttaccctaggttaccgttccggggtttcctcgtccggtacctacgacgttaccggtacttaccgttcccgtacccaactttcccgtaccgtacccttcccctaaccgtacctacctccgtaccgtacgtaacgttacgaacgtacgtaggtaaccgggtaacggacggttacctacgtaacccgtacttacgtcggtaaccttacggttaacttacgtaacgttacgtagttaccgacgttaccgttaccgggtttcgggttacgggttacccggggaacggggaccgggtaaaccgtaacgggttacccgggttaagtacccccggtttaaccggtaccgggtaaccgggtaccccggaacccggtaacccggttaccccggg

SEQ ID NO: 187953 - DNA, 836 bp, Homo sapiens
  misc_feature: GYAE6OF02HDC7G.42.39.D06.1.454.CMB.1.raw
tcagtgacgtatgtcacgaccggtgctcgatttagtgacatctcgcagttctttggggtggtagctcaggaagcagagcctggagcatctccactatggcctgggctccactacttctcaccctctcgctcactgcacaggttcttgggcctaattttatgctgactcacgcccactctgtcggtcgggtcgtacggggaacgaccggtaacctctccgtcgaccacccgcagctaggtcgcagctagtcgaccaaacaactagtcgtcgacgtaggttggttcgcgtacgcgtacggccggcccgggctacccgttcccccaacgtcttcggtacgtactacgtacgtacggaaggtaactaacgtaacaaacccgtaccgttccgggtcgggttacccgtagttaaccgttccggtttcgtacgttcgggtaccttaccgtcgttaaccggtaaccgttccgtttaccccgtaacccttaacgtttcccgtaacccggtaccccttttccccgtaaccctaaccttaaccgttccggttaccggtacggtaaccgttacggaacgtacggttacggggaacggtaaccggtaggacgtaccgttaaccttaaccgtttacgtacggttaaccttacgtttaccgttaggtaacgtaacgtttacggaccgttaacgttaaccgggtttaccggggttacgggttaccgggggtttaccggggaccggggtaaaccgggtacccgtaagggtaccccgttaaccgggttaccccggtttaacgggaacggttaccccggtaaccgggtaaccccggtaccgggttaacccccggg

SEQ ID NO: 187954 - DNA, 790 bp, Homo sapiens
  misc_feature: GYAE6OF02JUNG2.42.39.D06.1.454.CMB.1.raw
  modified_base (235)..(235): a, c, t, g, unknown or other
  misc_feature (235)..(235): n is a, c, g, or t
  modified_base (724)..(724): a, c, t, g, unknown or other
  misc_feature (724)..(724): n is a, c, g, or t
tcagtgacgtatgtcacgaccggtgctcgatttagtgacatctcgcagttctttggggtggtagctcaggaagcagagcctggagcatctccactatggcctgggctccactacttctcaccctcctcgctcactgcactaggttcgttgggccctaattttatgctgtacctcacgcccccatcgtgtggtcggggtcgtccgggaagaccggtaaccctctcctgccacccgntacgcaggtggccagcagttacgacccaaacctaaattcgtgtaccgtgacggttggtcgcaggccaggcccggccccgggactacccggttaccccccacgtacgttgacgtaactcgtaagtcgggaacgtaattaaccgaaccgtaacgtacccccttgggtaccgggttccccaggttaccggtttccggtccttccggttcgacccttaaccggtccgtaacccgttaccgtaccgtttaacccgtacccctaaggtttccccttacgccccccgtttaaccctaccctaaccgtaaccttccctttaaccggaaacgttaaccggtaacgtaaacgtccggttaagggaaacccggtggaccgtaacgttaccgtaaaccgtttacccgttaagttccgtacgttaaaccgtttataacgtacgtaacggaccgtacgtacggtacgttaccgggttggttccgggtacgggaaccgggtaanaacccggtgtacgtaccgggtacgtacggttaaccggtccaacccgggttacggacccgtcccggg

SEQ ID NO: 187955 - DNA, 562 bp, Homo sapiens
  misc_feature: GYAE6OF01CU1KZ.39.60.F05.1.454.CMB.1.raw
  modified_base (228)..(228): a, c, t, g, unknown or other
  misc_feature (228)..(228): n is a, c, g, or t
  modified_base (380)..(380): a, c, t, g, unknown or other
  misc_feature (380)..(380): n is a, c, g, or t
  modified_base (479)..(479): a, c, t, g, unknown or other
  misc_feature (479)..(479): n is a, c, g, or t
tcagtcgcactagtcacgaccggtgctcgatttagtacgtcatcagggaaaggggcgtgggcctaaggaagcagcactggtggtgccgtcagccatggccctggaccgttctcctcctccggacctcctctctcactgcacaggctctgtgacctcctatgtcttgactcagccaccctcggtgtcagtggcccccaggacagacgccaggattacctgtggggaacntaagttggaagtaatagtgtgcactggtaccagcagaagtcaggcccagggccccctgtgctggtcgtctatcgatgatagccgaccggccctcgaggggactccccgtgagccgaagttctccttcggctcccaaacgtcgtggggaaccnccgggccacccgtgaacccatcagcgagggtcgaaggtcgggatggacggccgactattactgtcaggtgtgcgtatgagaatgtagatcgtaggtttntgttcgttacggacgtgggacctaaggtccaccggtcgtaggtcacggcccaaggccccaacccactgacactctcgtccccc

SEQ ID NO: 187956 - DNA, 530 bp, Homo sapiens
  misc_feature: GYAE6OF01BWAOK.39.60.F05.1.454.CMB.1.raw
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggcctcgagggactccctgagcgattctctggctccaactctggaacacggccaccctgaccatcagcgagggtcgaagtcgggatggaggccgactattactgtcaggtgtgcgatgagaatgtgagtcaggtttatgtcttacggactgggaccaggtccaccgtcgtaggtccagcccaaggcccaaccccgacgtcgtacacttctccgtcccctacccc

SEQ ID NO: 187957 - DNA, 626 bp, Homo sapiens
  misc_feature: GYAE6OF01D12W9.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagcccaccctcggtgtcagtggccccaggacagacggccaggattaccgtgtagggggaaacataattggaagtaatagtgtgcactggtaccagcagaaagtcaggccaggcccctgtgctggtcgtctatgatgataggcgacccggccctcgagggactccccgtgacgcgattcctcgtggcctccaaactccgtagggaaccaccggcccaccctgaccatcagcgaggggtacgaaggtcggggatggaacgggcccgtaacgttagttactggtacgtagggttgtggacgtagtaggaagtaagttaggtgaagttacgtaagggttttattggttacgtttacgggaacgtgggaacctaacgggtccacccgttaccgtacggtaccacggaccccgaaacgggaccccaaaccccgtctacgtacctaccgtccgttccggttacccccg

SEQ ID NO: 187958 - DNA, 614 bp, Homo sapiens
  misc_feature: GYAE6OF01C2XLR.39.60.F05.1.454.CMB.1.raw
  modified_base (382)..(382): a, c, t, g, unknown or other
  misc_feature (382)..(382): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagcccaccctcggtgtcagtcggccccaggacagacggccaggacttaccgtggtaggggggaaaacagtaaagttagggaaagtaaatagtagtgcacgtggtaccagcagaagtcaggccaggcccctggtgctggtcgtctatgatgataggccgacccggcctcgagggactcccgtgagcgtattctcgtggcctccaactcgtagggaacnccggccaccctgaccatcacgcgagggtacgaaggtcgggaagtggacggaccgtaacgttaattacgtcgtcgaggttgtcgacgtagtagaagaataggtagatacgtaggtttatgttcgttaacggacgtacgggaacctaacgggtccaccgttccgtacgtacgaccggcccgaaccggaccccaacccctacgtccgtaccaccgttccgttccggttccccccg

SEQ ID NO: 187959 - DNA, 637 bp, Homo sapiens
  misc_feature: GYAE6OF01CW765.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggattaccgtgtagggggaaacataattggaagtaatagtgtgcactggtaccagcagaagtcaggccacggccctgtgctggtcgtctatgatgatagcgaccggcactcgagggactcccgtagacgcgtattctacgtcggcctaccaacgtcgtacgggaaccaccggacccacccgtgaacccgatccgacggcgaacggggtacgaacgggtcgggggaatgggaacggtccgtaacttaacgttacgtggtacgtagggtgtacggacgtagtagaagaagtagtacgtagtacgtaggtttactggttacgttacgggaacgttcgggaaccgtacggtaccgtaccgtaccgtacggtaccacggaaccccgaacgggaccctaaaccccgtacgtaccgtacctaccgttccgttaccccgg

SEQ ID NO: 187960 - DNA, 532 bp, Homo sapiens
  misc_feature: GYAE6OF01B48GU.39.60.F05.1.454.CMB.1.raw
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (519)..(519): a, c, t, g, unknown or other
  misc_feature (519)..(519): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctcgagggatccctgacgcgattctcgtggctccaaactcgtgggaaccaccggccaccctgacccatcgagcgagggtcgaaggtcggggatggaggccgactattacngtcaggtgngcgatganaatagtgatctaggtttatgttcttacggaactgggaaccaggtcaccgtctaggtcacgcccaaggcccaaccctctcacnctcgtcgtccccg

SEQ ID NO: 187961 - DNA, 672 bp, Homo sapiens
  misc_feature: GYAE6OF01D5BLF.39.60.F05.1.454.CMB.1.raw
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagccaccctcggtgtcagtggccccaggacagacggccaggattacctggtaggggaaacataagttggaaagtaatagtgtgcacgtggtaccagcaagaagtcgaggcccacggcccctgtcgcgtggtcgtctatgatgatcggccgacccggccctacgagggtctcccgtgagcgtattcgtcgtggcctacctaacgtcgtacgggaacaccggcccacccgtgacccatcgagcgagggtacgaaggtcggggatcgggacggtccgtaacttagttacgtggtacgtagggttgtgacgtagtacggaagtaagttaggtagtaattaccggttaaggttttacgtcggttacgtttacggaacggtcggggtaaaccgacggttacccgaacccggttcgttacggtaccgacggaccccgtaaaccggaaccccctaacccccgtaccgttccgttacctacccgtttacccgttcccggttaccccccgtcccccg

SEQ ID NO: 187962 - DNA, 672 bp, Homo sapiens
  misc_feature: GYAE6OF01EM370.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggattacctggtagggggaaacataagttggaagtaatagtgtgcactggtaccagcagaagtcaggccacggcccctgtcgcgtggtcgtctatgatgagtacgccgacccggccctcgacgggactcccgtagacgtcgattccgtcgtcggcctaccgaacgtcgtacgggaaccaccggacccaccctcgacccatcgagcgagggtacgaagggtcggggatggacggtccgaacttagttacgtggtacgagggttgtcgacgtagtaggaagtaagtagtagtattacggtaaggttttactggtttacgttacgggaacggttacggggaaccctaagggtcccgtaacccggttccgtaacgggttacccgaaccggtaccccgaaacccgggtacccccaaacccccggtacgttacccgttaacctacccgtttcccgttcccgttaacccccccg

SEQ ID NO: 187963 - DNA, 538 bp, Homo sapiens
  misc_feature: GYAE6OF01ELBC4.39.60.F05.1.454.CMB.1.raw
  modified_base (462)..(462): a, c, t, g, unknown or other
  misc_feature (462)..(462): n is a, c, g, or t
  modified_base (497)..(497): a, c, t, g, unknown or other
  misc_feature (497)..(497): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctcgagggactccctgacgcgattctcgtggcctaccaactcgtaggggaaaccacgggcccaccctgaacccatcagcaggggtcgaaggtcgggatggacggccgaatactactgtcaggtgtgcgatgagatagtgatcgtaggtttangttctaggactgggacaggtccaccgtcgtaggtnacggtcccaggcccaaccctctacgaccactcgtcgtcccc

SEQ ID NO: 187964 - DNA, 834 bp, Homo sapiens
  misc_feature: GYAE6OF01ER2CL.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattaccgtggtagggggaaacataagttggaaagtaataggtgtgctactggtaaccaacagaagtcaggccaggcccctgtgctggtcgtctatgatgataggccgaccggtccctagacgggtactcccgtggacgcgtacttccgtcgtcggtaccttaccgaaaccgtcggttaacggggaaaccctacccgggtacccccaaccccgttacggaaacccctaaacgttacccggaacgggtaccggtaacggggggttaccgggtaaaacggggttccggggggtaaacgttacggggaaccggggtacccgttaacgtttaaacgtttaaccggtagggttaacccggtaagggtttcgggtacgtaccgggtaagttacgggtaaaggtaagttaagggttacgttaacgttaacggttaacggttttacgttacggttttaccggttaaccggggtaaaccggtaccggggtaaacccgtaaaccgggttcccgtaaacccggttacccggttaaacggtaccgaaacccggtaaccccggaaccggaacccccgtaaacccccgtaccgttccggtaacccttacccggtttccgtttccccggtcccccgtacccccg

SEQ ID NO: 187965 - DNA, 716 bp, Homo sapiens
  misc_feature: GYAE6OF01CW4FZ.39.60.F05.1.454.CMB.1.raw
  modified_base (245)..(245): a, c, t, g, unknown or other
  misc_feature (245)..(245): n is a, c, g, or t
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagccaccctcggtgtcagtggccccaggacagacggccaggattacctggtaggggaaacataattggaagtaatagtgngcactggtaccagcaagaagtcaggccaaggcccctagtgactggtctctatgatgatagcgacccggcctcgagggactccctggacgtcgaagttcctcgtacggtctacccgtaaactcggtacggggaaccacccgggaccctaccccgttggaacccactcgaacggtacgaacggggtacgtaaggtacggggacgtaggacgggaccgtaacgtttagttaccgtggtaccgtaagggtcgtggaccgtaagtggaaagtaagttacggtagtaagttaccggttaaggttttacgtggttaccgttacgggtaaccggttcggggaaacccgttaaagggttcccgaaacccgggttaccgttacgggaaccgtaaccgggaacccccgaaaggtaccccccaaacccggtacttaccggttacccgaaccctttccggtacccggttcccccgttacccccg

SEQ ID NO: 187966 - DNA, 590 bp, Homo sapiens
  misc_feature: GYAE6OF01A3G0Y.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtagggggaaacataattggaagtaatagtgtgcactggtaccagcagaagtcaggccaggcccctgtgctggtcgtctatgatgatagcgaccggccctcgagggatcccgtgagcgattcctcgtggctaccaactcgtagggaacacggccacccgtgaccatcagcgagggtcgaaggtcgggatggacggccgactattacgtgtcgaggtgttacgagtgaagtaatagtgtatcgtaaggtttatggttacttacgggaacgtgggaacctaagggtccaccggttccgtaaggtccaacggaccccgaaacgggaccccaaaccccgacgttccgtacctaaccgttccgttccgttcccccgtacccc

SEQ ID NO: 187967 - DNA, 692 bp, Homo sapiens
  misc_feature: GYAE6OF01BW71L.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggattacctggtagggggaaacataagttggaagtaatagtgtgcacgtggtaccagcaagaagtcaggccaggcccctgtgcgtggtcgtctatgatgatgccgaccgccctgacgggactcccgtgacgcgtattctcgtggctaccaacgtcgtgggaaccacggcccaacccgtgaaccctagtccgacgcgtaacggggtaccggaagggttccggggagtgggaacgggtcccgaactttaacgttaacgttggtacgagggttcgtacggcgtaagtaggaacgtaaagttacggtagtaacttacggtaagggtttttacgtcggtttaccgtttaccgggaacggttacggggaaacccgtaagggttacccgtaaccccggttcgtaaccgggtacccgaacggtaacccccgaaacgggacccccaaaccccgtccgtacgttaccccaaccgttcccgttcccggttcccccccg

SEQ ID NO: 187968 - DNA, 683 bp, Homo sapiens
  misc_feature: GYAE6OF01BJ6OY.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcacgtggtaccagcagaagtcaggccgaggcccctgtgctggtcgtctatgatgataggccggacccggccctcgaggggactccccgtggacgcgtattctcgtggcctaccaactcgtagggaaccaccggcccaccctcgacccatcgagacgaggggtacgaacgggtcggggatcgggacggacccgtaacgttacttacgtggtacgtagggttcggtggacgtagtagggtaacgtaaagttacggtagaacttacggtaagggttttatcggtttacgttaccgggtaacggttacggggtaacccgtaaacgggttcccgaacccggttaccgtaacgggttaccgaacccggaccccgaaccggtaacccccgtaaacccccgtacggttaccgtaccctaccgttcccgttcccgggttaccccccg

SEQ ID NO: 187969 - DNA, 653 bp, Homo sapiens
  misc_feature: GYAE6OF01C9P24.39.60.F05.1.454.CMB.1.raw
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcacgccaccctcggtgtcaggtcggccccaggacagacggccaggattaccgtggtagggggaaacataagttaggaagtaatagtgtcgacacgtggtaccagcgagaagtcgacggccacggtcccctgtcgcgtggtctctagtgatgatacgccgaccggcctggacggctccgagacgacgtacttcncgtcggtcctaccaacgtcgacggaccaccgcctacccngaccatcgacgnggacgggtacggacggtcgggatacggacggtacctaagttacttacgtcggtagacgggtcgtagacgtagtaagacgtaagtaggtaacgtagttacggttagtttacgttacggttcgttaaccgggacggtaccgggtaaccggtacgtacccggtaccgtcgttacggacctaacccggacccgaaccgtaccccgtaaccgtaccgtacgtactaccctttccgtcccgttaacccccg

SEQ ID NO: 187970 - DNA, 700 bp, Homo sapiens
  misc_feature: GYAE6OF01BD4WY.39.60.F05.1.454.CMB.1.raw
  modified_base (379)..(379): a, c, t, g, unknown or other
  misc_feature (379)..(379): n is a, c, g, or t
  modified_base (465)..(465): a, c, t, g, unknown or other
  misc_feature (465)..(465): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagcccaccctcggtgtcagtcggccccaggacagacggccaggattaccgtggtggggaaacataattggaataatagtgtgcacgtggtaccagcagaagtcaggccaggcccctgtcgcgtggtcgtctagtgatgatacgccggaccggccctcgacgggactcccgtaggacgcgtattctcgtcggcctcctaacgtcgacgggaaccnccggcccaccctgaccatcgagcgagggtacgaagggtcgggaactggacggtacccgtaatacgttacgtgtacgaggtgtacgngtacgtaggtaagtaacgttaggtgtaacgttacggttaagggtttttaagtcgggtttaaccggtttaccggggtaaacggtaccggggtaaaccgttaaaccgggttcccgtaacccgggttacccggttaacgggtacccgaaacccggtaccccggaaacccgggacccccctaaaacccccgtcgttacccgtacccgtaacccgttccgtttacccccgttaccccccg

SEQ ID NO: 187971 - DNA, 649 bp, Homo sapiens
  misc_feature: GYAE6OF01DWCAU.39.60.F05.1.454.CMB.1.raw
  modified_base (382)..(382): a, c, t, g, unknown or other
  misc_feature (382)..(382): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggacttaccgtggtagggggaaacaattaagttaggaagttaataggtgtgacactggtaccagcagaagtcgaggccacggcccctgtcgctggtcgtctatgatgatacgccggaccgccctcgagggactcccgtgacgcgtattctcgtcgcctccaactcgtacgggaaccnccggacccacctcgacccatccagacggagggtacgaaggtcgggataggacgggccctaatagttacgtgtacgtaggttcgtgacgtagtaggaagtaagtcgtagtaacgttacgttaggttttacgtacggttaccgttaacggacggttacgggaaccgtaacgggtccctaaccggttccggtaaggtcccgaacccggcccaaaccgggacccccaaccccgtacgtacctacccgtccttcccgtacccgttacccccc

SEQ ID NO: 187972 - DNA, 672 bp, Homo sapiens
  misc_feature: GYAE6OF01BWZXT.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagcccaccctcggtgtcagtcggccccaggacagacggccaggacttaccgtggtagggggaaaccattaagttaggaaagtaataggtgtgcacgtggtaaccagcaagaacgtcgacggccacggcccctgtcgcgtggtcgtctatgagtgatacggccggaccggcacgtcgagggtactcccgtagacgcgtacttcgcgtcgtcctacccgaactcgtacgggaaccaccggacccacccgtcgacctactacgacgcggacgggtacggaaggtacggggatacgggacgtacgtacgttaagttaccgtgtacggtaggttcgtacggacgtagtaggaacgtaagtaggtagtagttacgttaggtttagtcggttacgttacggaacggttcgggaaccgtacggtacccgtacccggttcgtaacggtccgaacccggtaccccgaaccggaccccgtaacccgacgttaccgtacctaccgttccgttcccccgg

SEQ ID NO: 187973 - DNA, 541 bp, Homo sapiens
  misc_feature: GYAE6OF01B0O2Q.39.60.F05.1.454.CMB.1.raw
  modified_base (363)..(363): a, c, t, g, unknown or other
  misc_feature (363)..(363): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtagggggaaacataattggaagtaatagtgtgcactggtaccagcagaagtcaggccaggcccctgtgctggtcgtctatgatgatagcgaccggcctcgagggtttcaatcgcttctctggctccaagtctggcaacgacgccctccngaccatctcgtggctccgaggctgacgggacgaggctgtattagttactgctagctctatttcgcaatcaagtgaggtcttatcgttcgttacgggaggttcggaacctaaggtcacgtccgtccgtaggtcacgacccaaacggccccaacccctacagtccctacgtcgttccccg

SEQ ID NO: 187974 - DNA, 781 bp, Homo sapiens
  misc_feature: GYAE6OF01B7QS2.39.60.F05.1.454.CMB.1.raw
  modified_base (177)..(177): a, c, t, g, unknown or other
  misc_feature (177)..(177): n is a, c, g, or t
  modified_base (450)..(450): a, c, t, g, unknown or other
  misc_feature (450)..(450): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctctatgtcttgactcacgccacctggtntcgagtcggcccaggaccagacgtcaggtacttaccgtggtaggggaaactagtaagtaggaagttaagtagttgtggaccaacgttggtaacccgagtacgtaagaaacggttccgacgggaccgtaaccgggtccccttaggtcgaccggttggtccgtactagtgtaatgtaacgtacgacccggtacccggtccgtacggaggtaccgtccgtaggtacgacgttacttcgtcggtcggacctacgtaaccgtcggtaccgggaaaccncccgggtacctaccggacaaaccgtacgtacggacggtacggaacggggtcggtaaaccgggttaggacggacggtaccggtacgtaaacgtttacgtaaccggtgtacggtaacggttgaggtaccgttagaaggtaacgttaaaggttagtacgtaacggtttgtttaaaggggtttcttaccggtttacggtaacggtaacggttaaccgggaaccgttaacgggtcccctaaacggtttccgacggtaaccgaccggtaaccccaacccgggtaacccctaccggttacccgtacgtaacgtacccttccggttaccccttccccgg

SEQ ID NO: 187975 - DNA, 672 bp, Homo sapiens
  misc_feature: GYAE6OF01C7PEZ.39.60.F05.1.454.CMB.1.raw
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcacgccacctcggtgtcagtcggcccaggacaggacggccaggacttaccgtggtaggggaaacataagttggaaagtaatagtgtgcacgtggaccagcagaagtcaggccacggcccctggtgcgtggtcgtctatggtatgatacggccgacccggcctacgagggcctcccgtgacgtccgtacttccttcgacggtcctaccgtaaaccgttcggtaacgggaaaccctccgggacccacccgtacgaccgtaactcggaagcggtacgggtacgaacggggtcggacgtgggacgaccgtaacttagttacgtcgtcgtagggtgtggacgtagtaggaagtaatagtgtacgttacgttagggtttaacttggttacgttacgggtaacggtcgggaacgtaggttctacggttccgtaccgtacggttcaaccggtaacccgaccggtaaccccgaccccgttagtaccctacctaccgttccgttcccggttacccccg

SEQ ID NO: 187976 - DNA, 951 bp, Homo sapiens
  misc_feature: GYAE6OF01B5KLX.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagcccacccgtcggtgtcagtcggccccaggacaggaccggccaagggtacttaccgtgggtacggggggaaaactagtaaagttacgggaaagttaaagtaggttgtcgccgtaacgtcggtaaccgaggacgtaacggaaacggttcgaacgggtacccgaaccggggtacccccgttggtacggtaccgttcggggttaccggttaccttaagttcggtaagtttacgggtaaaccgttaacgggcccccggggtaacccccggggtaccccttaaccggggtaacgggtacccgttacccccggtagggtaccggaccggtttaaccttttccgtaccgttcgggttacccttaccgtaacccggttaccgggtaaccggggtaaacccgtacccggaccccttaacccggacccgtaaacccgtactacggaaaccggtaccgggtaagggggttaaccgaagggggttacccggggaagtacggggaacccgggttaacccgtaacctttacggttaccggttagtaccggtaagggttcgtaggtacgtaaggtaaggtaaacgtaagttaacggtcggttaaagttccgggttaagggtttttacggtacggttttacggttacggggttaacggaacggggtaacctaaacgggttcctaacgggtttaccgttaaccggttaccgggaccgtaacccgggtacccccgaaaacccggtacccccgaaaacccgttaccgtaccggttacccggtaacccttccggttacccccggg

SEQ ID NO: 187977 - DNA, 675 bp, Homo sapiens
  misc_feature: GYAE6OF01DZ5EO.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcaggtcggccccaggacagacggccaggattacctggtagggggaaacataattggaaagtaatagtgtgcacgtggtaccagcagaagtcaggccacggcccctgtcgctggtcgtctatgatgatcgcgaccggccctcgagggtactccccgtagacgcgtattcctcgtcggccttccgaactcgtacgggaaccaccggcccaacccgtcgaacctataccgacggacgtaggggtacggtaaacgggtccggggtaagtcgggaacgggtcccgtaacgttaacgtttaccgtcggtacgtagggttcgtcggacgtagtaggaagtaacgtagtaggtattacggttaagggttttactggtttacggttaccgggaacgttcgggaaacccgtaacggttccgaaccgttccgtagggtacccacggacccaaaccgggaccccaaccccgtcgtacgtacctaccgttccgtaccggttccccccg

SEQ ID NO: 187978 - DNA, 760 bp, Homo sapiens
  misc_feature: GYAE6OF01DLL45.39.60.F05.1.454.CMB.1.raw
  modified_base (382)..(382): a, c, t, g, unknown or other
  misc_feature (382)..(382): n is a, c, g, or t
  modified_base (500)..(500): a, c, t, g, unknown or other
  misc_feature (500)..(500): n is a, c, g, or t
tcagtcgcactagtcacgaccggtgctcgatttagtacgtcatcagggaaagggctgggcctaaggaagcagcactggtggtgcctcagccatggcctggaccgttctcctcctcggcctcctctctcactgcacaggctctgtgacctctatgtcttgctcacgccacccgtggtgtcaggtccggcccaggacacggaccggcgaggacttaccgtggtaacgggggaaactagttaagttagggtaaagttaaagtaggtagtcgacctacgttggaccgagcaaggtaacgtcgacgccgaacggtccctggtcgtacgtcggtcgttcgtatggattggactacgccggacccggtccgtacgacgggccttcccgnggacgtacgtacttcgtcgtcggtaccttacgaaccgtggtaccgggaaccgacccggcctaaccggtacgtaaccgtgtaccgacggaccggtaagggtacgaacgggttacggggngtaacgggacgggtaccctaaacgtttacgttcgtacggttacggaggttacggcgtacgtaaggtacgaagttaacgtagtacgtagttacgttacggtttagacggttttaccggtaacggttaaccgggacggtaaacccgttacggtaacccgtttacccgggtacggtaacgttacccgaacccgtaacccggaacggtaaaccccctacccgacgtttaccggtacctcccgtttcccggttacccgtcccccc

SEQ ID NO: 187979 - DNA, 805 bp, Homo sapiens
  misc_feature: GYAE6OF01C622U.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggccctcctctctcactgcacgacggctctgtcgaccttcctatgtcttgactcacgcccacccgtggtgtcgaggtccggacccccgaggaccaggaccggaccgaggtacttaccgtaggtacgggggaaactagttaagttaggaaagtaagtaggtggtacgacgacgtagtaccgagacgagaagtcgaggcccgacggccccgtagtcgcgttggtcgtacgtagtgacgtgaacgtacggccgacccggccctacggacgggtactcccgtgtacgaccgtacttcgtacgtcgtaccgtacctaacgtcgtagaacgtaacccggaccggtaccccacccgtacgaacccgacgttaccgaccggtacgggtaaccgggttaacgggaaccgggttacgggggtagtaccggggtaaacccgggtcccgtttaaacgttaaccgtttaccggttacggttaccgggtaacggggtttggtacccgggacgttaagttacgggtaaaggtaagttagggtacgttaacggttaggtttaggtttaacgttcgggtttaccgtaccgggtaacggtacgggtaaaccgtaccggtaccgtaccggttaccggtagtaccgggtaaccgaaccccggaccgacccctaaaccccgtcgtagtccctacccgttcgttacccccg

SEQ ID NO: 187980 - DNA, 743 bp, Homo sapiens
  misc_feature: GYAE6OF01EQ9AB.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcacgcccacccgtcggtgtcagtcggccccaggacagacggccaggtacttaccgtggtaggggaaacagtaagttaggaagtaagtagtgtgcacgtggtaccagacagaacgtcaggccacggcccgtgtcgcgtggtcgtctatgatgagtacggccgacccggcctcggacgggtctccgtagacgcgtattccgtcgtcggtcctaccgtaacgtccggtaacgggaacccgaccgggcccctaacccgtacggaaccctacgtaccgacggacggtacggggtacggaacgggtacgggggaacgtacgggaccgggtaccgtaacgtttacgttacgtacggtacggtagggttcggtcggacggtagtaggtaacgtaagttacggtagtaacgttacggtttaagggtttagttacggtttacggttaacgggtacggttaaccgggaaaccgtaaccgggttacccgtacccggttaccggtaacggtacccgaaccggaaccccgaacccggacccctaaaccccgtaccgtaccgtacctacccgttcccgtcccgttaaccccccg

SEQ ID NO: 187981 - DNA, 835 bp, Homo sapiens
  misc_feature: GYAE6OF01AGN55.39.60.F05.1.454.CMB.1.raw
  modified_base (371)..(371): a, c, t, g, unknown or other
  misc_feature (371)..(371): n is a, c, g, or t
tcagtcgcactagtcacgaccggtgctcgatttagtacgtcatcagggaaaggggctgggcctaaggaagcagcactggtggtgcctcagccatggcctggaccgttctccctccgtccggcctcctctctcactgcacaggctcgtgtgacctcctatgtctgactcacgccaccctcggtgtcaggtcggcccaggacaggacggccgaggtacttaccgtggtagggggaaaacagttaagttagggaagttaagtaggttcggtacgtacctaccgttagggtaacccaggtaccgaaaggtaacggtccgacgggacccgtaaccggcccccgttggacgtcggttacgggttccgacgtttaagnggtaacgttggaacgtaccggacccgggtaccccggacccttagggaaccgggtactaccccggttaggaccgaccgttaacttcgtcggtccggacctaccaaacgtccggtaacgggaacgacccggtacccaccccgtacaaccacgtacgaacggtacgggtaacggggtccgggtaacgggtaccggggtacgttaacggggcccggtaaacccccggttagttaaccggtttacgtttacgggtaccggttaggttaccgggcggtaggtaacggtaggtaaggttaacgtacgggtaagttaacttaggttacgggtttatccggtttacggttacggtacggtaccgggaacgttacggtcgtaacccggtacgtaccggtactaacccggccccgttaaaccgacccccttaaccgttaccaccgtacccttccgttcgtccccccgttaccccg

SEQ ID NO: 187982 - DNA, 675 bp, Homo sapiens
  misc_feature: GYAE6OF01CHFH3.39.60.F05.1.454.CMB.1.raw
  modified_base (147)..(147): a, c, t, g, unknown or other
  misc_feature (147)..(147): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
tcagtcgcactagtcacgaccggtgctcgatttagtacgtcatcagggaaagggggctgggcctaaggaagcagcactggtggtgcctcagccatggcctggaccgttctcctcctcggcctcctctctcactgcacaggctctgtnacctctatgtcttgactcagccaccctcggtgtcagtcggcccaggacagcgcagatctgngggaanatatgaatatagtgtncacgtgacagcagaagtcagcaggccctgtgctggtcgtactagtgatgactacggccgacccggcctacgaggactcccgtagacggctattctcgtgactaccaacgtcgacggggaactaccggaccctaacccgtcgaccctaacgtccaacggtaccgggtaacgggggtaccggtaaacggggtccgggggtaatacggggtaaaccgggaacccggtaacgtttaaacgtttacgttcggtaccggtaagggtcgttacggaaccggtataacgggtaacgtaaagttaaggtgaacgttacgttagggtttagtgttaccgtacgggtaacctagggtaaccgtacggtcctaacccggtcgtacggtacgaccggtacccgaaacggtacccccaaccctacgtaccgtaccaacccgttcttacccgttcccccc

SEQ ID NO: 187983 - DNA, 212 bp, Homo sapiens
  misc_feature: GYAE6OF02IG224.39.60.F05.1.454.CMB.1.raw
  modified_base (210)..(212): a, c, t, g, unknown or other
  misc_feature (210)..(212): n is a, c, g, or t
tcagtcgcactagtcacgaccggtgctcgatttagtacgtcatcagggaaagggaccacggtcaccgtctccttagcttccaccaagggcccatccgtcttcccctggcgccctgctccaggagcacctccgagagcacagccgccctgggctgcctggtcaaggactacttccactagtgcgactgagcgggctggcaaggcgcatagnnn

SEQ ID NO: 187984 - DNA, 531 bp, Homo sapiens
  misc_feature: GYAE6OF02IRLK6.39.60.F05.1.454.CMB.1.raw
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctcagggactccctgagcgattctctggcctccaactcgtagggaacacggccaccctgaccatcagcagggtcgaaggtcggggatggaggccgatattactgtcaggtgtgcgatgagaatagtnatntaggtttatgtcttcggaactgggacctaggtcacgtccgtaggtcacgtcccaaggacccaacccgactcgtacactccgtcgttacccc

SEQ ID NO: 187985 - DNA, 570 bp, Homo sapiens
  misc_feature: GYAE6OF02IL66N.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctggtaggggaaacataagttggaaagtaatagtgtgcagtggtaccagcagaagtcaggccaggcccctgtgctggtcgtctatgatgataggcgaccggcctcgagggactccctgagcgtattctcgtggctaccaactcgtagggaacaccggccaccctgaccctatcgagcgagggtacgaaggtcggggatggacggccgatagttactgtcgaggtgtgcgagtgagaatgtagatcgtaggtttatgttcgttacggaacgtcgggacctaaggtcctaccggtcgtacggtccacggaccccgaaggaccccaaccccgtactccgtaccaccttcgtccgttcccccg

SEQ ID NO: 187986 - DNA, 525 bp, Homo sapiens
  misc_feature: GYAE6OF02HGB9O.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctcagggatccctgagcgattctctggctccaactctgggaacacggccaccctgaccatcagcgagggtcgaaggtcggggatggaggccgatattactgtcaggtgtgcgatgagaatagtgatcgtaggtttatgttcttacggaactgggaccaaggtcaccgtccgtaggtcacgacccaatcgacccaacccatcgacctactcctccg

SEQ ID NO: 187987 - DNA, 568 bp, Homo sapiens
  misc_feature: GYAE6OF02G8Z1A.39.60.F05.1.454.CMB.1.raw
tcagtcgcactagtcacgaccggtgctcgatttagtacgtcatcagggaaagggcgtgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggattacctgtgggggaaacataattggaagtaatagtgtgcactggtaccagcagaagtcaggccaggcccctgtgctggtcgtctatgatgatagccgaccggcctcgagggactcccgtgagcgtattcctcgtggcctccaactcgtaggggaacacggccaccctgaccatcagcgagggtcgaaggtcgggatggacggccgatattacgtgtacaggttgtcgcgagtgagaatagtgatcgtaggtttatggttaccttacgggaactcgggtaaccaagggtccaaccggtccgtaaggtccacggtaccccaacggcccaaccccgcttacgtaccaccttctcgttaccccc

SEQ ID NO: 187988 - DNA, 520 bp, Homo sapiens
  misc_feature: GYAE6OF02GNBRN.39.60.F05.1.454.CMB.1.raw
  modified_base (411)..(411): a, c, t, g, unknown or other
  misc_feature (411)..(411): n is a, c, g, or t
  modified_base (447)..(447): a, c, t, g, unknown or other
  misc_feature (447)..(447): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctcagggatccctgagcgattctctggctccaactctgggaacacggccaccctgaccatcagcagggtcgaaagtcggggatggaggccgactattacgngtcaggtgtgcgatgagaatagtgatcgaggtttangttcttcgaatgggaccaaggtcacgtctaggcacggcccaaggcccaacccgctcgacactctcgttacccc

SEQ ID NO: 187989 - DNA, 827 bp, Homo sapiens
  misc_feature: GYAE6OF02JZ8NU.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacaggacggccaggattaccgtggtaggggaaacataattggaagtaatagtgtgcacgtggtaccagcagaagtcaggccaggcccctgtgctggtcgtctatgatgatagccggaccggccctcgaggggactcccgtaggacgtcggtacttccgtcgtcggcctacccgaacttccggtacggggaaacccaccggggtaccctaccccgttaggaacccctaagtacccgacgggtacccggtaagggggttacccgggtaaaacggggtcccggggggtaagttaccggggaaccggggtaccccggttaaaccgtttaacggtttaaacccgtgggttacccggtaaaggggttcggttacgggtaaccggttaaggttacgggaaaggttaaacgtttaagggttacggttaacgtttaccggtttaaacggggtttttagtaccggttttaccgggtttaaacgggaaacccgggttaacgggggaaacccgtaacggggttacccgaacccggtttacccgggttaacgggacccgaaccggtaccccgaaaccggtaccccgtaaacccccgtacgttaccggttaacccacccgtttaccgttccccgtttacccccccgg

SEQ ID NO: 187990 - DNA, 589 bp, Homo sapiens
  misc_feature: GYAE6OF02JY78C.39.60.F05.1.454.CMB.1.raw
  modified_base (290)..(290): a, c, t, g, unknown or other
  misc_feature (290)..(290): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
tcagtcgcactagtcacgaccggtgctcgatttagtacgtcatcaggaaaggggcgtgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtntatgatgatagcgaccggcactcgagggatccctgagcgattcncgtggctccaatcgtagggaaccncggcccaccctggaaccctatccagccgagggtacgaagggtcggggaatcggacggccgtacgttacgttacgtagtcgtaggttgtaggcgagtgaacgtaagtagtcgatcgtaggtttatggttcgtaggaacggtagggaaccgtaggtcgtaacgtcggttaccgtaggtaccgacggacccgtaacggaccccaaaccccgtacgttcggtacctaacttcccg

SEQ ID NO: 187991 - DNA, 774 bp, Homo sapiens
  misc_feature: GYAE6OF02HZHP5.39.60.F05.1.454.CMB.1.raw
  modified_base (452)..(452): a, c, t, g, unknown or other
  misc_feature (452)..(452): n is a, c, g, or t
tcagtcgcactagtcacgaccggtgctcgatttagtacgtcatcagggaaagggggcgtgggcctaacggaagcagcgactggtggtgtcctcaggccatcggcctggaccgttctcctcctcggcctcctctctcactgtcacaggctcgtggttcgtaccttcctatgttacgttgactcagccacccgtcggtgtcaggtcggccccgaggaccaggacgggccgaggtacttaaccgtggtagggggaaacctaggttaacgttgggaaagtaattacgtgtgcacgtcggtaccagtcgtagaacgtcaggccacggtcccctagtacgcgtggtccggtacgtacgtcgagtcgacgtaggccgggacccggtccgtcgagggtctcccgttagtacggcggtagtttctacgtacgtcctaccgaacgttcgtacgggaaacccnccgggtaccctacccgtcgaaccctactaccgacggccgtaacggggtacggaaacgggtccggggtaactacgggaacggacccgtaacgttaacgttacgttcggttacgtaaggttacgtacggacgtaacgttaggaaggaagtacgggtagaagttacgtagggttttactacggttacgtttacgggaacgttacggggaaccgtaacgggttcccgtaaccggttccggtaacggtcccgaacggtaccccgttaacggaccccgttaaccgttccgtaacgttacccgacgtttcccggtaccgttaacccccg

SEQ ID NO: 187992 - DNA, 961 bp, Homo sapiens
  misc_feature: GYAE6OF02FFRJX.39.60.F05.1.454.CMB.1.raw
tcagtcgcactagtcacgaccggtgctcgatttagtacgtcatcagggaaggggctgggcctaaggaagcagcactggtggtgcctcagccatggcctggaccgttctcctcctcggcctcctctctcactgcacaggctctgtcgaccttcctatgtcttcgactcacgcctaccgtcggtcgtcgacggtccggacccgagggaccacggaccggaccgtaggtaactttaccggtagggtaacgggggtaaactagttaacggttaaggtaagttaacgtcggttcggttacgaccgtaccggttacgtaaccgaggaccgtaacggaacgtcggaaccggtccgccggttcccgtggtcggtccgttcggtacgtactaggtacgtacgtacgaccggtaccggcccggacccggtccgtaacgggtaccgttaccgtaccggtacggtaccgttaccgttacgttccggttaccggtacccgtaacccgtacccggtaacggttacccggggtaacccgggaaccccgtaccccggtacccgtacccgggtaaccgtaacccggttaccgggaaccgggtaccggggtacgggggtaaccgggtaacggggtttacgggggaccgttaccggttaaacccggggtacctttaaacccgttagggtttaaaccgggttaccggaggggtacccgggtttagggttaacccgaagggttaagggtaaccgttaacggtaaacggtttaccgggttaacggttaccggttaacgggttttaccgggttttaaaccggttacgggttaacccggtttaaccggggaacccttaaaccggggtccgttaacccggtacccgtttaccggacccgaacggtaccccgacccgtaacccggttaacccgcccgttaacccgtcgtttccttaccccgctttccccggtccttacccccggtac

SEQ ID NO: 187993 - DNA, 651 bp, Homo sapiens
  misc_feature: GYAE6OF02IOHN0.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtggggaaacataattggaagtaatagtgtgcactggtaccagcagaagtcaggccaggcccctgtgctggtcgtctatgatgatagcgaccggcctcgagggactccctgacgcgtattcctcgtcggcctaccaactcgtagggaaccaccgggcccacccgtgaacccatccgagcgagggtacgaaggtcggggatgggacggccgtaacttagttactggtacgagggttgtacgcgtaagtgaagaagttagtgacttacgtaggttttaagtcgttaccgtttacgggaaacgttcggggtaacctaacgggttcccgtaacccggtttcccggtaacggggttacccaaccgggtaccccgaaaccgggtacccccaaaccccctacgttaccgttaccctaaccgttcccgttaccggttacccccccg

SEQ ID NO: 187994 - DNA, 611 bp, Homo sapiens
  misc_feature: GYAE6OF02G2DVM.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgaaagcgaccggcctacgagggactcccgtgacgcgtattctctcggctaccaactcgtggaacacggcccacctgaccatcgagcgaggtacgaaggtcgggatcggagccgactattactgtcaggtgtgcgagtcgagtaagtagtgagtcgtaggtttatcggtacgtttacgggtaaacgtcgggaaccgtaagggttcccgtacccggttccggttaacggtccaaccggtaccccgaaacgggaccccctaaacccccgtacgtaccggttacccaaccgtttcccggttccgttacccccgtccccc

SEQ ID NO: 187995 - DNA, 542 bp, Homo sapiens
  misc_feature: GYAE6OF02FIEHI.39.60.F05.1.454.CMB.1.raw
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggccccctgtgctggtcgtctatgatgatagcgaccggcactcagggatccctgagcgattcnctggctccaactcgtgggaacacggccaccctgaccatcagcaggggtcaaggtcggggatggaggccgactattacngtcaggtgtgcgatgagaattagtgatcgtaaggtttatggtcttacgggaactggggaaccctaggtccaccggtctaggtccacggtcccaacggccccaaccccgacttcggcctactcgttacccg

SEQ ID NO: 187996 - DNA, 618 bp, Homo sapiens
  misc_feature: GYAE6OF02I3VOR.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctatgacctcctatgtcttgactcagccaccctcggtgtcagtggccccaggacagacggccaggattacctggtgggggaaacataattggaagtaatagtgtgcacgtggtaccagcagaagtcaggccaggcccctgtgctggtcgtctatgatgatagcgaccggcctcgacgggatccctgagcgattctctggcctccaactcgtgggaacacggccaccctgaccatccagcgaggggtacgaaggtcggggatggacggaccgtagtacttacgtgtcgaggttgtgcgatggaagaattaggagtagttcgtaagggttttatcggttaccgtttacgggaacgttacggggaaccctaacgggttcctaacccggttccgtaaggttaccaacggtacccccgaaacgggtaccccaaccccgtacgttccggttaccctaacgttcccgttcccggttaccccccg

SEQ ID NO: 187997 - DNA, 715 bp, Homo sapiens
  misc_feature: GYAE6OF02JDGSQ.39.60.F05.1.454.CMB.1.raw
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctgacgggatccctgagcgtattctctggctccaactcgtgggaacctacggccctacccgtgaacccagtccaacggccgaaggggtaccgaacgggttcggggatgggaacgggcccgtaacgttattacgtggtaccgtaagggttcggtggtaccggagttacggaagtaaagttaacgggtgtaacgttacggtaaggtttttacgtaggtttaccgtttaccgggtaaacggttaccggggaaacccgtaaacggggttacccgtaccccgggtttaccgtaacggggtttacccgaaccggtaacccccggaaacgggtacccccctaaacccccgtacggttaccgttacccgtacccgtttacccggttacccggtttaccccccctaaccccccg

SEQ ID NO: 187998 - DNA, 523 bp, Homo sapiens
  misc_feature: GYAE6OF02GGC03.39.60.F05.1.454.CMB.1.raw
  modified_base (354)..(354): a, c, t, g, unknown or other
  misc_feature (354)..(354): n is a, c, g, or t
  modified_base (417)..(417): a, c, t, g, unknown or other
  misc_feature (417)..(417): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggcctcagggatcccgtgagcgattctctggctccaactctgggaacncggccaccctgaccatcacgcgagggtcgaaggtcggggatggaggccgacgtattacgtgtnaggtgtgcgatgagatagtgatcgtagttatgttcttcggactgggaccgagtcaccgtcgtaggtcacgcccaaggcccaacccgctcgacactcctcgtccccg

SEQ ID NO: 187999 - DNA, 708 bp, Homo sapiens
  misc_feature: GYAE6OF02GMWSY.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtggggaaacataattggaagtaatagtgtgcactggtaccagcagaagtcaggccaggcccctgtcgctggtcgtctatgatgatagcgaccggcctcgagggatcccgtgacgcgtattctcgtggcctccaacgtctacgggaaccaccggcccaaccccgtgaaccctatccgacgaccgaggggtaccgaaacgggttccgggggaattcgggaacgggacccgtaacttaacgtttaccgtgtaccgtagggttcgtagggtacgtagttcggaaagtaaacgttaggttacgaagttacgtaaagggtttttatacgggtttaccgtttaaccggggtaaacgttacgggggtaaaccctaaggggttacccgaacccggtttaccggtaacgggttacctaaccgggtaccccgaaacgggtacccccaaacccccgtacgttcccgttaaccgtacccgtttacccgttccggtttccccccccgg

SEQ ID NO: 188000 - DNA, 757 bp, Homo sapiens
  misc_feature: GYAE6OF02GF18T.39.60.F05.1.454.CMB.1.raw
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagccaccctcggtgtcagtcggccccaggacagaccggccaggattacctggtaggggaaacataattggaagtaatagtgtgcacgtggtaccagcaagaagtcaggccaggcccctgtcgcgtggtcgtctatgatgatagccgaccggccctgaggactcccgtgacgcgtattctcgtcggcctaccaacgtcgtacgggaaacctaccgggcccctacccgtacgaaccctaacgtccgaacggtaccgtaagggggtaccggaaacggggtaccgggggtaagtcgggaaccgggtacccgtaacgttaacgtttaaccgttggtaccgtaggggttacggtcggacggtagttaggaagtaaagttacgggtagtacgttacggttaaggttttacgttacgttaccgtttaacgggtaaaccggttacgggaaaccgttaaacgggttcccgttaacccggttaccggttaacgggtacccgaaccgggtaacccccgtaaacccgggtaaccccctaaacccccggtaccttaccggtaacccttaacccgttccgtttaccccggttacccccctaaccccg

SEQ ID NO: 188001 - DNA, 625 bp, Homo sapiens
  misc_feature: GYAE6OF02HSURN.39.60.F05.1.454.CMB.1.raw
  modified_base (396)..(396): a, c, t, g, unknown or other
  misc_feature (396)..(396): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctggtgtcagtcggccccaggacacgacggcaggacttaccgtggtaggggaaacagttaaagttggaaagtaatagtgtgacacgtcggtaccagcaagagtacacggccgacggcccctgtgctcggtccgtctatgatgatcggacgacccggccctacgagggacctaccgtgacgcgtattccgtcgtcggcctacctaaccgttcgtacgggaacccncggtacccaccctgaacccctagtccaggccgaggggtacggaacggtcgggagtggaccgtcgaattacgtacgtcgtacgaggttcgtagacgtagtgaagtaattaggtagtagtgttacgttgtacggttacgttaggaacgcggaaccgtagtccgaccgttacgtgtaccgaccgaccgtacgacccgaaccctgtaccgttacgtccttccgtaccgtcccc

SEQ ID NO: 188002 - DNA, 737 bp, Homo sapiens
  misc_feature: GYAE6OF02IUJPI.39.60.F05.1.454.CMB.1.raw
  modified_base (316)..(316): a, c, t, g, unknown or other
  misc_feature (316)..(316): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggacttacctgtagggggaaacataattggaagtaatagtgtgcactggtaccagcagaagtcaggccaggcccctgtgctggtcgtctatgatgatagcgaccggccctnacggggactcccgtgacgcgtattctcgtcggcctaccaactcgtcggggtaaaccaccgggccctaaccccgtacggaaccctaactaccgaacggtcgaacgggggtaccggtaaacgggtccgggggaatcgggaacggggtaccccggtaaacgttaacgtttaacgtcgggttaccgaaggggtttacggttgggacggtaagttacgggaaaggaaacgttaggtaggtaagttaccgtaagggtttttacgtggtttaccgttaaccgggtaacgtaacgggggtaaccctaacggggttacccgaacccggtttaccggtaacgggttacccgaaccgtaaccccggaaacgggacccccaaacccccgtacgtccgttaacccgtacccttcccggttccggttcccccccg

SEQ ID NO: 188003 - DNA, 695 bp, Homo sapiens
  misc_feature: GYAE6OF02JO80U.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcacgcccaccctcggtgtcaggtcggccccaggacaggacggccaggtattaccgtggtacggggaaactagtaagttgaaaacgttaataggtgtgcaactgggtaacccagcagaatcaggccaggccctggtcgctggtcgtctatgatgatagacgaccggcctacgacgggactcccgtgacgcgtattcgtctggcctaccgaactcgtacgggtaaccacgggccaacccgtgaaccctagaccgacgacgaggggtacggaaaggtcggggaagtacggaacgggaccgaacgtacgttaaccgtaggttacagggttcgtacgacggtagtacggaagtaaagtagtagacgtacgtaaggtttacgttacgttacgttacgggtaaccgttacgggtaaaccgtaacggttaccgtaaccggtaccggttaacggtaccgtaaccggtaacccgtaaaccggtaccccgtaaaccccgtaccgttaaccgtacgtacccttaccgttaccgttaacccccg

SEQ ID NO: 188004 - DNA, 774 bp, Homo sapiens
  misc_feature: GYAE6OF02GLFV2.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggacttacctggtagggggaaacagtaagttggaagtaatagtgtgcactggtaccagcagaagtcaggccaggcccctgtgctggtcgtctatgatgatagcgaccggcctcgagggactcccgtgacgcgtaattctacgtcggcctacctaaactcgtagggaaacaccgggacccaacccgttacgaacccacgtaccgaacgtccggtaacggggtaccggaaagggtttccgggggaattacgggaaccgggacccgtaacgttaaactttaccgtacggtacgtagggttggtcggacgtaagttaggaaacgtaaaggttaggttaggtaacgttacgggttaaacggtttttaacgtttcgggtttaccgtttaacccggggtaaacggttaaccggggttaaacccgttaaacggggttacccgttaaacccgggttacccggttaacgggttacccgaaccgggtaacccccgtaaaacccgggacccctaaaaccccccgtacggttaccgttaacccgtaaccgtttaccccggttaccggtttaacccccccccgg

SEQ ID NO: 188005 - DNA, 689 bp, Homo sapiens
  misc_feature: GYAE6OF02JK7U1.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacaggacggccagggacttaccgtgggtacggggggaaactagtaaagttagggaaagtaaataggtgtgctacgtcggtaaccagcagaagtccaaggccacggcccctagtcgcgtcggtcgtctagtgatgtataggccggaccggccctacgacgggactcccgagacgcgtattcgtcgtcggcctacctaacgtcgacgggaacaccggccctaccgtcgacctagtaccgacggcgagggtacgtaagggtacgggactagggacgggtaccgaacgttagttacgtacgttcgaagggtggtacgacggtagtacggtaagaagttaggtacggtacgttagggtttagtttaacgtcggtttcggttaaccggaacggttacgggaaccgtaacggtacccgtaaccggttacggtacggacctaccggacccgaaccggacccaacccgtcgttaccgtaccgttacctccgtacccgttacccc

SEQ ID NO: 188006 - DNA, 736 bp, Homo sapiens
  misc_feature: GYAE6OF02IDV53.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacacgacggcgaggacttaccgtggtaggggaaacataagttggaaagttaatagtgtgcacgtgtaccagcaagaagtcaggccgacggccccgtgtacgtcgtggtcgtctagtgagtgagtacggccggacccggtccctagacgggtacttccccgtaggacgacggtactttccgtcgtacggtaccctcctaaacgtcgtacgggtaaccgacccggacccgtaccctacggaaccctacgtaccgaggtccggaaggggtaccggaaaggggtaccggggagtacggacggtaccggtaacttaacgttacctggttacgagggttcggtacgagtagtaggtaagaaagttacgtagtaacgttcggttaaggttttagtcggtttaaccggttacgggaaacgtaccgggtaaccgtaacggttaccgtaacccggttccgttaacgggaccgaaccggtaaccccgtaaaccggaccccctaaacccggacgttaccgtaccctaaccgtttcccgtcccggttcccccccg

SEQ ID NO: 188007 - DNA, 591 bp, Homo sapiens
  misc_feature: GYAE6OF02F0EP4.39.60.F05.1.454.CMB.1.raw
  modified_base (291)..(291): a, c, t, g, unknown or other
  misc_feature (291)..(291): n is a, c, g, or t
  modified_base (433)..(433): a, c, t, g, unknown or other
  misc_feature (433)..(433): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtgccccaggacagacggccaggattacctggtgggggaaacataattggaagtaatagtgtgcactggtaccagcagaagtcaggccaggcccctgtgcgtggtcgtntatgatgatagcgaccgccctcgaggactcctgagcgattctcgtggctccaactcgtagggaacacggccacccgtgactatcagaccaggggtcgaaggtcggggatggacggccgacttacgttactgcgtaggttcgngcgatgagtaataggtgatcgtagtttaatggttacttacgggaacgttgggtaaccgtaggtaccgaccgttaccggttaggacctaccggaccccgtaacggacccccttaacccgaccgttacggtcctaccggttccttccggttacccccccg

SEQ ID NO: 188008 - DNA, 559 bp, Homo sapiens
  misc_feature: GYAE6OF02FLZLX.39.60.F05.1.454.CMB.1.raw
  modified_base (421)..(421): a, c, t, g, unknown or other
  misc_feature (421)..(421): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggccccctgtgctggtcgtctatgatgatagcgaccggccctcagggactcccgtgagcgattctctggctccaactctagggaacacggcccacctgaccatcagcagggtcaaggtcgggatggaggccgatagttactgtcaggtgngcgatgagtaatagtgatcgtaaggttttatgttacgttacggaacgttcgggaaccgtaaggttccgaccgtccgtacggtaccaacggtcccaacggccccaaccccgactacgtaccacttcctcgttacccccc

SEQ ID NO: 188009 - DNA, 646 bp, Homo sapiens
  misc_feature: GYAE6OF02GKUNO.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggcccaggacagacggccaggacttaccgtggtagggggaaacataattggaagtaatagtgtgcacgtggtaccagcagaagtcaggccaggcccctgtgcgtggtcgtctatgatgataggcgaccggccctcgacgggctcccgtgacgcgtattctcgtggtctaccaactcgtacgggaaccgacggccctacccgtcgacccactcgacgcgacggggtacgtaacgggtcggggtaatgggacgggaccgtaacgttacgttacgtcgtacgagggttcgtggacgtagtagaaggtaacgtaggtagtaacgttacgttaggttttattcggttaccgttacggtaacggtacgggaaccgtaacgggtcctacccggtacgtaacggtacgacccggacccgtaaccggacccaacccgtcgtaccgccctacttcccgtcgttaccccccg

SEQ ID NO: 188010 - DNA, 636 bp, Homo sapiens
  misc_feature: GYAE6OF02GDF7V.39.60.F05.1.454.CMB.1.raw
  modified_base (179)..(179): a, c, t, g, unknown or other
  misc_feature (179)..(179): n is a, c, g, or t
  modified_base (324)..(324): a, c, t, g, unknown or other
  misc_feature (324)..(324): n is a, c, g, or t
  modified_base (441)..(441): a, c, t, g, unknown or other
  misc_feature (441)..(441): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtntcagtggccccaggacagacggcaggattaccgtggtggggaaacataattggaagtaatagtgtgcacgtggtaccagcagaagtcaggccacggcccctgtgctggtcgtctatgatgatagcgaccggcctcgaggactccngacgcgattctcgtggctccaagtcgtaggaacacggccaccctgaacccatcgacgcgagggtacgaagggtcgggatcggacggccgtactacttacgtcggtacgtaggttcgngtacgagttacggagtaaagttaggtacgaagttcgtaggttttacgtggtttaccgttacgggaaacgttacgggggaaccctaacggtcccgtaacccggtaccgttaacgggtaccaacggaccccgtaaacggcccccaaacccggtccttaccggttaccctacccgtttccgtaccggtttaccccccc

SEQ ID NO: 188011 - DNA, 686 bp, Homo sapiens
  misc_feature: GYAE6OF02I802G.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagcccaccctcggtgtcagtcggccccaggacagaccggccaggacttaccgtggtagggggaaaacagtaagttggaaagtaatagtgtagcacgtggtaccagcagaagtcaggccacggcccctgtcgcgttggtcgtctagtgatggagtacggccggacccggcctacgacgggactccgtgacgcgtacttctcgtcgcctaccgtaacgtcggacgggaccaccggccctacccgtacgaacctactacgacggcgtaacggggtacgaacgggtcgggagtacggacggtaccgtaacgtacgttacgtcgtacggtagggttcggtacggacgtagtacgtaaggtaacgttaagtcgtaacttacggttaaggtttagtcggttaccgttacgggaacggttacgggtaaccgtaacggtccgtaccggttaccggtacggtaccgaccggtacccgaaccgtaccccgtaacccgtcgtaccgtacctaccgttcccgttcccgtccccg

SEQ ID NO: 188012 - DNA, 707 bp, Homo sapiens
  misc_feature: GYAE6OF02I1VB5.39.60.F05.1.454.CMB.1.raw
  modified_base (395)..(395): a, c, t, g, unknown or other
  misc_feature (395)..(395): n is a, c, g, or t
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcagccaccctcggtgtcagtcggccccaggacagacggccaggattaccgtgtagggggaaacataagttggaaagtaatagtgtgcactggtaccagcagaagtcacggccaggcccctggtgcgttggtcgtctatgatgatagccggaccggcccgtacgagggactcccgagacggacgtactttccgtcgttcggacctaccctaacgttcgtacggggaaacccnccgggaccctacccctcgaaccctatcgacggtcgaacggggtcggtaaacgggtccggggagtcggacgggacctacgttaattaccgtggtacgtagggttgtcggtacgaagttacgggaaagtaaagttaggtataacggtttacgtaaggttttacgttcgggtttaccgttacggggtaaccgttaacggggaaccgttaacgggttccgaccggttacccggtaaggtaccggaaccgacccgtaaccggaccccctaaccccgtacggtccgttaccctacgttacccgttcccggttaccccc

SEQ ID NO: 188013 - DNA, 762 bp, Homo sapiens
  misc_feature: GYAE6OF02IO2OX.39.60.F05.1.454.CMB.1.raw
  modified_base (547)..(547): a, c, t, g, unknown or other
  misc_feature (547)..(547): n is a, c, g, or t
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagccaccctcggtgtcaggtcggccccaggacaggaccgccgaggacttaccgtggtaggggaaacataattggaagtatagtgtgcacgtacggtaccagcaagacgtagacggccacggtcccctggtcgcgtaggttcgtctagtgtagtggatacggaccggtaccggcccgtacgacgggaccttcccggtgacgacgtatttccgtgtaccggcctaccctaagttccgaccggggtaaccgccggtaccccgaaccgtcgaacccgtacgtaccgaacggtcgggtaacggggtacgggtaaacgggtcgggtaaggtacgggaccggaccgtaccgttagttaccgtcggtacgtaggtggttcggacgtaagnggaacgtaaagtggtatacgttacgttaagggttttacgtccggtttacggtttaacggggtaagggtttaaccgggaaccgttacgggttacgttaccgggttaccggttaccggtttaaggacccgtaacccggtaacccgaacccggtaacccgaaccccccggttacggtcggttacccccttacgttccccgggttccctacccccccgg

SEQ ID NO: 188014 - DNA, 717 bp, Homo sapiens
  misc_feature: GYAE6OF02IIYMP.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtcgacctcctatgtcttgactcagcccacccgtggtcgtcagtcggcccaggacaggaccggcaggacttaccgtgggtaggggaaactattaagttaggaaagttaagtacggtgtcgactacgtcgggtaccagcgaagaagtcgacggccgacggccccgtgtcgcgtcggtcgtctatcgagtgagtacggccgaccgccgtcgacggtctccgtgacgcgtacttcgtctcggtcctacctacgtcgtacgggaaccaccgggtaccctaccctacgacctaacgtccgaggaccggtaacggggtaacgtacggggtacgggtacgtagggacgggtaccgtacgtttacgttaaccgtggttacgtaacgggttcggttacggcgttaaggtacgaagtaaacgtggttagtacgtacggtttagtttacggtcgtttaccgttacgggaccggttaacgggaccgttacgtacccgaaccggtttcgtaacggtaccggaccgaaccgaccccgtaacccgacccgttacgtcccgtaccctacgttcccgtacccgttcccccg

SEQ ID NO: 188015 - DNA, 956 bp, Homo sapiens
  misc_feature: GYAE6OF02I3YZZ.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttgactcacgcccacccgtcggtgtcaggtcggccccaggaccgaggaccggccgaggtacttaccgtgggtacgggggaaactagttaagttagggaaagtaagttacggttagtcggacctacgttacgggtaccagacgaaggtaacggtcgacggcccgaccggtcccccgtggtcgtccggttcggggtcctacttagtggacgtaggtaacggtccgggtacccggaccccgggtaccccgtagggaccggggtaccttcccccggttaggacggtaccgttacgtttccgtaccggttcggtacccttacccgtaaacggttccggtaaaccgggaaccccgtaccggacccccctaccgtaccgaacccttacgtaaccgacgggtacgggtaacgggggttacggtaaccggggtacggggtaacgtacgggaacggtacccggtaacgttaacgttaccggtacggttacgggttaccggttacggttacggtaacggttacgtaaacgggttaaagtacggttaacgttaaggttaccggtttaaggttttccggttttacggtttaaccccggggttaccggttaaaaccggggttacccggtaaaccgggtttaaaccgggtaccccggttacccggttaaccgggtttaccgggtaacccccggaaacccgggttaaccccccggaaacccggttaacccccccgtaaacccccgttcggtttaaccccgtcccgtttaaccccgtttccccgggttacccccgtttcccccccgttaaccccg

SEQ ID NO: 188016 - DNA, 803 bp, Homo sapiens
  misc_feature: GYAE6OF02GKZZU.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctcctctcactgcacgagctctgtcgacctcctatcgtctgacctcacgacccaccgtcggtgtcgaggtccggaccccgacggacgacggaccggaccgaaggtacttaccgtgggtaacggggaaactaagttaagttaggtaaagtaagtagtgtgacgacgtacggtaccgagacgagtaacgtaccgacggaccgaccggtcccgtggtccgtcgttacggttccgttacgtagtaggtaagtaggaacgtaccggcccggtaacccggtaccgtacggacgggtaccgtacccggtaggtaccggtcgttacttcgtcgtcgtaccctaacctacgtccggaacggaacccgaccgaccctacccgacgaccctacgacgacggacggtaccgggagtacggggtacggacgggacggtaaccggaccgtagttacgttacgtcggtcggtaaggttctagggacgtagtaggtaacgtagtcgtagtacggttaatttagggttacttacgggtttacgtaacccgggtaagggttaacccggggaacgttacccgggtacccgtaccggttaacgggtaccggtacccggtaaccggtaaccccgaacggtacccccctaaccgttccggtaccgtaccccgttcggtttcccccggtaccccgttacccccg

SEQ ID NO: 188017 - DNA, 704 bp, Homo sapiens
  misc_feature: GYAE6OF02FIO1Q.39.60.F05.1.454.CMB.1.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (394)..(394): a, c, t, g, unknown or other
  misc_feature (394)..(394): n is a, c, g, or t
tcagtcgcactagtcacgaccggtgctcgatttagtacgtcatcagggaaaggggctgggcctaaggaagcaacactggtggtgcctcagccatggcctggaccgttctcctcctcggcctcctctctcactgcacaggctctgtgacctcctatgtcttgactcagcccaccctcgggtgtcagtcggccccagggacaggacggccaggacttaccgtggtagggggaaacataagttggaagtaatagtgtgacactggtaccagcagagtcaggccaggcccctgtgctggtctcgtatgatgatggccgaccgccgtcgagggactccgngacgtcgattcncgtcgctaccacgtcgtaggaccgaccggcctaacccgcgtaacccnctacgacggacgtaggggtacgaacgggtcggggaacgtaggaccgggaccgtaacgtactttaccgcggtcgacgggttagtcgagtacgtcgtaaagtaacgtaggtacgttacgtacgtttaaggtttttacgtcggtttacggttttacgggaaacggttcggggaaacccgttaaacggttaccgtacgttacccgggttaccggtttaaacgggccgtaaccccgggaccccgtaaacccgggtacccccaacccccggttatacccgttaccgtaccccgtttacttcccccggtttcccccg

SEQ ID NO: 188018 - DNA, 773 bp, Homo sapiens
  misc_feature: GYAE6OF02JTKWW.39.60.F05.1.454.CMB.1.raw
  modified_base (236)..(236): a, c, t, g, unknown or other
  misc_feature (236)..(236): n is a, c, g, or t
tcagtcgcactagtcacgaccggtgctcgatttagtacgtcatcagggaaagggggctgggcctaagggaagcagcactgggtgggtgcctcagccatggcctggaccgttctcctcctcggcctcctctctcactgcacaggctctgtcgacctcctatgtcttgactcacgccacccgtcggtgtcaggtccggaccccgaggacgacggaccggtccgaagggtacttaccgngggtacgggggaaaacagttaagttaggaagtaataggtcgtgactacgtcggtaccagcgaagagtcgacggaccgacggaccccttggcgtacgtcgggttcgtactagtcgagtaggtactacggacccggtaccggtacccgtggaacgggtacctccgtgacgtcgtacttcgtcgcggtactacctaaccggtcgtaacgggaaccgtccggcctaacccgtgaaccctagaccgtacgggcgtacggggacggtaagggtcgggacgtacgggacggtaccgtaacgttacttaccggtggtacggtaggtcggtacgagtacgttaacggaagtacgggtaatcggtaacggttacggtttacgttaacggtcggtttaaccgtaacgggttacggtacgggtacccgttacgggttaccgaacccggttacgtacccgggtaccgaccggtaaccccggtaaccgaccccggtttaaaccccgtggttacccgtaacccgttccggttacccttcccggttaaccccc

SEQ ID NO: 188019 - DNA, 700 bp, Homo sapiens
  misc_feature: GYAE6OF02I5FY1.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtcgacctcctatgttcttgactcacgcccaccctcggtgtcacggtcggccccgaggacacggaccggccaggtacttaccgtgggtagggggaaacagttaaagttagggaaagtaatagtgtgacacgtcggtaccagcaagaacgtcgacggccacggcccctgtgcgtggtcgtctagtgatgataggccggacccggcctacgacgggactccctggacgcgtattctacgtcggcctaccaactcgtacgggaaaccaccggccctaccgtacgacctactacgacggtcggtaacggggtacggtaaacgggtcgggggtagtcgggacggaccgtacttaagttacgtcgtacgtagggttcgtagcgtagtacgaagtaacgtaggtagtagtacggttagtttacgttacgtttacggttaaccggaggttaaccgggtaacgtaacggttaccgtaccggttaccgtaacggtccgacggtaacccgaacccggtacccaacccgtacgttaccgtaccctaccttccgttacccgttacccccg

SEQ ID NO: 188020 - DNA, 789 bp, Homo sapiens
  misc_feature: GYAE6OF02HBIBE.39.60.F05.1.454.CMB.1.raw
tcagtcgcactagtcacgaccggtgctcgatttagtacgtcatcagggaaaggggctgggcctaaggaagcagcactggtggtgcctcagccatggcctggaccgttctcctcctcggcctcctctctcactgcacaggctctgtgacctcctatgtcttagactcagcctacccgtcggtgtcagtcggcccaggacagacggcaggacttaccgtggtaggggaaacagttaagttaggaaagtaagtagtagtgacacgtacggtaccacgtacgagaagtcgaacggcccgtacggcccccgtaggtcggtccgttgggttccttacgttagttacggtaacgttggtaacgtacgggacccgggtaacccggtccccgtacgggtaacgggtaccctccccggtagggtacggtccgttacgttccgttaccgtcggtacctaccgtaacgtcggtacgggaacccaccggaccctacctaccgacctacacgtcgacggtacgggtaaccggtaggggtcgggacgtacgggaccgggtccgtaaacttcgttaacggttctaacgggttgggtcgttacggacggtataacgggagttaaagtaggtagtacttacgggtttagtttagttaccggttacggttaacggaaccggttaccgggaaaccgttaccgggtaccgtacccggtttacggaacggttacccaaccggaccccgtaaaccgggaccccctaaccgttccgaccgttaccctacccgttcccgttaccctaccccccg

SEQ ID NO: 188021 - DNA, 215 bp, Homo sapiens
  misc_feature: GYAE6OF01A27RX.4.61.F06.1.454.CMB.1.raw
  modified_base (214)..(215): a, c, t, g, unknown or other
  misc_feature (214)..(215): n is a, c, g, or t
tcagagcactgtagcacgaccggtgctcgatttagctacgctctaagggaaagggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctggcaaggcgcatagnn

SEQ ID NO: 188022 - DNA, 224 bp, Homo sapiens
  misc_feature: GYAE6OF01ETAXD.4.61.F06.1.454.CMB.1.raw
  modified_base (216)..(224): a, c, t, g, unknown or other
  misc_feature (216)..(224): n is a, c, g, or t
tcagagcactgtagcacgaccggtgctcgatttagctacgctctaagggaaaggggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctgggcaaggcgcatagnnnnnnnnn

SEQ ID NO: 188023 - DNA, 218 bp, Homo sapiens
  misc_feature: GYAE6OF01EKEOD.4.61.F06.1.454.CMB.1.raw
  modified_base (215)..(218): a, c, t, g, unknown or other
  misc_feature (215)..(218): n is a, c, g, or t
tcagagcactgtagcacgaccggtgctcgatttagctacgctctaagggaaaggggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctggcaaggcgcatagnnnn

SEQ ID NO: 188024 - DNA, 214 bp, Homo sapiens
  misc_feature: GYAE6OF02FFPJD.4.61.F06.1.454.CMB.1.raw
  modified_base (213)..(214): a, c, t, g, unknown or other
  misc_feature (213)..(214): n is a, c, g, or t
tcagagcactgtagcacgaccggtgctcgatttagctacgctctaagggaaagggtgatcaggactcctcagttcaccttctcacaatgaggctccctgctcagctcctgggctgctaatgctctgggtctctggaactgtggctgcaccatctgtcttcatcttcccgccatctgactacagtgctctgagcgggctggcaaggcgcatagnn

SEQ ID NO: 188025 - DNA, 216 bp, Homo sapiens
  misc_feature: GYAE6OF02G78ZI.4.61.F06.1.454.CMB.1.raw
  modified_base (215)..(216): a, c, t, g, unknown or other
  misc_feature (215)..(216): n is a, c, g, or t
tcagagcactgtagcacgaccggtgctcgatttagctacgctctaagggaaaggggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctggcaaggcgcatagnn

SEQ ID NO: 188026 - DNA, 223 bp, Homo sapiens
  misc_feature: GYAE6OF02GZDRY.4.61.F06.1.454.CMB.1.raw
  modified_base (215)..(223): a, c, t, g, unknown or other
  misc_feature (215)..(223): n is a, c, g, or t
tcagagcactgtagcacgaccggtgctcgatttagctacgctctaagggaaaggggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctggcaaggcgcatagnnnnnnnnn

SEQ ID NO: 188027 - DNA, 216 bp, Homo sapiens
  misc_feature: GYAE6OF02IC9YH.4.61.F06.1.454.CMB.1.raw
  modified_base (214)..(216): a, c, t, g, unknown or other
  misc_feature (214)..(216): n is a, c, g, or t
tcagagcactgtagcacgaccggtgctcgatttagctacgctctaagggaaagggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctggcaaggcgcatagnnn

SEQ ID NO: 188028 - DNA, 221 bp, Homo sapiens
  misc_feature: GYAE6OF02HE4WI.4.61.F06.1.454.CMB.1.raw
  modified_base (215)..(221): a, c, t, g, unknown or other
  misc_feature (215)..(221): n is a, c, g, or t
tcagagcactgtagcacgaccggtgctcgatttagctacgctctaagggaaaggggtgatcaggactcctcagttcaccttctcacaatgaggctccctgctcagctcctggggctgctaatgctctgggtctctggaactgtggctgcaccatctgtcttcatcttcccgccatctgactacagtgctctgagcgggctggcaaggcgcatagnnnnnnn

SEQ ID NO: 188029 - DNA, 273 bp, Homo sapiens
  misc_feature: GYAE6OF02FL5F4.4.61.F06.1.454.CMB.1.raw
  modified_base (154)..(154): a, c, t, g, unknown or other
  misc_feature (154)..(154): n is a, c, g, or t
  modified_base (157)..(157): a, c, t, g, unknown or other
  misc_feature (157)..(157): n is a, c, g, or t
  modified_base (184)..(184): a, c, t, g, unknown or other
  misc_feature (184)..(184): n is a, c, g, or t
  modified_base (236)..(236): a, c, t, g, unknown or other
  misc_feature (236)..(236): n is a, c, g, or t
  modified_base (238)..(273): a, c, t, g, unknown or other
  misc_feature (238)..(273): n is a, c, g, or t
tcagagcactgtagcacgaccggtgctcgatttagctacgctctaaggggaaagggggtgatcaggactcctcagttcaccttctcacaatgaggctccctgctcagctcctggggctgctaatgctctgggtctcgtggactgtgctgcaccntcngtctcattcctcccgcatctgacctanagtgccttcgtggacggccggggcttgggacgaacggggtccactaagtagnannnnnnnnnnnnnnnnnnnnnnnnnnnnnnnnnnnn

SEQ ID NO: 188030 - DNA, 175 bp, Homo sapiens
  misc_feature: GYAE6OF01BK0ON.45.25.C03.1.454.CMB.1.raw
  modified_base (171)..(175): a, c, t, g, unknown or other
  misc_feature (171)..(175): n is a, c, g, or t
tcagacgcgatcgacacgaccggtgctcgatttagtagtgtagatttgggtttggggacggttcggccaagggaccaaggtggaaatcaaacgaactgtggctgcaccatctgtcttcatcttcccgccatctgatcgatcgcgtctgagcgggctggcaaggcgcatagnnnnn

SEQ ID NO: 188031 - DNA, 220 bp, Homo sapiens
  misc_feature: GYAE6OF01D7145.45.25.C03.1.454.CMB.1.raw
  modified_base (190)..(220): a, c, t, g, unknown or other
  misc_feature (190)..(220): n is a, c, g, or t
tcagacgcgatcgacacgaccggtgctcgatttagtagtgtagatttgggtttgggggagttacagtaccctcaagacgttcggccaagggacccaaggtggaaatcaaacgaacctgtggctgcaccatctgtcttcatcttcccgcatctgatcgatcgcgtctgagcgggctggcaaggcgcatagnnnnnnnnnnnnnnnnnnnnnnnnnnnnnnn

SEQ ID NO: 188032 - DNA, 190 bp, Homo sapiens
  misc_feature: GYAE6OF01CMF6S.45.25.C03.1.454.CMB.1.raw
  modified_base (188)..(190): a, c, t, g, unknown or other
  misc_feature (188)..(190): n is a, c, g, or t
tcagacgcgatcgacacgaccggtgctcgatttagtagtgtagatttgggtttggggagttacagtaccctcaagacgttcggccaagggaccaaggtggaaatcaaacgaactgtggctgcaccatctgtcttcatcttcccgccatctgatcgatcgcgtctgagcgggctggcaaggcgcatagnnn

SEQ ID NO: 188033 - DNA, 170 bp, Homo sapiens
  misc_feature: GYAE6OF01DFCCX.45.25.C03.1.454.CMB.1.raw
  modified_base (170)..(170): a, c, t, g, unknown or other
  misc_feature (170)..(170): n is a, c, g, or t
tcagacgcgatcgacacgaccggtgctcgatttagtagtgtagatttgggtttggggacgttcggccaagggaccaaggtggaaatcaaacgaactgtggctgcaccatctgtcttcatcttcccgccatctgatcgatcgcgtctgagcgggctggcaaggcgcatagn

SEQ ID NO: 188034 - DNA, 189 bp, Homo sapiens
  misc_feature: GYAE6OF01BODM6.45.25.C03.1.454.CMB.1.raw
  modified_base (187)..(189): a, c, t, g, unknown or other
  misc_feature (187)..(189): n is a, c, g, or t
tcagacgcgatcgacacgaccggtgctcgatttagtagtgtagatttgggtttgggagttacagtaccctcaagacgttcggccaagggaccaaggtggaaatcaaacgaactgtggctgcaccatctgtcttcatcttcccgccatctgatcgatcgcgtctgagcgggctggcaaggcgcatagnnn

SEQ ID NO: 188035 - DNA, 189 bp, Homo sapiens
  misc_feature: GYAE6OF01AOEHP.45.25.C03.1.454.CMB.1.raw
  modified_base (187)..(189): a, c, t, g, unknown or other
  misc_feature (187)..(189): n is a, c, g, or t
tcagacgcgatcgacacgaccggtgctcgatttagtagtgtagatttgggtttggggagttacagtaccctcaagacgttcggccaagggaccaaggtggaaatcaaacgaactgtggctgcaccatctgtcttcatcttcccgcatctgatcgatcgcgtctgagcgggctggcaaggcgcatagnnn

SEQ ID NO: 188036 - DNA, 188 bp, Homo sapiens
  misc_feature: GYAE6OF01AFXL6.45.25.C03.1.454.CMB.1.raw
  modified_base (183)..(188): a, c, t, g, unknown or other
  misc_feature (183)..(188): n is a, c, g, or t
tcagacgcgatcgacacgaccggtgctcgatttagtagtgtagatttgggtttgggagttacagtacctcaagacgttcggccaaggaccaaggtggaatcaaacgaactgtggctgcaccatctgtcttcatcttcccgcatctgatcgatcgcgtctgagcgggctggcaaggcgcatagnnnnnn

SEQ ID NO: 188037 - DNA, 172 bp, Homo sapiens
  misc_feature: GYAE6OF01BMISB.45.25.C03.1.454.CMB.1.raw
  modified_base (170)..(172): a, c, t, g, unknown or other
  misc_feature (170)..(172): n is a, c, g, or t
tcagacgcgatcgacacgaccggtgctcgatttagtagtgtagatttgggtttggggacgttcggccaagggaccaaggtggaaatcaaacgaactgtggctgcaccatctgtcttcatcttcccgccatctgatcgatcgcgtctgagcgggctggcaaggcgcatagnnn

SEQ ID NO: 188038 - DNA, 188 bp, Homo sapiens
  misc_feature: GYAE6OF01CY5W6.45.25.C03.1.454.CMB.1.raw
  modified_base (187)..(188): a, c, t, g, unknown or other
  misc_feature (187)..(188): n is a, c, g, or t
tcagacgcgatcgacacgaccggtgctcgatttagtagtgtagatttgggtttggggagttacagtaccctcaagacgttcggccaagggaccaaggtggaaatcaaacgaactgtggctgcaccatctgtcttcatcttcccgcatctgatcgatcgcgtctgagcgggctggcaaggcgcatagnn

SEQ ID NO: 188039 - DNA, 224 bp, Homo sapiens
  misc_feature: GYAE6OF01BG9FO.45.25.C03.1.454.CMB.1.raw
  modified_base (177)..(224): a, c, t, g, unknown or other
  misc_feature (177)..(224): n is a, c, g, or t
tcagacgcgatcgacacgaccggtgctcgatttagtagtgtagatttgggtttgggggaccgttcggccaagggaccaacggtggaaatcaaacgaacctgtggctgcaccaatctgtcttcatcttcccgccatcttgatcgatcgcgtctgagcgggctggcaaggcgctatagnnnnnnnnnnnnnnnnnnnnnnnnnnnnnnnnnnnnnnnnnnnnnnnn

SEQ ID NO: 188040 - DNA, 181 bp, Homo sapiens
  misc_feature: GYAE6OF01A47JD.45.25.C03.1.454.CMB.1.raw
  modified_base (172)..(181): a, c, t, g, unknown or other
  misc_feature (172)..(181): n is a, c, g, or t
tcagacgcgatcgacacgaccggtgctcgatttagtagtgtagatttgggtttgggggacgttcggccaagggaccaaggtggaaatcaaacgaactgtggctgcaccatctgtcttcatcttcccgccatctgatcgatcgcgtctgagcgggctgggcaaggcgcatagnnnnnnnnnn

SEQ ID NO: 188041 - DNA, 195 bp, Homo sapiens
  misc_feature: GYAE6OF01C1QGS.45.25.C03.1.454.CMB.1.raw
  modified_base (191)..(195): a, c, t, g, unknown or other
  misc_feature (191)..(195): n is a, c, g, or t
tcagacgcgatcgacacgaccggtgctcgatttagtagtgtagatttgggtttggggagttacagtaccctcaagacgttcggccaaagggaccaaggtggaaatcaaaacgaactgtggctgcaccatctgtcttcatcttcccgccatctgatcgatcgcgtctgaggcgggctggcaaggcgcatagnnnnn

SEQ ID NO: 188042 - DNA, 173 bp, Homo sapiens
  misc_feature: GYAE6OF02HYXKA.45.25.C03.1.454.CMB.1.raw
  modified_base (170)..(173): a, c, t, g, unknown or other
  misc_feature (170)..(173): n is a, c, g, or t
tcagacgcgatcgacacgaccggtgctcgatttagtagtgtagatttgggtttggggacgttcggccaagggaccaaggtggaaatcaaacgaactgtggctgcaccatctgtcttcatcttcccgccatctgatcgatcgcgtctgagcgggctggcaaggcgcatagnnnn

SEQ ID NO: 188043 - DNA, 210 bp, Homo sapiens
  misc_feature: GYAE6OF01D7VLF.5.60.F05.1.454.CMB.1.raw
  modified_base (210)..(210): a, c, t, g, unknown or other
  misc_feature (210)..(210): n is a, c, g, or t
tcagatcagacacgcacgaccggtgctcgatttagtacgtcatcagggaaagggaccacggtcaccgtctcctcagcctccaccaagggcccatcggtcttcccctggcaccctcctccaagagcacctctgggggcacagcggccctgggctgcctggtcaaggactacttcccgtgtctgatctgagcgggctggcaaggcgcatagn

SEQ ID NO: 188044 - DNA, 213 bp, Homo sapiens
  misc_feature: GYAE6OF01C9L7V.5.60.F05.1.454.CMB.1.raw
  modified_base (210)..(213): a, c, t, g, unknown or other
  misc_feature (210)..(213): n is a, c, g, or t
tcagatcagacacgcacgaccggtgctcgatttagtacgtcatcagggaaagggaccacggtcaccgtctcctcagcctccaccaagggcccatcggtcttcccctggcaccctcctccaagagcacctctgggggcacagcggccctgggctgcctggtcaaggactacttcccgtgtctgatctgagcgggctggcaaggcgcatagnnnn

SEQ ID NO: 188045 - DNA, 213 bp, Homo sapiens
  misc_feature: GYAE6OF01BRDQJ.5.60.F05.1.454.CMB.1.raw
  modified_base (211)..(213): a, c, t, g, unknown or other
  misc_feature (211)..(213): n is a, c, g, or t
tcagatcagacacgcacgaccggtgctcgatttagtacgtcatcagggaaagggaccacggtcaccgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnn

SEQ ID NO: 188046 - DNA, 211 bp, Homo sapiens
  misc_feature: GYAE6OF01EKLUE.5.60.F05.1.454.CMB.1.raw
  modified_base (210)..(211): a, c, t, g, unknown or other
  misc_feature (210)..(211): n is a, c, g, or t
tcagatcagacacgcacgaccggtgctcgatttagtacgtcatcagggaaagggaccacggtcaccgtctcctcagcctccaccaagggcccatcggtcttccccctggcaccctcctccaagagcacctctgggggcacagcggccctgggctgcctggtcaaggactacttccgtgtctgatctgagcgggctggcaaggcgcatagnn

SEQ ID NO: 188047 - DNA, 214 bp, Homo sapiens
  misc_feature: GYAE6OF01DW59Z.5.60.F05.1.454.CMB.1.raw
  modified_base (211)..(214): a, c, t, g, unknown or other
  misc_feature (211)..(214): n is a, c, g, or t
tcagatcagacacgcacgaccggtgctcgatttagtacgtcatcagggaaagggaccacggtcaccgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnnn

SEQ ID NO: 188048 - DNA, 214 bp, Homo sapiens; identical to SEQ ID NO: 188047
  misc_feature: GYAE6OF01C7H0O.5.60.F05.1.454.CMB.1.raw
  modified_base (211)..(214): a, c, t, g, unknown or other
  misc_feature (211)..(214): n is a, c, g, or t

SEQ ID NO: 188049 - DNA, 212 bp, Homo sapiens
  misc_feature: GYAE6OF01AV3MY.5.60.F05.1.454.CMB.1.raw
  modified_base (211)..(212): a, c, t, g, unknown or other
  misc_feature (211)..(212): n is a, c, g, or t
tcagatcagacacgcacgaccggtgctcgatttagtacgtcatcagggaaagggaccacggtcaccgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnn

SEQ ID NO: 188050 - DNA, 212 bp, Homo sapiens
  misc_feature: GYAE6OF02FMBKP.5.60.F05.1.454.CMB.1.raw
  modified_base (209)..(212): a, c, t, g, unknown or other
  misc_feature (209)..(212): n is a, c, g, or t
tcagatcagacacgcacgaccggtgctcgatttagtacgtcatcagggaaagggaccacggtcaccgtctcctcagcctccaccaagggcccatcggtcttccccctggcaccctcctccaagagcacctctggggcacagcggccctgggctgcctggtcaaggactacttcccgtgtctgatctgagcggctggcaaggcgcatagnnnn

SEQ ID NO: 188051 - DNA, 437 bp, Homo sapiens
  misc_feature: GYAE6OF01CS4T6.3.56.F01.1.454.CMB.1.raw
  modified_base (425)..(425): a, c, t, g, unknown or other
  misc_feature (425)..(425): n is a, c, g, or t
  modified_base (431)..(437): a, c, t, g, unknown or other
  misc_feature (431)..(437): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagccccagccccccagagagcacgacccccaggtgccgtcgggccccgggggttttggtctgagcctcattcactgtgttatgtctcggactggaccaaggtcaccgtctaggtcagccaaggccaacccactcgtcactctcgtttcccaccctctcgagtcgcgtctcgtgacggcgggctggcaaggcncatagnnnnnnn

SEQ ID NO: 188052 - DNA, 431 bp, Homo sapiens
  misc_feature: GYAE6OF01CZ7Y1.3.56.F01.1.454.CMB.1.raw
  modified_base (423)..(423): a, c, t, g, unknown or other
  misc_feature (423)..(423): n is a, c, g, or t
  modified_base (427)..(431): a, c, t, g, unknown or other
  misc_feature (427)..(431): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagacgcagaccccaggtcgctcgggccccgggggttttggtctgagcctcattcactgtgttatgtctcggactgggaccaaggtcacgtcctaggtcagcccaaggccaacccactgtcactctcgttccccaccctctcgagtcgcgtctctgacgcgggtctggcaaggcacntagnnnnn

SEQ ID NO: 188053 - DNA, 438 bp, Homo sapiens
  misc_feature: GYAE6OF01CJGBJ.3.56.F01.1.454.CMB.1.raw
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
  modified_base (428)..(438): a, c, t, g, unknown or other
  misc_feature (428)..(438): n is a, c, g, or t
tcagagacgcactccacgaccggtgctcgatttagcagacgtctgaacacacaaaaggggagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagacccccaggtgcctggcccccgggggttttgcctgagcctcattcactgtgttatgtcttcggaactgggaccaaggtcaccgtcctaggtccagcccaaggccaacccatgtccactctgttccccnccctcctcgagtcncgtctctgacgcgggctggcaaggcnatagnnnnnnnnnnn

SEQ ID NO: 188054 - DNA, 461 bp, Homo sapiens
  misc_feature: GYAE6OF01E1RYY.3.56.F01.1.454.CMB.1.raw
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
  modified_base (451)..(461): a, c, t, g, unknown or other
  misc_feature (451)..(461): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagccccacgcccccagacgagccacgacccccaggtcgccgtcgggtcccccgggggtttttggctggacgccctctacttcacctgtgtttatgtctttcggaactcgggaccaggtcaccgtcgtacggtcacgcccaacggcccaacccnctcgtcactctcttcccaccctcctcgacgtcgcgtctcngacgcgggctggcacggcgnagtgnnnnnnnnnnn

SEQ ID NO: 188055 - DNA, 594 bp, Homo sapiens
  misc_feature: GYAE6OF01A99Y3.3.56.F01.1.454.CMB.1.raw
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (527)..(528): a, c, t, g, unknown or other
  misc_feature (527)..(528): n is a, c, g, or t
  modified_base (531)..(531): a, c, t, g, unknown or other
  misc_feature (531)..(531): n is a, c, g, or t
  modified_base (545)..(545): a, c, t, g, unknown or other
  misc_feature (545)..(545): n is a, c, g, or t
  modified_base (550)..(551): a, c, t, g, unknown or other
  misc_feature (550)..(551): n is a, c, g, or t
  modified_base (562)..(562): a, c, t, g, unknown or other
  misc_feature (562)..(562): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (588)..(588): a, c, t, g, unknown or other
  misc_feature (588)..(588): n is a, c, g, or t
tcagagacgcactccacgaccggtgctcgatttagcagacgtctgaacacacaaaaggggagagaggaaagacacacactggggtaactccaaggctgtgtgtggcacttgccttggacagcagacaggcacagggacacctctagggggctggccacccccctgcctcatgtctaggtcccagccccgccactgcaaccctgtcgcccgtcatcgcccagcaggcctcctgcctccacgccccacgccccccgagacgacgccaccgaccccgaggtcgccggtcgggtcccgggggttttgctgacgtcctcgtacttcctacgttggttgtttacgtcgttccgttacggaacgttcgggaaccgtaacggtccaccggtaccgtaggtccgacgcccgaaaccggccccaaacccctcgtcgaccaccttctccgttcccctaccctcctacggtctcgtccgttcctcgtcggacggccgggtcgtacgggcgaacgggtccacgtacgtacgntcgngtcnncgntcgactgcatcgcnctacnncgcacgcgacngtcgcacncgcncgcgacgtgcagcncgtgtc

SEQ ID NO: 188056 - DNA, 427 bp, Homo sapiens
  misc_feature: GYAE6OF02F6SM6.3.56.F01.1.454.CMB.1.raw
  modified_base (422)..(427): a, c, t, g, unknown or other
  misc_feature (422)..(427): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagccccagcccccagagagcagaccccaggtgctggccccgggggttttgctgagcctcattcactgtgttatgtcttcggaactgggaccaaggtcaccgtctaggtcagcccaaggcccaacccactgtcactctcgttcccgccctcctcgagtcgcgtctctgagcgggctggcaaggcgcatgnnnnnn

SEQ ID NO: 188057 - DNA, 452 bp, Homo sapiens
  misc_feature: GYAE6OF02H9R6O.3.56.F01.1.454.CMB.1.raw
  modified_base (365)..(365): a, c, t, g, unknown or other
  misc_feature (365)..(365): n is a, c, g, or t
  modified_base (433)..(452): a, c, t, g, unknown or other
  misc_feature (433)..(452): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagccccagcccccagacgagcagacccccaggtcgctcgggtcccccgggggttttgctgagcctcattcactgtgttatgtcttcggactgggaccaggtcaccgtctaggtcagcccaaggcccaacccnctcgtcactctcgttcccaccctctcagtcgccgttctctgacgtcgggctggacaaggcgacatagnnnnnnnnnnnnnnnnnnnn

SEQ ID NO: 188058 - DNA, 659 bp, Homo sapiens
  misc_feature: GYAE6OF02IRYAB.3.56.F01.1.454.CMB.1.raw
  modified_base (581)..(581): a, c, t, g, unknown or other
  misc_feature (581)..(581): n is a, c, g, or t
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (620)..(620): a, c, t, g, unknown or other
  misc_feature (620)..(620): n is a, c, g, or t
  modified_base (622)..(623): a, c, t, g, unknown or other
  misc_feature (622)..(623): n is a, c, g, or t
  modified_base (625)..(625): a, c, t, g, unknown or other
  misc_feature (625)..(625): n is a, c, g, or t
  modified_base (634)..(634): a, c, t, g, unknown or other
  misc_feature (634)..(634): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (650)..(650): a, c, t, g, unknown or other
  misc_feature (650)..(650): n is a, c, g, or t
  modified_base (657)..(658): a, c, t, g, unknown or other
  misc_feature (657)..(658): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccaccccctgcctcatgtctaggtcccagccccgccactgcaaccctgtcgcccgtcatcgccagcaggctcctgctccacgcccacgcccccagacgacgccaacgaccccagggtcgccgttcggggtcccccgggggtttttggcctggacgccgtcacgtttccacgttggttgtttactcggttccgtttacggggaaccgttcgggaacctaaacggggttccctaccggttccgtaagggtccaacggccccgaaaggaccccaaacccgaacgttcgaccttaaccgtcccgttacggtttacccccaacccgttcccgttacggacggttcccgtccgttaccgttccgtacggtaaccgggtccggggtaccgttacggggaaccgaaacggggtccgtaccgtaacgttaggcgtcngcggtactcggntccagntaccgnttcgngtcncgngcngnngncgacgtcgngtcgcgcgncncgtcncgtctcnnc

SEQ ID NO: 188059 - DNA, 499 bp, Homo sapiens
  misc_feature: GYAE6OF02JTDT2.3.56.F01.1.454.CMB.1.raw
  modified_base (386)..(386): a, c, t, g, unknown or other
  misc_feature (386)..(386): n is a, c, g, or t
  modified_base (472)..(472): a, c, t, g, unknown or other
  misc_feature (472)..(472): n is a, c, g, or t
  modified_base (475)..(499): a, c, t, g, unknown or other
  misc_feature (475)..(499): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccacccccctgcctcatgtctaggtcccagcccccgcccactgccaaccctgtcgcccgtcatgcccagcaggctcctgctccacgcccacgcccccagagacgcacgaccccaggtcgcgtcgggtcccccgggggttttgcgtgacgcctcattcacgtgtgttatcgtcttcggaactcgggacctaaggtccaccgtcctaggtccacgtcccgaacggcccaaccctntcgtcacttctcgttccccgcccttcctacgactcgtccgttctccgtcggacggtccgggctcgggcaacgggccgacagtacgncgnnnnnnnnnnnnnnnnnnnnnnnnn

SEQ ID NO: 188060 - DNA, 500 bp, Homo sapiens
  misc_feature: GYAE6OF02FU7K9.3.56.F01.1.454.CMB.1.raw
  modified_base (365)..(365): a, c, t, g, unknown or other
  misc_feature (365)..(365): n is a, c, g, or t
  modified_base (460)..(460): a, c, t, g, unknown or other
  misc_feature (460)..(460): n is a, c, g, or t
  modified_base (464)..(468): a, c, t, g, unknown or other
  misc_feature (464)..(468): n is a, c, g, or t
  modified_base (471)..(476): a, c, t, g, unknown or other
  misc_feature (471)..(476): n is a, c, g, or t
  modified_base (478)..(500): a, c, t, g, unknown or other
  misc_feature (478)..(500): n is a, c, g, or t
tcagagacgcactccacgaccggtgctcgatttagcagacgtctgaacacacaaaggggagagaggaaagacacacactggggtaactccaaggctgtgtgtggcacttgccttggacagcagacaggcacagggacacctctagggggctggccaccccctgcctcatgtctaggtcccagccccgcccactgcaaccctgtgcccgtcatgcccagcaggctcctgctccagcccagccccccagacgacgcagaccccaggtgctcgggccccggggttttggtctgacgcctcattcactgtgttatgttcttcggaactgggaccaaggtcaccgtctaggtcacgccaagcccaacccnctcgtacactctcgttccccacctcctcgagtcgcgtcctcgtcgaggcccggggtactcggggaccgtaaggggtccccgacgtaacgtacggnatcnnnnncgnnnnnncnnnnnnnnnnnnnnnnnnnnnnn

SEQ ID NO: 188061 - DNA, 550 bp, Homo sapiens
  misc_feature: GYAE6OF02FSSR4.3.56.F01.1.454.CMB.1.raw
  modified_base (326)..(326): a, c, t, g, unknown or other
  misc_feature (326)..(326): n is a, c, g, or t
  modified_base (400)..(400): a, c, t, g, unknown or other
  misc_feature (400)..(400): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (517)..(519): a, c, t, g, unknown or other
  misc_feature (517)..(519): n is a, c, g, or t
  modified_base (521)..(521): a, c, t, g, unknown or other
  misc_feature (521)..(521): n is a, c, g, or t
  modified_base (523)..(529): a, c, t, g, unknown or other
  misc_feature (523)..(529): n is a, c, g, or t
  modified_base (531)..(533): a, c, t, g, unknown or other
  misc_feature (531)..(533): n is a, c, g, or t
  modified_base (535)..(550): a, c, t, g, unknown or other
  misc_feature (535)..(550): n is a, c, g, or t
tcagagacgcactccacgaccggtgctcgatttagcagacgtctgaacacacaaaggggagagaggaaagacacacactgggggtaactccaaggctgtgtgtggcacttgccttggacagcagacaggcacagggacacctcgtagggggctggccacccccctgcctcatgtctaggtcccagccccgcccactcgcaaccctgtcgcccgtcatcgcccagccaaggcctcctcgcctccacgcccacgcccccagacacgcaacgaccccgaggtcgcgtcggggtccccgggggttttgcgtcgagcctcattcacttgtnttagtcgttcttacggaactgggaaccaagggtccaccgttcctaggtccgagcccgaaaggtcccaaaccccncttgtacctaccgtcttaccggttccccgtccccttccgtcgacgtcgtacccgtcgtccgttggacgtcccgggtctcgggaccgtaaacggcgccgtaatgggncgcngngcncnnncncnnnnnnnannncnnnnnnnnnnnnnnnn

SEQ ID NO: 188062 - DNA, 552 bp, Homo sapiens
  misc_feature: GYAE6OF01D9ONX.21.28.C06.1.454.CMB.1.raw
  modified_base (338)..(338): a, c, t, g, unknown or other
  misc_feature (338)..(338): n is a, c, g, or t
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggctgggttttcctcgctgtttctttttagaggtgtccactgtcaggtaacactggtggagtcgggggaggcgtggtccagcctgggacatccctgagactctcctgtttaggctctggattcagtatttggagacgccgccatgcactggtccgccaggctccaggcaagggtctcgagtggttgggatttanaacagtcgatcatattctcgaatttgcggctctgtgaggggccatgtagcatctcaggacaatcatacaatacagtctatctccaattgaacagtctcagacctgacgactacggcttatttattattgtgaccaagaactaccggcccgtaggacgggggccaccggtcggggaccccgggtaaccctcggtaccacccgtcgtcccgtaccg

SEQ ID NO: 188063 - DNA, 576 bp, Homo sapiens
  misc_feature: GYAE6OF01C6I49.21.28.C06.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgtttaggctctggattcagtatttggagacgccgccatgcactgggtccnccaggctccgagcagggtctcgagtggttggatttatacngtcatcatattctcgtaatttgcggtctcgtgtggaggggcctatgtagcatctcgaggacaattccatcaatactacgtctatctacctaattagaactacgtctacacgacctagaccgacgtacggacttatttattattgtgtaccaagaagtaccggcccgtacgggacgggggccgaccggtccggggacccgggtacccgtcgggtaccctacccgtccgtccgtaccg

SEQ ID NO: 188064 - DNA, 584 bp, Homo sapiens
  misc_feature: GYAE6OF01E0YLY.21.28.C06.1.454.CMB.1.raw
  modified_base (342)..(342): a, c, t, g, unknown or other
  misc_feature (342)..(342): n is a, c, g, or t
  modified_base (566)..(566): a, c, t, g, unknown or other
  misc_feature (566)..(566): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggcttgggttttcctcgcttgtttctttttagaggtgtccactgtcaggtaacactggtggaggtcggggggagcgtggtccagcctgggacatccctgagactctcctgtttaggctctggattcagtatttggagacgccgccatgcactgggtccgccaggctccaggcaagggtctcgagtggttggatttanaacagtcgatcatattctcgtaatttgcggtctcgtggtggaggggccgaagttgtagcagtctccgagggacaattccatacaatacagtactatctactaattgaactagtctacagacctagacgacacggtacttatttaattattgtgaccaaagaacgtaccggcccgtacgggacgggggcccacggtcggggccccgggtaacccgtcgggtaccncccgtccgtccgtacccg

SEQ ID NO: 188065 - DNA, 542 bp, Homo sapiens
  misc_feature: GYAE6OF01CCD1T.21.28.C06.1.454.CMB.1.raw
  modified_base (339)..(339): a, c, t, g, unknown or other
  misc_feature (339)..(339): n is a, c, g, or t
  modified_base (528)..(528): a, c, t, g, unknown or other
  misc_feature (528)..(528): n is a, c, g, or t
tcagtcgtcgctcgcacgaccggtgctcgatttagagctcacgtattgggtttgggggagaggagcccagcactggaagtcgccggtgtttccattcggtgatcagcacttgaacagagaggactcaccatggagtttgggctgggctgggttttcctcgctgttctttttagaggtgtccactgtcaggtaacactggtggagtcgggggagcgtggtccagcctgggacatccctgagactctcctgtttaggctctggattcagatttggagacgccgccatgcactgggtccgcaggctccaggcaagggtctcgagtggttgggatttataacngtcgatcattatctcgaaatttgcgggtctctgtggaggggccatgtagcatctcagggacaattccatcaaatacagtctatctccaattgaacagtctcagacctgacgacacggctatttatattgtgacaaagaatacggccctacggacggggccacgtcggggacccggtaaccctggtaccnccgtcgtcctaccg

SEQ ID NO: 188066 - DNA, 549 bp, Homo sapiens
  misc_feature: GYAE6OF01E389H.21.28.C06.1.454.CMB.1.raw
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgtttaggctctggattcagatttggagacgccgccatgcactgggtccgccaggctccaggcaagggtcncgagtggttgggatttanaacagtcgatcatattctcgaatttgcgggctctgtgaggggccatgtagcatctccagggacaattccatcaatacagtctatctccaattgaacagtctcacgacctagacgacacggctatttattattgtgccaagaatacggcccgtacggacgggggccacgtcggggccccgggaacccgtcggtccacccgtctcccgtaccg

SEQ ID NO: 188067 - DNA, 559 bp, Homo sapiens
  misc_feature: GYAE6OF01AMGXW.21.28.C06.1.454.CMB.1.raw
  modified_base (336)..(336): a, c, t, g, unknown or other
  misc_feature (336)..(336): n is a, c, g, or t
tcagtcgtcgctcgcacgaccggtgctcgatttagagctcacgtattgggtttggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcgggggagcgtggtccagcctgggacatccctgagactctcctgtttaggctctggattcagatttggagacgccgccatgcactgggtccgccaggctccaggcaagggtctcgagtggttgggatttanaacagtcgatcatattctcgaatttgcggctcgtgtgaggggccatgtagcatctccagggacaattccatacaatacagtctatctaccaattgaacagtctcagacctgacgacacgacttatttattattgtgaccaagaataccggcccgtggacgggggcccacggtccggggaccccgggtaacccgtcgggtacccgacccggtcctcccgtaccg

SEQ ID NO: 188068 - DNA, 607 bp, Homo sapiens
  misc_feature: GYAE6OF01CXCLL.21.28.C06.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagagctcacgtattgggtttggggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgttttaggctctggattcagtatttggagacgccgccatgcacgtgggtccgccaggctccaggcagggtctcgagttggttgggatttanaacagtcgatcatattctcgtaatttgcgggtctcgtgtggaggggccagtgtagcatcgtcaggactaactccatacaaatacagtctactctacctaatagaacatctacacgacctgaacgacgaccgtctttaatttattacttagtacgtaccgaaagtaactacccggtcccgtacgggaccggggggtcccgacgggtacccgggggaccccggggtaaccccggtcgggtacccgtacccgttccgtcccgtacccg

SEQ ID NO: 188069 - DNA, 598 bp, Homo sapiens
  misc_feature: GYAE6OF01CGXVD.21.28.C06.1.454.CMB.1.raw
  modified_base (344)..(344): a, c, t, g, unknown or other
  misc_feature (344)..(344): n is a, c, g, or t
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcgggggagcgtggtccagcctgggacatccctgagactctcctgtttaggctcgtggattcagtatttggagacgccgccatgcacgtgggtccgccaggctccgaggcaagggtctcggagtggttggatttataacngtcgatcatacttctagaagtttggcggtctcgtggtggaggggcctatggtagctatcgtcgagggactaatccatacaatacagtctactctactaattgaactacgtctacacgtacctagacgacgtacggtacttatttattattgtacgacctaagaacgtaccggtcccgtacgggacgggggtcccgacgggtccggggaccccgggtaacccgttcggtacccgtcccggttccgtcccgtaccg

SEQ ID NO: 188070 - DNA, 701 bp, Homo sapiens
  misc_feature: GYAE6OF01BANUG.21.28.C06.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagagctcacgtattgggtttggggggggagaggagcccagcactggaagtcgccggtgtttccattcggtgatcagcactgaacagagaggactcaccatggagtttgggctgggctgggttttccncgctgtttcttttagaggtgtccactgtcaggtaacacgtggtggaggtcgggggagcgtggtccagcctgggacatccctgagacttctcctgtttaggctcgtggtattcgagtatttggagacgccgccatgcacgtgggtcccgccaggcctccgaggcaagggtctcggaggtggttgggatttagaacaggtctaatctattacttctacgtaatttggaccggtcttcgtggtggacggggtcccgtagttggtaacgctacgttcctaccggtaaggggtaacctaaacttccccgaattaccctaaattaaccgaacgttactaacttcctaacctaagttacgaacctacgtactaccacgaccctacggaccgaaccgtacggtactttaactttagtttacgttcggtacgaccgtaaagtaaacgttacccggtacccgtacgggaacggggggtccctaacgggtcccgggggaccccgggtaaccccggttacgggtacccgtacccgttcccgtcccgtacccgg

SEQ ID NO: 188071 - DNA, 602 bp, Homo sapiens
  misc_feature: GYAE6OF01B51FC.21.28.C06.1.454.CMB.1.raw
  modified_base (344)..(344): a, c, t, g, unknown or other
  misc_feature (344)..(344): n is a, c, g, or t
  modified_base (377)..(377): a, c, t, g, unknown or other
  misc_feature (377)..(377): n is a, c, g, or t
tcagtcgtcgctcgcacgaccggtgctcgattagagctcacgtattgggtttggggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggaggtcggggggaggcgtggtccagcctgggacatccctgagactctcctgtttaggctctggattcagtatttggagacgccgccatgcacgtgggtccgccaggctccgaggcaagggtctcggagtggttgggatttanaacagtcgatcatattctcgtaatttggcggtntcgtggtggacggggccagtgtagcatctcgaggacactccatacaatacagttctactctactaattacgaactacgtctacacgactacgacgacgtacgtacttaatttattagttgtacgtaccgaaagtaacgtaccggtcccgtacgggacgggggtccgaccgggtcggggacccccgggtaacccggtcggtacccgacccgtccgtcccgtacccg

SEQ ID NO: 188072 - DNA, 830 bp, Homo sapiens
  misc_feature: GYAE6OF01CSABD.21.28.C06.1.454.CMB.1.raw
tcagtcgtcgctcgcacgaccggtgctcgattagagctcacgtattgggtttgggggggagaggagcccagcactggaagtcgccggtgttccattcggtgatcagcactgaacagagaggactcaccatggagttgggctggcgttgggttttcctcgtcgttgtttctttttaggaggtcgtccactgtcgaggtaacacgtgggtggagggtcgggggagcggtcggtccaggtccgtagggacacgtcccgtaggacgtacctcgttccgttggttacgctcgtggattcgagttagttggaacgtccgccgaccagtcggactaccggtcgggtccccgccgtaggtccctaccggaggaccgtaacgggtccgtacggtagggtttcgggtaggttacttttaacgaacggtaggtactaacttaccgtaatttaccgttaccggttaacggttaacggtttcgggccggttaccttcggttgggggttacgggaccggggtaccgtagttacggtaacgtaccgtaccgttacggtacccggtaacgggttaacctaaccgtttacccaacttaacgtaaacttaccgtacgttacttaccttaccgttaacctaagttacgtaacttcgtacgtaccgtaacgtaccgtacaacccggaccgttaacgttacttaagttttcgtacgttcgtaacgtacctaaacgggtaccgtacccgggtccccggttagggggacccgggtccggtacccggggtacccggggtaccccggtaaccccggttaggtacccccgtcccgttcccgtaccccgtacccggg

SEQ ID NO: 188073 - DNA, 927 bp, Homo sapiens
  misc_feature: GYAE6OF01DKXJD.21.28.C06.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagagctcacgtattgggtttggggggggagaggagcccagcactggaagtcgccggtgtttccattcggtgatcagcactgaacagagaggactcaccatggagtttgggctgggcttgggttttcctcgcttgtttctttttagaggtgtccactgtcaggtaacacgtgggtggaggtcggggggaggcggtggtccaggccgtgggacacgtccctgacgtacctctccgttggtttacggccttcgtaggtatttcgaagtattttgggagtaccgcccgccagttgcctacgtcggggtcccgccgaggcctaccgagggcgaacggggttcctacggagggttggggtttagggtaattttaacgtaaacgnggttacgtaattctaattactttccgtacggtaattttcgggaccgggtctttcgtggtcggggaggggggtcctaggttgtacggacctacgttaccgtaccggaacgggtaacttaacgttaccccaaagttaaccctaaacgttaactaacggtttaaccttaaccgtttaccttaacccgtaaaagtttttaccggaaaaccgtttaaccggttaccttaaccgaaccggttaacccgttacgggaaacccggtaacccgttaaccggtaacccgtttttaaagttttttaacgttttaagtttaccgggttacggtaaacccgtaaaacgggtaaaacccggttaaccccggggtaccccccgggttaacggggggaacccggggggggttacccccggtaaaccgggggttccccccgggggggaaaccccccgggggttaacccccgggttacccggggttaacccccgttaacccccgggtttccccgttacccccggttaaccccgg

SEQ ID NO: 188074 - DNA, 884 bp, Homo sapiens
  misc_feature: GYAE6OF01CIYKE.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggcttgggttttcctcgcttgttctttttagaggtgtccactgtcaggtaacactggtggaggtcggggggagcgtggtccagccgtgggacatccctgagactctcctgtttacgctcgtggattcgagtagttttggacgtaccggcccgaccagtgaccacgtcggggtcccgccgacggcctacccgagggaccgtaaggggttcctacggtaggttggggtttagggtaattttaacgtaaaccgaggttaccgaagttacctaagtttactttccgtacggttaaacgtttttcgggacccggggttcctttcggttagggtacggggtaacggggggtcccgtaagtttggtaacgtccgtaacttcccgtacccggtaacggggtaaaccttaaccgtttaacccctaacgttaaccctaaacgttaacccgttaaacggtttaccctttaaccgttaccctttaacccgtaaacgttttacggaaaccttaacgttacccttaaccgtaaccgttacccgtaacggtaacccggtaacccgtaccggttacttttaaacgtttttaacgtttacgttacggttacgtaacccgtaaaacggtaaaccgttaacccgggtaccccggttaaccgggggaccggggggtaccccgtaccggggtacccgggggaccccccgggtaaacccggttccgggtaccccgtaccccggttcccgttcccgtacccg

SEQ ID NO: 188075 - DNA, 715 bp, Homo sapiens
  misc_feature: GYAE6OF01DZ2JQ.21.28.C06.1.454.CMB.1.raw
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggaggtcggggggagcgtggtccagcctgggacatccctgagactctcctgtttaggctcgtggattcagtatttggagacgccgccatgcactgggtccnccaggctccgaggcaaggggtctcgagtggttgggatttanaacagtcgatcatattctcgtaatttggcggtctcgtgtaggacggggcccgtatggtaagcaagttccttaccgaagggtacctaacgttcccgtaataacctaaataacctaacggttaccttaacgttaccttaaccctaaagtttacgaaaccgtacgttacctaccaacggtaacccgtaggtaacccggaacctaacgggtacctttaagttttaactttagtttcgtacgtaaccgtaaacggtaaacttacccgggtaccccgttacgggggtaacgggggggacccctaaccgggttccgggggaaccccccgggtaaaccccggttcgggtaccccgtaacccggtcccttccccgtacccgg

SEQ ID NO: 188076 - DNA, 761 bp, Homo sapiens
  misc_feature: GYAE6OF01EIQD4.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgcttgttctttttagaggtgtccactgtcaggtaacactggtggaggtcgggggagcgtggtccagcctgggacactccctgagacctctccttgtttaggctcgtggattcagtatttggagacgccgccatgcacgtcgggtcccgccgaggcctccgaggcgaaggggtcctcggtaggttgggtttgggtaattttaagtaaacgtaggttacgtaatctaattatttcgtacgttaagtttcgggccgggtcttcgttggtacgggacgggggtccctaagttggtacgactacgttccgtaccggaacgggtaactaaccgtttaccaattactaaactacgtaacgttacctaacttaccttacctaacttacgaactacgttactaccgacgtaacccgtacggaaccgaccgtaacggtactttaacgttttaacgtttaacgtttcggttaccgtaccgtaaaacggtaaaccggttaacccgggtaccccggtaccggggtacggggggaccccgtaccggggtacccggggtaccccggggtaaccccggttaccgggttacccggtacccgttcccgtcccgtacccg

SEQ ID NO: 188077 - DNA, 895 bp, Homo sapiens
  misc_feature: GYAE6OF01D724X.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggtcttgggttttcctcgcttgtttctttttaggaggtgtccactgtcaggtaacagtggtggaggtcgggggagcgtggtccagccgtgggacactcccgtgacgtaccttctccgttggtttacggccttcgtggtattcgaggtagtttgggacgaccggcccgccagtcgcctacgtcggggtcccgccgagggcctccgagggacgtaaggggtcctacgggtaggttgggtttagggtaatttttacgaaaacgtacggtaccgtaattcctaattactttacgtacggttaagttttcggggccgggttacctttcggtagggttcgggaacggggggtaccctagtttaggtacggtaccttaacgtttaccggtacccggtaaggggttaaacccttaaaccgttttacccgtaaacttaacccgtaaacgttaacccgtaacggtttaccctttaaccgtttacccgttaacccgttaaacgttttacgaaaccttaacggtttaccttacccggaaacgtaccccggttaacggaacccggtacgtaaccgggtttacttttaacgttttaacgtttacgtttacggtaccgtaacccgtaaaacggtaaccggttaacccgggtcccccggttaacggggggacccgggggtaaccctacccgggggttacccgggggaaccccccggtacccgggttaccggttacccggtaccccggttccgtcccccgtaaccgg

SEQ ID NO: 188078 - DNA, 812 bp, Homo sapiens
  misc_feature: GYAE6OF01BX8CJ.21.28.C06.1.454.CMB.1.raw
  modified_base (159)..(159): a, c, t, g, unknown or other
  misc_feature (159)..(159): n is a, c, g, or t
  modified_base (312)..(312): a, c, t, g, unknown or other
  misc_feature (312)..(312): n is a, c, g, or t
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggcttgggttttccncgcttgtttactttttagaggtgtccactgtcgaggtaacacgtggtggaggtcgggggagcgtggtccagtccgtggacatccctgacgtactccgtccttggtttacgctcgtggtattcgagtagtttggacgaccgcccgaccatcgcncgtcgggtcctccgaggtcctacgaggccgaaggttctcggtaggtggttaggtatttacgaacgtcgtacgacttctaagttattaccgtacgtaagtttcggacggttcttaccgtgggtacggacggggtacccgtagttcggaactcctacgttcccgtaccggtaacgggtaaccttaaccgttacctaacgttacgtaaaacgttaccgttaacgtaccttaacttacccgttaacgtaacgtttaggaaacccttcgttcccgtaaccaaccggtaaccgttaacggaaccgtacccgttaaccggttacctttaattttaacgttacggttgttaacccggtaactaaaccgggtaacccgttaaccccggggtacccggtaccggggtaacccgggggtacccgtaccggggttaccccgggggtaacccccgggttaccccgtacgggtaccccggttaacccccgtccccggtttcccggtaaccccgg

SEQ ID NO: 188079 - DNA, 821 bp, Homo sapiens
  misc_feature: GYAE6OF01CT9FZ.21.28.C06.1.454.CMB.1.raw
tcagtcgtcgctcgcacgaccggtgctcgattagagctcacgtattgggtttggggggggagaggagcccagcactggaagtcgccggtgtttccattcggtgatcagcactgaacagagaggactcaccatggagtttgggctgggcttgggttttcctcgcttgtttctttttagaggtgtccactgtcaggtaacacgtggtggaggtcggggggaggtcgtggtccaggccgtgggacatccctgacgacctctccgttagtttacggctcgtggtattcgagtagtttggagccgccgaccagtcgcacgtcgggtccgccgacggcctaccgaggcgtaagggtcctacggtaggttgggttagggtactttaataacgtagtcgatctattacttctacgtaacgtttggcggtcttacgtggtacgggacggggccgtagtacggtacgacctacgtccgtaccggaacgggtaacctaacgttacccaagttaaccaaacttaaccgtaacgttaccttaacttacccttaaaccgttaagttaacggaaacctacggttaccctaacgtaaccgtaacccgtacgggaaccgtaaccgtaaccggtttacttttaaacgttttaagtttacgttacggttaaccgaaacccggtaaaacggttaacccggttaacccgggggtaccccggttaccggggggacccggggggttaccccgtaacccgggggttacccccgggggtaacccccgggtaacccggttacccgggttacccggtaaccccggtttcccgtccccggtaaccccgg

SEQ ID NO: 188080 - DNA, 825 bp, Homo sapiens
  misc_feature: GYAE6OF01D2LCO.21.28.C06.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggtagtttgggctgggcttgggttttcctcgcttgttttctttttaggaggttcgtccacttgtacgaaggtaacacgtgggtggagggtccgggggaggtcgtcggtccagccgtgggacnctccgtgacgtccttctcttagttacgctgtggtattcagtagttggacgaccgccgcctatagctacggtccgggtacccgccgaacggccgtaccgacgggacgtacggggtcctacggaggttcgggttaggtaattttaacgaacgtacggtacgtaatctaattaccgttacgttaccggttaaacgtttcgggaccgggtcttcgtaggggtacggacgggggtacctaggttgtaacgcgtaaccgttcgtaaccggtagggtaaccttaacgtcctaactaacgtaactaccgtaacgttacctactaaccttacctaaactttacggtaaacctcggttacctaaccgtaacgtaacccggtacgaacccggtaaccgtaacgttaacttttaacgttttaattacgtttcgaaccggtaaccgtaaacgtaacccgttaccgggtaccccggttaccgggggtaaccggggtcccgtaacccggggttaccccggggaaacccccggggtacccgttaaccgggttaccccctaacccggtttccccgccgttacccccgg

SEQ ID NO: 188081 - DNA, 905 bp, Homo sapiens
  misc_feature: GYAE6OF01DSKJQ.21.28.C06.1.454.CMB.1.raw
tcagtcgtcgctcgcacgaccggtgctcgattagagctcacgtattggggtttgggggggagaggagcccagcactggaagtcgccggtgttccattcggtgatcagcactgaacagagacggactcaccagtgggtaggtttgggcgtgggtcgttgggttttcctcgtcttgttttcgtttttaggaggtcgtaccacgtcgtacgaaggtaacacgtgggtggggagggtcgggggggaggcggtcggtccgagtccgtgggactactccgtgacgtacctctccgttgttacgctcgtaggtacttcgagtacgttaggacgccggccgcctagtcgaccgtaccggtcgggtccgaccgtacggcctaccggacggggtaccggtaacggggttccgtaccgggtagggtttgggggtttaggttaaacttttaacgtaaacggtacggttaccgtacttacgtaacgtttacgttttaccgtacggtttaacggttttcgggccggttcgttttacggttggggtacggggacggggtacccgtttaaggttacggtaaccgaccgtttacggttacccggttaacccgggtaaccgggttaaaccgttaacccgtttaacccgtaaacttaacccgttaaacttaaccgttaaaccgttaccgtttaactaaccctttaaccgttaaacgttaccgtaaccgttacgtttaccgtaccgttaaccggtccgaaccggtaacccgtacgttacggtttaaccttttagtttacttacgttacggtacgaacgtaaaccgtacggtacccggtcccgggtacggggacccgggtcccgtaccggggtcccggggacccccggtacgttacccggacccgttccccgtcgtcccgtacccg

SEQ ID NO: 188082 - DNA, 676 bp, Homo sapiens
  misc_feature: GYAE6OF01CQHC7.21.28.C06.1.454.CMB.1.raw
tcagtcgtcgctcgcacgaccggtgctcgatttagagctcacgtattgggtttggggggggagaggagcccagcactggaagtcgccggtgtttccattcggtgatcagcactgaacagagaggactcaccatggagtttgggctgggcttgggttttcctcgcttgttctttttagaggtgtccactgtcaggtaacactggtggaggtcggggggaggcgtgggtccagcctgggacatccctgagactctcctgtttaggctctggattcagtatttggagacgccgccatcgacacgtgggtccgccgaggctaccgagggccaaggggtctcggtaggttgggttagggtattttaataaacgaggtccgtaatacattaactttctacggtaatttcgggccgggtcttcgtggtggacgggggtccagtcggtaagcaattccgtaccgaacgggactaacttacctaataccaatactaagtcttatcctacctaattacgaactagtactacgacgtactacgaacgaaccgtacgtacttaatttaatttagttcgttacgacctaaagaacgtaacccggtcccggtacgggacggggggacccgacggtaccgggggaaccccgggtacccggtacggtacccgtacccgtccgtcccgtaccg

SEQ ID NO: 188083 - DNA, 815 bp, Homo sapiens
  misc_feature: GYAE6OF01BX6XQ.21.28.C06.1.454.CMB.1.raw
  modified_base (103)..(103): a, c, t, g, unknown or other
  misc_feature (103)..(103): n is a, c, g, or t
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
tcagtcgtcgctcgcacgaccggtgctcgattagagctcacgtattgggtttggggggggagaggagcccagcactggaagtcgccggtgtttccattcggtnatcagcactgaacagagagactcaccatggagtttgggctgggcttgggttttccctcgtcttgtttctttttagnggtcgtccatgtcaggtaacngtggtggaggtcgggggagcgtcggtccaggccgtgggacactcccgtagacgaccttccgttccgttaggtttacggccttagtaggtaccttttagaaggttagtttgggaaccggtacccgcccgtaccagttcgaccgtacgttccggggtccccgaccgtacggccctaccggagggaccggtaagggtccgttacggtaggtttgggttaggtaagttttaacgtaacgtacgggttactaacttacgtaactttacttccggttaacgtaagttttcgggaccggttcttcggtagggttagggaccggggtctaggttggtaacgtcctagttcccgtacggaacgggtaacctaaccgttacctaacttaacccgaagttaaaccgtcgtttaacccgtttaacttacccttaaccgtaaagtttaaccgaaccgttacggttacctaccgaaccgtacccgtaacgaaccgtaccgttaaccgtatttttaactttacgtactttacgtacgaacgtaaacggtacggtacccggtaccggtacggggacggtccggaccgggtaccgggcccggtaccgcgttcccgacgttccctccgtcccg

SEQ ID NO: 188084 - DNA, 869 bp, Homo sapiens
  misc_feature: GYAE6OF01CYGWG.21.28.C06.1.454.CMB.1.raw
tcagtcgtcgctcgcacgaccggtgctcgatttagagctcacgtattggggtttggggggggagaggacgcccagcactggaagtcgccggttgtttccattcggtgatcagcactgaacagagaggactcaccagtgggtaggtttggggctgggtctttcggggtttttccctcgctttagtttcttttttaggaggttcgtccctagttgtacgaagggtaaactcggtgggtggggacgggttcgggggggacggtcggtgggtccctaggccggtgggaacctacgttcccgtagaacggtaccttccgttccgttgggttttacggccttcgtgggtaatttccgagtttagttcgggacgtacccgtacccgcctagtcggaccgtaccgttccggggtacccggccgacggtacccgtccgaacggtacggacgggttctcgggtaggtttgggtttagggtattaacgtactacggttctagtacctaagttccgtttacgttacggttaatttcggggtcggtcgtttaccggtgggtacggggacggggtccgtaaggttccggtacgacgttaccggtaccgtaccggtaacggtaacctaacgtttaccagttaacctagtaaccttacgtactttactaccgttactaacgttacgaacgttacgtacgtacgtacgtaccgacgtacccgtacgtacgttatttaccgttttaagttcgttaacggtaccgtaaccgtaaacggtaaccgtacccgggtaccggtacggggtacccgggtacccgggtccggggtaaccccggggaccccggtacccgggttacgtaccccggttccgtaccgtcccggtaccg

SEQ ID NO: 188085 - DNA, 858 bp, Homo sapiens
  misc_feature: GYAE6OF01AJ7IB.21.28.C06.1.454.CMB.1.raw
  modified_base (164)..(164): a, c, t, g, unknown or other
  misc_feature (164)..(164): n is a, c, g, or t
  modified_base (209)..(209): a, c, t, g, unknown or other
  misc_feature (209)..(209): n is a, c, g, or t
tcagtcgtcgctcgcacgaccggtgctcgatttagagctcacgtattggggtttggggggggagaggagcccagcactggaagtcgccggtgtttccattcggtgatcagcactgaacagagaggactcaccatgggtagtttgggctgggcttgggttttccncgtcgttgtttcttttaggaggtcgtccacgttgtcgaggtaacncgttgggtggacgggtcggggggagtcggttcgggtcccaggcccgttaggggacctaccgtcccgttggaacctacctttcgtcccgttggttttaaccggccttcgtacgggttacttaccgtaaggttagttacgggacggtaccgtccccgtaccgagttcgtaccggtaccgttccggggtcccgaccgtacggacctcccggaacggtccggtaacgggttcccgtagggtggggtttacgggtttagggttaacttttaaacggaacgtacgggtacgtacgttacctagttactttacccggttacgttaaacgtttcgggtacggttccttcggttacgggtacgggtaccgggggtcctaggttacggtacggtcctacgtacccgtacggaacgggtaacctaccgttacgtacctaactaacggttactacgtacttcttaccgtaccttaagtacgtaaccgttcgaacgttcgaaccggtacgtacggtaccggtaacgttacgttacttaagttttaccttagttccgtaccacggtaaacgtccggtaccggtaccgggtcgggacggtacccgggtaccgggtacccgggaccccggtaccgcggttaccccgaccttcccggcccgtacgg

SEQ ID NO: 188086 - DNA, 774 bp, Homo sapiens
  misc_feature: GYAE6OF01B30TH.21.28.C06.1.454.CMB.1.raw
tcagtcgtcgctcgcacgaccggtgctcgattagagctcacgtattgggtttggggggggagaggagcccagcactggaagtcgccggtgtttccattcggtgatcagcactgaacagagaggactcaccatggagtttgggctgggcttgggttttcctcgcttgtttctttttaggaggtgtccactgtacaggtaacacgtgggtgggagggtcgggggggaggcggttcggtccaggccgtagggacctactcccgtagacgtaccttcctccgttaggtttacggtctcgtggtacttcgagtagtttaggacgaccgcccgaccagtcggacctaccgtcgggtcccgaccgacggccgtaccgagggacgtaacggggtccgtacggtagggttcggggtttagggtaacttttaacggtaaaccgtaggttaccgaacgtttactaatttacgtttacgttacggttaagttttcgggccgggtcctttccggtgggtcgggacggggtaccgtagttacggtagcctacgtccgtaccggaggtaactaacgttaccaacttacaaacgttacgtactttactacttacctacgtaacttacgaactacgtacctacgacgtacctacggaccgacgtaacgttctttaatttagttattacgtacgtacctaaagtaacgtacccggtccggtacgggaccggggtccgaccgggtcccggggaccccggtaccgtacggtacccgtccctccgtcccgtaccg

SEQ ID NO: 188087 - DNA, 834 bp, Homo sapiens
  misc_feature: GYAE6OF01B8BBB.21.28.C06.1.454.CMB.1.raw
  modified_base (188)..(188): a, c, t, g, unknown or other
  misc_feature (188)..(188): n is a, c, g, or t
  modified_base (597)..(597): a, c, t, g, unknown or other
  misc_feature (597)..(597): n is a, c, g, or t
tcagtcgtcgctcgcacgaccggtgctcgattagagctcacgtattggggtttgggggggagaggagcccagcactggaagtcgccggtgtttccattcggtgatcagcactgaacagagaggactcaccgatggtagtttgggctgggtcgttgggttttccctcgtctttgtttcgtttttaaggnggttcgtcctacgttggtaccgaacgggtaaacctacggtggggtacgggacggggttcggggggggacggtaccggttcggtccgacggtcccggtagggacctaacgttccccgtaggaaccgtacctttcccgtttccgttacgggttttacggccgttccgtaagggttactttaccgaaggtttaggtttacgggaaccgtaacccggccccggaccgtaagttcgaccgtacggtcggggtccccgaccgtaccggccctaccggacgggtaccgtacgggttccgtacgggtagggtttggggtttaacggtaattttaaacgaaacgtagttcgaattactaacgttacttacgtacggttaagttcgggcggttctcggtaggcggacggtcagtggacncgtcgtcgacggagtaactactccgtatacgaagttactagtaccttaaccttctaacgttaaacgtccaacgttcgtccgtagtaacacgtaacgacgtacgtacgtttaacttatttacgtacgttcgaacgtaactaacggtaacctaaccgggcccggtaaggggacccgggttccggaccgggtccgggaaccccggttcccgtaccggtcgaccccgttcgtacctaccgg

SEQ ID NO: 188088 - DNA, 945 bp, Homo sapiens
  misc_feature: GYAE6OF01A157P.21.28.C06.1.454.CMB.1.raw
  modified_base (103)..(103): a, c, t, g, unknown or other
  misc_feature (103)..(103): n is a, c, g, or t
tcagtcgtcgctcgcacgaccggtgctcgatttagagctcacgtattgggtttgggggggagaggagcccagcactggaagtcgccggtgtttccattcggtnatcagcactgaacagagaggactcacatggagtttgggctgggtcttgggttttcctcgtcttgtttcgtttttaggaggtcgtccacgttgtacgtaaggtaacctacgtgggtacgggaggggtccggggggaggtccggtcggtacccgaggccgtgggaacctactcccgtgacgtaccttccttccgttgtttacggtcttacgtggtacttacgagttacgttaggaccggtaccgccgcctagtccgacctaccggtcgggtcccggaccgacggtccgtaccggacgggtaccgtaacggggttccgtacgggtaggtttcggggtttaaggttaacttttaaacgaacgttacggtaccgtattaactaacttacgttttacgtacggtttaacgtttcgggacccggttcttacggttacgggtaggggaacggggtccgttaagtacgtacgtcgtaccgttaccggtaccggtaacggtaaccgttaccttactaacgttaaccgtaaacttaaccggtaactttaacctttacttaacccgttaacctttaacgtacgtaaaccgtacgttaccgtaccgaaaccggtacccgtaacggtaacccggtacgttaaccgtttaacttttaaacgttttaacgtttacggttaacgtaccggtaaaccttaaaccgggtaaacccgttaccccggggcccgggttaacgggggtaaccccgggggttcccgggttaacccgggggtaaccccccggggttaccccggggtaacccgggttacccgggttacccccggttaccccggttcccgttaaccccggtaaccccgg

SEQ ID NO: 188089 - DNA, 720 bp, Homo sapiens
  misc_feature: GYAE6OF01DCFVH.21.28.C06.1.454.CMB.1.raw
  modified_base (105)..(105): a, c, t, g, unknown or other
  misc_feature (105)..(105): n is a, c, g, or t
  modified_base (162)..(162): a, c, t, g, unknown or other
  misc_feature (162)..(162): n is a, c, g, or t
  modified_base (203)..(203): a, c, t, g, unknown or other
  misc_feature (203)..(203): n is a, c, g, or t
  modified_base (525)..(525): a, c, t, g, unknown or other
  misc_feature (525)..(525): n is a, c, g, or t
  modified_base (617)..(617): a, c, t, g, unknown or other
  misc_feature (617)..(617): n is a, c, g, or t
  modified_base (639)..(639): a, c, t, g, unknown or other
  misc_feature (639)..(639): n is a, c, g, or t
  modified_base (709)..(709): a, c, t, g, unknown or other
  misc_feature (709)..(709): n is a, c, g, or t
  modified_base (715)..(715): a, c, t, g, unknown or other
  misc_feature (715)..(715): n is a, c, g, or t
tcagtcgtcgctcgcacgaccggtgctcgatttagagctcacgtattggggtttggggggggagaggagcccagcactggaagtcgccggtgtttccattcggtnatcagcactgaacagagaggactcaccatggagtttgggctgggcttgggttttccncgcttgtttctttttagaggtgtccagtgtacgaggtaacncgtgggtgggagggtccggggggagtcgtggtccaggcccgtgggacactcccgtagaacgtccttccttcccgttaggtttacggcctttccgtaggtattcgaagttagtttagggaacgtacccggccgaccctaatcggacctaccggtcggggtaccccgaccggtacggccttacccggaagggtaccggtaaacggggttcctacggggtaagggtttgggggtttaacgggttaacttttaaacgaaccgttagtacggtacttacctatttacgtttcgttacgtaacgtttcgggccggtcttaagtcgggngggacggggctagtcgtagcctatccgacggtaggacttaactccgatactaagtacgatctatactaccgtatacgactgctacgacaccngggaccacgtgtactttatttntacttggacaacgaagtaccggtaccggtccggacgggcgggacctcgggtccggacccgtacgcgtccncgtccncgacc

SEQ ID NO: 188090 - DNA, 566 bp, Homo sapiens
  misc_feature: GYAE6OF02GD3XV.21.28.C06.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggaggcgtggtccagcctgggacatccctgagactctcctgtttaggctctggattcagatttggagacgccgccatgcactgggtccgccaggctccaggcaagggtctcgagtggttggatttanaacagtcgatcatattctcgaatttgcgggctctgtgaggggcatgtagcatctcaggacaattcatcaatacagtctatctccaattagaacagtctcacgacctagaccgacacggtcttaatttaattattgtacgaccaagaacgtaccggtcccgtaccggacggggggcccgacggtacggggcccgggaacccgtcggtcccgacccgtccctcctacccg

SEQ ID NO: 188091 - DNA, 592 bp, Homo sapiens
  misc_feature: GYAE6OF02H3GWG.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgtttaggctctggattcagatttggagacgccgccatgcactgggtccgccaggctccaggcaagggtctcggaggtggttgggatttataacgagtcgatcatattctcgtaatttggcggtctctggtggaggggccatggtagctatccgtccgagggactaacttccatcaatacagtacttactcctacctaattgaactagtactcacgacctacgacgacacggtcttaatttattattgtcgtaccaacgaacgtaccggtcccgtaccgggacgggggccgaccggtccggggacccgggtaacccgtcggtccgacccgtcctcccgtaccg

SEQ ID NO: 188092 - DNA, 566 bp, Homo sapiens
  misc_feature: GYAE6OF02FF6TJ.21.28.C06.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgtttaggctctggattcagtattggagacgccgccatgcacgtgggtcccgccaggcctccgaggcaaggggtctcggagtgggttgggatttanaacagtcgatcatattctcgaatttgcggctctggtgaggggccatgtagcatctccaggacaattccatacaatacagtctatctaccaattgaacagtctcagacctcgacgacacggtacttattattattgtcgaccagaacgtaccggtcccgtcgggacgggggcccgacggtcggggaccccgggaccgtcggtccacccggtcctccgtaccg

SEQ ID NO: 188093 - DNA, 591 bp, Homo sapiens
  misc_feature: GYAE6OF02G5TO7.21.28.C06.1.454.CMB.1.raw
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggaggcgtggtccagcctgggacatccctgagactctcctgtttaggctctggattcagtatttggagacgccgccatgcacgtgggtccgcaggcctccgaggcaagggtctcggagtggttggatttanaacngtcgatcatattctcgtaatttggcgggtcttcgtggtggaggggcctatggtagctagtcctccgagggactaacttccatacaatacagtctatctacctaattgaacagtctcacgtacctagacgacacggtacttatttattattgtagacctaagtacgtaccggcccgtacgggacgggggcctaccggtcggggaccccgggtacccggtcggtcccgaccggtcctacccgtaccg

SEQ ID NO: 188094 - DNA, 542 bp, Homo sapiens
  misc_feature: GYAE6OF02FV34M.21.28.C06.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttcttttagaggtgtccactgtcaggtaacactggtggagtcgggggagcgtggtccagcctgggacatccctgagactctcctgtttaggctctggattcagatttggagacgccgccatgcactgggtccgccagctccaggcaagggtctcgagtggttgggatttanaacagtcgatcatattctcgaatttgcggctctgtgaggggccatgtagcatctccaggacatccatcaatacagtctatctcaattgaacagtctcagacctgacgacacggtcttattattattgtcgacctaagaatacggccctacggacgggggaccacgtcggggacccgggaaccgtcggtaccaccgtctcccgtaccg

SEQ ID NO: 188095 - DNA, 607 bp, Homo sapiens
  misc_feature: GYAE6OF02GWR6L.21.28.C06.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgttaggctctggattcagtatttggagacgccgccatgcactgggtccgccaggctccgaggcgaagggtctcggagtggttgggatttataacngtacgatcatattctgaatttgcggctctgtggaggggccagtgtagcatctcgacggactaacttcatactaatacagtactatctacctaattacgaactgtctcacgacctgaccgacgacggtacttaactttaattagttgtcgtaccaagtaacgtaaccggtcccgttaacgggacgggggtcccgtaaccggttcccgggggtaccccggtacccggttcggtcccgtacccggttacccgtccctaaccccgg

SEQ ID NO: 188096 - DNA, 580 bp, Homo sapiens
  misc_feature: GYAE6OF02G7YCI.21.28.C06.1.454.CMB.1.raw
  modified_base (340)..(340): a, c, t, g, unknown or other
  misc_feature (340)..(340): n is a, c, g, or t
  modified_base (446)..(446): a, c, t, g, unknown or other
  misc_feature (446)..(446): n is a, c, g, or t
tcagtcgtcgctcgcacgaccggtgctcgattagagctcacgtattgggtttggggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgtttaggctctggattcagatttggagacgccgccatgcacgtgggtccgccaggcctccaggcaagggtctcgagtggttgggatttanaacagtcgatcatattctcgtaatttggcgggtcttcgtggtggacgggggcctagtggtagcatcctacgaggactaattcatacaatacagtctatctcaattnaacagtctacacgacctagacgacgacgtacttatttattattgtcaccaagtaacgtaccggtcccgtacgggacgggggcccacggtcggggacccgggtaaccgtcggtaccgacccggtcctccgtaccg

SEQ ID NO: 188097 - DNA, 585 bp, Homo sapiens
  misc_feature: GYAE6OF02GA52G.21.28.C06.1.454.CMB.1.raw
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggctgggttttcctcgctgttcttttagaggtgtccactgtcaggtaacactggtggaggtcgggggagcgtggtccagcctgggacatccctgagactctcctgtttaggctctggattcagtatttggagacgccgccatgcacgtgggtccgccaggctccgaggcgaagggtctcggaggtgggttgggatttataacagtcgatcatacttctacgtaatttcggcgggtctcgtggtggaggggccgatgtagctatctccgagggactaatccatacaatactagtctatctactaattagaactagtctacacgtacctagaccgacacggtacttaatttattattgtacgaccaagtacgtaccggcccgtacgggacgggggccgacggtcggggacccggtaccgtcggtccgtaccgtcctcctaccg

SEQ ID NO: 188098 - DNA, 591 bp, Homo sapiens
  misc_feature: GYAE6OF02H8MCF.21.28.C06.1.454.CMB.1.raw
  modified_base (302)..(302): a, c, t, g, unknown or other
  misc_feature (302)..(302): n is a, c, g, or t
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggaggtcggggggagcgtggtccagcctgggacatccctgagactctcctgtttaggctctggattcagtatttggagacgcccgccatgccactgggtccnccaggctcccgaggcaagggtctcggagttgggttgggatttataacgagtcgatcaattattcctacgaattttggcgggtctcgtgtggacggggcctagttgtagctatccgtccgagggactaacttccatacaatactagtctactcctactaatcgaacatcctcacgtcctagaccgacacggtcttaatttattagttgtcgacagaactaccggccgtccggacggggcctaccggtccggggcccggtacccgtcggtccgtaccgtccgtccgtcccg

SEQ ID NO: 188099 - DNA, 749 bp, Homo sapiens
  misc_feature: GYAE6OF02IMNSN.21.28.C06.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgcttgttctttttagaggtgtccactgtcaggtaacactggtggagtcggggggagcgtggtccagcctgggacatccctgagacctctccttggtttaggcttctggattcagtatttgggagacgcccgccatgccagtcgggtccgccgaggcctccgaggcgtaagggtctcggaggttgggttggtatttanaacgagtcgatctaatacttctacgtaattttggcgggtcttcgtggtacgggacggggtccgtagttggtacgctacgttccgtaccggaagggtaacctaacgttacccacttaactaaattaacctacgttacttacttaccttaccttaagttaacgaacctacgttacctacgtaacgtaacccgtacgaacccgtaaccgtaaccggttacttttaacgtttttaacgttttaacgtttacggttacgtaacccgtaacgtaaacgttaccccggggtaccccggttaccgggggacggggggtaccccgtaccgggtacccggggggacccccgggtaacccggttaccggtaccccggtacccggttccccgtacccgtacccg

SEQ ID NO: 188100 - DNA, 789 bp, Homo sapiens
  misc_feature: GYAE6OF02GGFCO.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttcttttagaggtgtccactgtcaggtaacacgtggtggaggtcggggggagcgtggtccagccgtgggacactccctgacgactctccgtgtttagctcgtggattcgagtagtttggacgaccgtccgcctactcgccacgtcgggtcccgccgaggcctacgaggacgaacgggtccgtacggtaggttgggttagggtatttaacgaacgtagtacgaatcgtaattacttcgtacgtaagttttcgggccgggtcttcgtggtacggacgggggtaccctagttcgggtaacgccgtaacgtccgttacccggaacggggtaacccttaaacgtttccccgaagttaacctaaacgttaaccgtaacggttaccttaacgttcccttaaaccgtaaatttaccgaaacttacggttacctacgtaaccggtacctacggaacccgtaacgtaaccggttactttaagttttaacttagttacggtacgtaaccgtaacgtaacgtacccggtcccggtacggggtaccgggggtaccccgtacggggtacccgggggtacccccgggtaacccggttaccggggttacccgaccccggttacccgttccccgtaacccgg

SEQ ID NO: 188101 - DNA, 581 bp, Homo sapiens
  misc_feature: GYAE6OF02JI2CP.21.28.C06.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttcttttagaggtgtccactgtcaggtaacactggtggagtcggggggagcgtggtccagcctgggacatccctgagactctcctgtttaggctctggattcagatttggagacgccgccatgcacgtgggtccgccaggcctccaggcaagggtctcgagtggttgggatttanaacagtcgatcatacttctcgaatttggcggctcgtgtggaggggccatggtagcatctccaggactattccatcaatacagtctatctacctaattcgaactagtcctacgacgacctacgaccgacacggtacttatttattattagtcgaccagtaacgtaccggtcccgtacggacgggggcctacggtccggggaccccggtacccggtcggtccgaacccgtccgtacctacccgg

SEQ ID NO: 188102 - DNA, 899 bp, Homo sapiens
  misc_feature: GYAE6OF02HW8SB.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggcttgggttttcctcgctgttctttttagaggtgtccatgtcaggtaacactggtggaggtcggggggagcgtggtccagcctgggacatccctgagactctccttggtttaggctctggattcgaagatttggagaccgccgacctatgcacgtggggtcccgaccaaggtcctaccgacggacgtaaacggggtcctacggaggttcggttagggaatttttaacgtaaaaccgtaggttacgaacgttaccaagttactttaccgtaccgttaaagttttcgggaccgggtactttcgtggttacgggacgggggtaccgtaagttacgggttagaccgtaacgttccgttacccggaaaggggtaacctaaaacgttttaccccgaaattaaccgtaaaagttaccgtaacggtttaaccttaacgttaacccttaacccgttaaaagtttacggtaaaaccgttaacggttacctaaccgtaaccggtaacccgttaacggaaacccggtaaaccgtaaccgggtaacttttaaacgtttttaaacttttaacgtttacggttaacgtaacccgtaaaacggtaaaccggtttaaccccgggaacccccggttaacccgggggaaccggggggggtaaccccgtaaacccgggtttacccggggggggaaccccccgggttaaacccccgggttccgggttaaaccccgggttaaccccggttaccccggtttacccctaaccccggg

SEQ ID NO: 188103 - DNA, 622 bp, Homo sapiens
  misc_feature: GYAE6OF02JEQRP.21.28.C06.1.454.CMB.1.raw
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgttaggctctggattcagtattggagacgccgccatgcacgtgggtcccgcaggctccgaggcaagggtctcggagtggtggtatttanaacngtcgatcatattctagtaatttgcgggcttcgtggtggacggggtcctagtgtacgctagtcctacgacgggactaattccaatacaaatactagtctactctacctaattgaactatctacgacgacctagaccgacgtacggtacttacgtttaattagttacgttgaaccgagtaacgtaccgggtacccgtacgggaacgggggtacccgacgggtaccggggaccccgggtaacccgttccgggtacccgtacccggtcccgttaccgtacccg

SEQ ID NO: 188104 - DNA, 610 bp, Homo sapiens
  misc_feature: GYAE6OF02H9DFC.21.28.C06.1.454.CMB.1.raw
  modified_base (158)..(158): a, c, t, g, unknown or other
  misc_feature (158)..(158): n is a, c, g, or t
  modified_base (194)..(194): a, c, t, g, unknown or other
  misc_feature (194)..(194): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (415)..(415): a, c, t, g, unknown or other
  misc_feature (415)..(415): n is a, c, g, or t
tcagtcgtcgctcgcacgaccggtgctcgatttagagctcacgtattgggtttggggggagaggagcccagcactggaagtcgccggtgtttccatcggtgatcagcactgaacagagaggactcaccatggagtttgggctgggactgggttttccncggctgttcttttagaggtgtccactgtcaggtacnctggtggagtcgggggagcgtaggtccaggccgtgggaaccatcccgtgaggtactctcgtgttaggcctcgtgattcgagtattggagacgtccgcgtatcgcacgtggtccgcagcgtcacggnacgggtcncgtagtcggtggtaattaccgtaancggttacagttacgattactcgtacgtaattcggacggtctcgtgtcgaggtctagtcagcngtctcgagactactcatacgaactactagcttactcgtacctagtacacgtacgtctacgtagaccgtagcgacgacgttacttattagttacgtgtagtacgatacgaccgtaccggtcggtacggggaccttaccggtaccggggtaccccgtaccgggtaccggtacccgtaccgtacccgttcccgtaccg

SEQ ID NO: 188105 - DNA, 721 bp, Homo sapiens
  misc_feature: GYAE6OF02IY1Q7.21.28.C06.1.454.CMB.1.raw
  modified_base (179)..(179): a, c, t, g, unknown or other
  misc_feature (179)..(179): n is a, c, g, or t
  modified_base (651)..(651): a, c, t, g, unknown or other
  misc_feature (651)..(651): n is a, c, g, or t
tcagtcgtcgctcgcacgaccggtgctcgattagagctcacgtattgggtttggggggagaggagcccagcactggaagtcgccggtgtttccattcggtgatcagcactgaacagagaggactcaccatggagtttgggctggctggtttcgtcgctgttcgttttagtaggtgtccnctagtcagtacgtacgtggtggtaggtcgggggaggcgtcggtccgacgcgtcgggacgactccgtcgaggacctctccgttggtttacggtctcgtcggtattcgtacggtagtttcggtaaggaccggtacccgtccgaacgtggtaccgaaccggtcggggtcccgccggacgtccggtcccgtaacggggtcgaaacggggttcgtaccgtagggttcgggttaggggtaatttaacgtaaaccgaggtcgaacgtactaggtaactttacgtcgtaaacgttttcggcggggttctgtacggtagggacggggccgtagtagtacgtcgtacttacgaccgtaagggtaactaacgttaccgaactacgtaaactacgtaacgtacctaactccgttaaccgtaagttacgtaaatacgtcctacacgtactacgcgaacgtcgtacttactttagtattcggtcanacgtaacgtccggtcgaacgggtcgggtcgtaccgtcgggaccggtacgtccggccaccgttcgcctacg

SEQ ID NO: 188106 - DNA, 777 bp, Homo sapiens
  misc_feature: GYAE6OF02IU971.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctgctgttctttttagaggtgtccactgtcaggtaacactggtggaggtcgggggagcgtggtccagccgtgggacatccctgacgactctccttgtttacggctcgtggattcagtatttggacgacgccgccagtcgactacgtcgggtccgccagggcctccgacgggcgtaaggggttcctacgggtaggttggggttacgggtaattttaacgtaaacgtacggttacgaattacctaattacgtttccgttacggttaaagttttcgggaccggggtctttcggtggtgggaacgggggcccgtagttaggtacgcgtaacgttcccgtaccgagggtaactaacgttacctaacgtacaaacttaaccgtaagttaccttaacttaccgttaacctaagttacgtaaacgtacgttcccgtaacgacgtaccgtacgaaccgaccgtaccggttactttaacgttttaattaacgtttacgacgtaaccgtaacgtaacgttacccgggtcccggtaaccggggaaccgggggtacccgtaccggggtaccgggggtacccccgggtaacccgggttggtaccccggtacccgttacccgttacccgtaccgg

SEQ ID NO: 188107 - DNA, 716 bp, Homo sapiens
  misc_feature: GYAE6OF02FNHHP.21.28.C06.1.454.CMB.1.raw
  modified_base (353)..(353): a, c, t, g, unknown or other
  misc_feature (353)..(353): n is a, c, g, or t
tcagtcgtcgctcgcacgaccggtgctcgattagagctcacgtattgggtttggggggggagaggagcccagcactggaagtcgccggtgtttccattcggtgatcagcactgaacagagaggactcaccatggagtttgggctgggctgggttttcctcgctgttctttttagaggtgtccactgtcaggtaacactgggtggaggtcggggggaggcgtggtccagcctgggacatccctgagactctcctgtttaggctctggattcagatttggagacgccgccatgcacgtgggtcccgccgaggcctccgaagggcgaagggtcctcggaggtgggttggattttanaacgtgtcgatcattattctagaatttggcgggtctcgtggtggacggggtccgtagtggtagctatccgtaccgacgggtacctaacgttacctaactactaaactacgtaacgttactacttaccttaccttaaagttacgtaacctacgttacctaccgaacgtaccgtacgtacggaaccgtaaccggtactttaagttttaacttttaagtttacggtacgtaaccgtaacgaacgtaacccggtaccccgggtaccgggaaccggggggtacccgtaacccgggtccggggggtacccccgggtaacccgggttcccggttacccggtaaccccggttcccgttacccgtaccccgg

SEQ ID NO: 188108 - DNA, 855 bp, Homo sapiens
  misc_feature: GYAE6OF02HRNQ3.21.28.C06.1.454.CMB.1.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggcttgggttttcctcgcttgttctttttagaggtgtccactgtcaaggtaacactgggtggaggtcgggggaggtcggtggtccagccgtgggacatccctgagactctccgtgttacgctcgtggattcagtattagganaccgccgacatgacctacgtcgggtccnccgaggcctaccgaaggcgaacgggtctacggtaggtgggttcgggtaattttaacgtaacgtaggtacgtaactacgtaacttacgttaccgttacgttaaagttttcgggccggggtactttaccggtgggtacgggtaaccgggggtaccgtaagttaggttacgacttaacgtcccgtaccggaaacgggtaactaaacgttacccgtaagttaaccgtaaaacttaacgaacgtttacccgttaaacgtttaacccttaaacccgtttaaagttaaccggtaaaaccgtaaccgttaccgttaaaccggaacggttaaacccgtaacgggttaaaccgggtaaacccgttaaacgggttacttttaaaagtttttaacgtttaacggttaacggtttaccgaaaccgtaaaacgttaacggttaaccccgggtcccggttaaccggggaccgggggtaacctaaccggggtcccgggggtaccccgggtaacccgttcggtaaccccggtacccggttaccccttccgaacccgg

SEQ ID NO: 188109 - DNA, 986 bp, Homo sapiens
  misc_feature: GYAE6OF02GINZZ.21.28.C06.1.454.CMB.1.raw
tcagtcgtcgctcgcacgaccggtgctcgattagagctcacgtattgggtttgggggggagaggagcccagcactggaagtcgccggtgtttccattcggtgatcagcactgaacagagaggactcaccatggagtttgggctgggcttgggttttcctcgcttgtttctttttagaggtctccactgtcaggtaacacgtggtggaggtcgggggagcgtggtccagccgtgggacatcccgtgacgtacctctccgttggtttacggccttcgtaggatttcgaagtatttagggacgtaccgcccgccgaagtcgcctaccgtggggtaccccgccgaacgggcccttacccggaacgggtaccgtaaaacggggttccgttaccgggtaagggtttcgggggttttaggggtaactttttaaacgtaaaaccgtagggtttaccggtaattaccgtaaagtttaacgtttccgttaacgggttaaagtttttcgggaccggggttacctttcggttagggttacgggaacggggggtacccgtaagtttcgggtaaacgtccgtaacgttcccgtacccgggtaaaccggggtaacccttaaacgttttaccctaacgttaaccgtaaacgtttaaccgttaacggtttaccctttaacttacccgttaacccgtaaagttttaaccggaaacccgttaacggttacccgttaccgtaaacccggttaacccgttacgggtaaccccgtaaccggtaaacccgggttacctttttaaaacgttttaaccgttttaaaggttacgttaaccgtaaaccttaacgggtaaaccggttaccccggggtaccccgggttaaccgggggtaaccgggggggtacccccgttaaccggggttaccccgggggggaaccccccgggtttaccccggttaccggggtaccccgtttaaccccgggttccccgtttacccgtacccccggg

SEQ ID NO: 188110 - DNA, 588 bp, Homo sapiens
  misc_feature: GYAE6OF02G0XBF.21.28.C06.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagagctcacgtattgggtttggggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggagtcggggggagcgtggtccagcctgggacatccctgagactctcctgtttaggctctggattcagtatttggagacgccgccatgcacgtgggtccgccgaggcctccgaggcaagggtctcggaggtggttggtatttataacngtcgatcatattctgaatttgcggtctcgtgtggaggggccagtgtagcatctcgaggacattcatacaatacagtctatctacctattacgaacacgtctacgacgacctacgacgacacggtacttatttattattagtacgacctagtaacgtaccggtcccgtacgggacgggggacccgtaccggtacggggaccccgggaccgtcggtcccgtacccggtccgtccgtaccg

SEQ ID NO: 188111 - DNA, 856 bp, Homo sapiens
  misc_feature: GYAE6OF02F9FTL.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgctgttcttttagaggtgtccactgtcaggtaacactggtggagtcggggggagcgtggtccagcctgggacactccctgagactcctctgttagctctggatcagattggagacgccgccatcgcacgtcggtccgccgaggcctccgaggcaacgggtctcgaggtggttgggtactttaataacagtcgtatactaatattcctacgtaagttttcggcggtcctcgtggttaggacgggggtcccgatttagggacgtccgtaagttccgtacccgtaaaggggtaacctaaactttcccgaaacgttacctaaaacgttaaccgttaacgttaacccgttaacttacccgttaaccgttaaacgtttaccggtaaaaccaaccgggtttacccttacccggtaaacgtaaccccgtttcgggaaacccggtacccggtaaacccggttacccgttttaaaattttttaaacggttttaaacgttttacgggttaacccggtaacccgtaaaacggttaaaaccgttccccggggtaaccccccggtttaaccggggggaaacccggggggggttaaccccgtaacccggggtttaacccgggggggaccccccgggggtttaaacccccgggttacccggggttacccccggtacccccggttacccccggttacccgttaaccccccggg

SEQ ID NO: 188112 - DNA, 720 bp, Homo sapiens
  misc_feature: GYAE6OF02G7TXN.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggggtttggctgggctgggtttcctcgctgttcttttagaggtgtccactgtcaggtaacactggtggaggtcggggggaggcgtggtccagcctgggacatcccctgagactcctcctgtttaggctctggtatcagtagtttggaggaccgcccgcctatgccacgtcgggtccgccaggcctccgacgggcgaaggggtctacggaggtggggttagggtaattttataacgaggtcgtatacctagttattctacgtaagtttggcgggtccttactgggtaggacggggtacctagttcgtaagaccgattaccgtacccgaagggtaacctaacgttaccgtagtaactaaacttaacacggttacctattacctacgtaacgttagaacgagttcctaactagacctaggaaccgacgtaccggtacttaagttttaattagtttcgtaagtaccgtaaacgtaacgtaccgggtacccggtaccggggaaccgggggtaccggtacccggtaccgggggtacccccggtaaccggttaccgggtaccgtacccccggttcgtccccgtccgtaaccccgg

SEQ ID NO: 188113 - DNA, 836 bp, Homo sapiens
  misc_feature: GYAE6OF02I01TI.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttcctcgcttgttctttttagaggttgtccactgtcaggtaacactggtggaggtcggggggagcgtggtccagcctgggacatccctgagactctcctgtttaggctcgtggattcgagtagtttgggacgaccgcccgccagtcgcacgtcgggtccgccgaggcctccgaggcgtaacgggtcctcggtaggttgggttaggggtaacttttaagtaaaccgtaggttaccgtattactaacgttactttaccgtacgttaaagttttcgggaccggggttctttaccgggttggggtacgggggggtaccggtacgtaaggttacggtacctaccgttaccgtacccgtacgggaaaccggtaaccttaacccgttacgtaaacctaaacgtaacgtaacgttaccgttaaccttaaccgttaccttaaaacgtttaacgtaaaccgtaacgtttaccctacgtaaaccggaaccgtaaccggttaaccggaaccgtacggttaaccgtttaagtttttaaactttaacgtttagttaacgtaaccgtaaacggtaacgtaaccgggtacccggttaccggggaaccgggggtaccggtaccgggtacccgggggaaccccgggtaccccggttaccgggttaccggtacccgttacccgttcccgtaccgtacccgg

SEQ ID NO: 188114 - DNA, 722 bp, Homo sapiens
  misc_feature: GYAE6OF02JXCSR.21.28.C06.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (349)..(349): a, c, t, g, unknown or other
  misc_feature (349)..(349): n is a, c, g, or t
  modified_base (467)..(467): a, c, t, g, unknown or other
  misc_feature (467)..(467): n is a, c, g, or t
  modified_base (523)..(523): a, c, t, g, unknown or other
  misc_feature (523)..(523): n is a, c, g, or t
tcagtcgtcgctcgcacgaccggtgctcgatttagagctcacgtattgggtttgggggggagaggagcccagcactggaagtcgccggtgtttccattcggtgatcagccactgaacagagaggactcaccatggagtttgggctgggcttgggttttcctcgcttgtttcttttagaggtntccatgtcagtaacncgtggtggaggtcgggggacgcggtggtaccacgccgtgggacactcccgtgacgtctctacgttggttgctcgtagactcgagtagttggacgccgaccgcagtcgactcggtcgggtccgacgacgccgtccgaggaccgtagggttccncggtagggttggggtttagggttaattttacgaaacggtcgtacgtaacgttactagttatttccgtagtaacgttttcggacggtcttacgtggtagggcgggtacgtagtagtacnccgtacgtcgacggtacgtacctacgttccactaccgtaaagttcagttacccgtntacccgttacaacgttacgactacttccgtacaccgacgtacgaaccgtactacgttaactttacgttaacgttgttacgtaccgtaacgtaacggtaacgttccgggtacccggacggggttaccggtcccggtaccgggtacccggggtcccggtaaccgtaccgtaccccggtacccgttacccgtccgtacccgg

SEQ ID NO: 188115 - DNA, 820 bp, Homo sapiens
  misc_feature: GYAE6OF02IDZLZ.21.28.C06.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (265)..(265): a, c, t, g, unknown or other
  misc_feature (265)..(265): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggctgggttttccngctgttctttttagnggtgtccactgtcaggtaacactggtggagtcggggggagcgtggccaggcctgggacatccctgagctctctgttagctctggattcagntttggagtacgccgccatcgacacgtcgggtcccgaccgagggtcctcccgagggaccgtaaaggggttcctacggtaggtttcgggtttaggggtaactttttaagtaaacccgtaggttaccggtaactttacgaacgttaagtttacccgtacggtaaagtttttcgggcccgggggtactttcccggttaggtacgggggtaacggggggtccctaaaggtttcggttaacggacctaacgttccgttacccggtaacggggtaacctaaacgtttacccaattaccgtaaaacttaccgaacgttaccttaacgtaccgttacctaaagtttacgtaaccgtacgttactaccgaacgtacccgtaggacccgaaccgtacggtactttaacgtttaagtttacgttacgtaccgttacgaaacggttaaccggttacccgggtacccgttaaccgggggacgggggtaccccgtaaccgggttaccggggggtaccccggtaacccggtccggttacccggaacccgtttcccgtacccggttaccccg

SEQ ID NO: 188116 - DNA, 837 bp, Homo sapiens
  misc_feature: GYAE6OF02FQOT0.21.28.C06.1.454.CMB.1.raw
tcagtcgtcgctcgcacgaccggtgctcgattagagctcacgtattgggtttgggggggagaggagcccagcactggaagtcgccggtgttccattcggtgatcagcactgaacagagaggactcaccatggagtttgggctgggctgggttttcctgctgttcttttagaggtgtccactgtcaggtaacactggtggaggtcgggggagcgtgtccaggcctgggacactcccgtgacgtaccttctccgtggtttacggcttcgtggtacttcgagtagtttggacgtaccgcccgccgtagtcgcctacggtcggggtacccgcccgtagggcctacccgagggacgtaacggggtcctacggtaggttcggggtttaggtactttaacgaacgtcggtactatccgtaattactttcgtacgttaagtttcgggccgggtaccttcggtcggttacgggacgggggtcctagttggtacgtctacgttccgtaccggaacgggtaacttaacgttccaaacgtactaaacgtaacgtacgttacctacgttaccttaaccgtaacgttacgtaaaccgtacgtttcctaaccggaccgttaaaccggtacggtaaacccgaaccggttaacggttacttttaaacgttttagtttaaccgtttcgggtaaccgtaacccgttaagttaacccggttaaccgggtaccccggtaccgggggtaacccggggggtaccccgtaaccggggttaccccggggggtaaccccccgggttacccggttaccggggttaaccccgtacccgggtttccccgtacccgttaaccccggg

SEQ ID NO: 188117 - DNA, 813 bp, Homo sapiens
  misc_feature: GYAE6OF02GFR0V.21.28.C06.1.454.CMB.1.raw
  modified_base (205)..(205): a, c, t, g, unknown or other
  misc_feature (205)..(205): n is a, c, g, or t
  modified_base (362)..(362): a, c, t, g, unknown or other
  misc_feature (362)..(362): n is a, c, g, or t
tcagtcgtcgctcgcacgaccggtgctcgatttagagctcacgtattgggtttggggggggagaggagcccagcactggaagtcgccggtgtttccattcggtgatcagcactgaacagagaggactcaccatggagtttgggctgggctgggttttcctcgctgttctttttagaggtgtccactgtcaggtaacactggtggnggtcgggggaggcgtggtccagcctgggacactccctgagactctaccttgtttaggctctggtattcagtagtttggacgcgccgccatgacacgtcgggtcccgccaggcctaccgaggaccgaagggtctacggtaggtggttgggtatttaanaacgagtcgatctattattctcgtaagtttcgccgggtctcgtggtcggagggggtccgtagtacggtagctacgttacgtaccggaagggtaacctaaagttccctaagttactaaaacgttaaccgtaacgttaccgtaaccttaccttaaacccgtaagtttaacgaaaaccgttacggtttaccctaacggtaacccgtaaacccttaacgggaaccccgtaaacccggtaacgggttaacccgtttttaaatttttaaacgttttaaacgggttttcggtaacccgtaacgtaaacgggtaaacccggttaaccccggggttcccccgggtaaccggggggaacccgggggggtaaccccgttaaccggggttacccgggggacccccccggggttaaccggttccgggttaacccccgtaccccgttccgttaccccgtacccgg

SEQ ID NO: 188118 - DNA, 774 bp, Homo sapiens
  misc_feature: GYAE6OF02JJ2X1.21.28.C06.1.454.CMB.1.raw
  modified_base (177)..(177): a, c, t, g, unknown or other
  misc_feature (177)..(177): n is a, c, g, or t
  modified_base (607)..(607): a, c, t, g, unknown or other
  misc_feature (607)..(607): n is a, c, g, or t
  modified_base (612)..(612): a, c, t, g, unknown or other
  misc_feature (612)..(612): n is a, c, g, or t
  modified_base (637)..(637): a, c, t, g, unknown or other
  misc_feature (637)..(637): n is a, c, g, or t
tcagtcgtcgctcgcacgaccggtgctcgatttagagctcacgtattgggtttgggggggagaggagcccagcactggaagtcgccggtgtttccattcggtgatcagcactgaacagagaggactcaccatggagtttgggctgggcttgggttttcctcgcttgtttcttttagnggttcgtcctacgtgtcaggtaaccacgtggtgggaggtcggggggagcgtcggtccacggtccgtagggactactcccgtgacggacttcctccttaggtttcggcctcggttggaactttcgaggttactttaggacgaccgccgccgtaatcgcctacggtccgggtccgacccgacgggcccccgaagggaccgtaacgggttcctacgggtaacggttgggtttaccggtaagttttaaccgtaaagtcggttacgtaagttaccctaagtttaacgtttcctacggttaagttttcggggaccggtccttagttggtacgggagggtcctagtggtaacgctagtccgtaccgagggtaaacctaacttccgtaactactaacgttaacgtacgttactacgtcctaactaagttacaaacgtntaacngacgtacctagaacacgttaccgtntttaacgtttatagttacgtcgaacgttaacgtaccgtaccggtccccgtaggggaccgggttaccgaccgggttaccgggggtacccccggttaacctccgggtccctaccggtacccttacggacccttacccgg

SEQ ID NO: 188119 - DNA, 745 bp, Homo sapiens
  misc_feature: GYAE6OF02FULXW.21.28.C06.1.454.CMB.1.raw
  modified_base (157)..(157): a, c, t, g, unknown or other
  misc_feature (157)..(157): n is a, c, g, or t
  modified_base (257)..(257): a, c, t, g, unknown or other
  misc_feature (257)..(257): n is a, c, g, or t
tcagtcgtcgctcgcacgaccggtgctcgattagagctcacgtattgggtttgggggggagaggagcccagcactggaagtcgccggtgtttccattcggtgatcagcactgaacagagaggactcaccatggagttgggctgggctgggttttccncgctgttcttttagaggtgtccactgtcaggtaacacgtggtggaggtcgggggagcgtggtcagccgtgggacatccctgagacctctctgttagctgnggtatcagtattggacgaccgccgaccagtcgcacgtcgggtccgaccgacggctaccgaggtacgaagggtctcggaggttgggttacgggtatttaacgtaacgtagtacgacgtctattacgttcgtacgtaacttttcgggccgggttcttcggtgggtcgggacgggggtacctagttcggtaaggcctaccgttccgttacccggaagggtaacctaaccttaccgtacgttaacgtaaacgttaaccgtagttacctacgttaccgttaaccgtaattaacgaacgtacgtacctacgtaccgtaccgtacgacgtaacgtacggttactttaacgtttacttagttacgtacgaaccgtaacgtaaccggtacccggtacccggtacggggaccgggggtacccgtaaccggggtcccgggggtaaccccggtacccggttacggttaccccgtaccggttccccgttacccgtccccgg

SEQ ID NO: 188120 - DNA, 733 bp, Homo sapiens
  misc_feature: GYAE6OF02FZQ5G.21.28.C06.1.454.CMB.1.raw
  modified_base (155)..(155): a, c, t, g, unknown or other
  misc_feature (155)..(155): n is a, c, g, or t
  modified_base (192)..(192): a, c, t, g, unknown or other
  misc_feature (192)..(192): n is a, c, g, or t
  modified_base (470)..(470): a, c, t, g, unknown or other
  misc_feature (470)..(470): n is a, c, g, or t
tcagtcgtcgctcgcacgaccggtgctcgatttagagctcacgtattgggtttggggggagaggagcccagcactggaacgtcgccggtgtttccattcggtgatcagcactgaacagagaggactcaccatggagttggctggcttggtttccngcttgtttcttttagaggtcgtccatgtcaggtaacncgtggtaggaggtcgggggagtcgtggccaggcctgggacactccgtgacgtctccgtctgtttagctacgtgtattcgagtagttggacgcgccgcagtcgcgtacgtcgggtcccgcaggtccttacggacggtacgaacgggttctcgggagggtttcggttaggtaaactttacgtaaacgtacggttccgaaagttctaaagtttccgttcgttaagttaacgtttcgggccgggtcctttggtagggtcgggtaacgggcctaagtcgtacnctagtccgtacgacggactaacgtaccacgtactagtactactcctagtccgtaacgtaagttacgaaacgttcgttacgtaaccgtaacgtaccgtagacccgtaacgtaccgttacttttaagttacgtttagttacgtacaacgtaacgtaaccggtacccggtacccggtaccggggaaccgggtcccgtaaccgggggttcccgggtaccccgggtaacccgttccggtacccgtacccgttccgtcccgtaacccgg

SEQ ID NO: 188121 - DNA, 780 bp, Homo sapiens
  misc_feature: GYAE6OF02F5LBZ.21.28.C06.1.454.CMB.1.raw
  modified_base (308)..(308): a, c, t, g, unknown or other
  misc_feature (308)..(308): n is a, c, g, or t
tcagtcgtcgctcgcacgaccggtgctcgattagagctcacgtattgggtttgggggggagaggagcccagcactggaagtcgccggtgtttccattcggtgagtcagcactgaacagagaggactcaccatggagtttgggctgggctgggttttcctcgctgttcttttagaggtgtccactgtcaggtaacacgtggtggaggtcggggggagcgtggtccagcctgggacatcccgtgagactcctcctgttaggctcgtgggattcagatttggacgacgccgccaatgacactgggtacccnccgaggctccgaggcaagggtctcgaaggtggtttagggatttacaacgtaggtcgaattccaattattccgtacgtaaattttggccgggtcttcgtggttacggaggggggccctagttggtaacgtcgaagttcgtacccgaaggggaaccttaaaggttacccaacttacgtaaactaccggaagttccgtaacttccgttaaccctaagttacgaaaccgtaacgttaccgtacacgtaccccttaggaaacccgaccgtaaccgggttacctttaagttttaacttttaacggttacgttaacggtacccgttaaacggtaaacggttaaccccgggtcccgttaccgggggaacccggggggggtaaccccttaaccggggtacccgggggggtaaccccccggggttaacccgggttccggggttaacccctacccggggtttacccgtacccgttacccccgg

SEQ ID NO: 188122 - DNA, 824 bp, Homo sapiens
  misc_feature: GYAE6OF02I4VWK.21.28.C06.1.454.CMB.1.raw
  modified_base (184)..(184): a, c, t, g, unknown or other
  misc_feature (184)..(184): n is a, c, g, or t
  modified_base (787)..(787): a, c, t, g, unknown or other
  misc_feature (787)..(787): n is a, c, g, or t
tcagtcgtcgctcgcacgaccggtgctcgatttagagctcacgtattggggtttgggggggagaggagcccagcactggaagtcgccggtgtttccattcggtgatcagcactgaacagagagactcacatggagtttggctgggtcgttgggttttcctcgtcttgtttctttttaggaggtntccacgttgtcgaggtaacacgtgggtggacgggtcggggggaggcggtcggtccgaggccgtgggacactcccgtgacgtactcctccttggttacgtctcgtagtattcgagtatttggacgaccggaccgccagtcgacgtcgtcggggtcccgcgtacggtcctaccgagggacgaacggtcgtacggtggttacgggtgggtattttaacgaacgtacggtcgtaacgttcaacgtttacgttccgtacggttaaagttttccgggacggtccgtttcgtgggttccggggacgggtaccgtaagtcggtacgtactacgttccgtaaccggaacgggtaacttaacgtttaccgtataacctaaagtacgtaacggttaccttaacgttaccgttaaccgttaaacttacggtaaaccttaacgggtccttaaccgtacgtaaacccgtaccgtaaccggtaaccgttaaccggttaaccttttaagtttaaccgtttaattccggttacgtaaccgtaacgtaaccgtacccgggttacccggtacggggtcccgggtaacgggtcccgggtaaccgggaccccgggttaacccgngggttacccccggtacgttaccccggtcctaacccgg

SEQ ID NO: 188123 - DNA, 804 bp, Homo sapiens
  misc_feature: GYAE6OF02GUKB2.21.28.C06.1.454.CMB.1.raw
  modified_base (327)..(327): a, c, t, g, unknown or other
  misc_feature (327)..(327): n is a, c, g, or t
tcagtcgtcgctcgcacgaccggtgctcgatttagagctcacgtattggggtttgggggggagaggagcccagcactggaagtcgccggtgtttccattcggtgatcagcactgaacagagaggactcaccatggagtttgggctgggcttgggttttcctcgcttgtttcttttagaggtgtccactgtacaggtaacacgtggtggaggtcgggggaggcgtggtccagccgtgggacactcccgtgacgtactctccgttgttaggcttcgtggtacttcgagtagtttggacgtaccgccgccatcgcaccgtggggtccccnccgtaggcctacccgagggtcgtaacggggtcctaccggtagggtggggttaggtactttaagaactaggtcgtattcattgttaccgtacgtaagttttcgggccggtacgtttcgtgggtacgggacgggggtcccgtaagttcgggtaacgcctaagttcccgtaccggtaacggggtaacctaaacgtttaccccaagttaaccgtaaataaccgtacgttacccttaacttacccttaaccctaaagtttacgaacttaacgtcctacgaccgtacccgtaacgtaccggtaaccacggttaaccttttaagttttaacgtttagttccgttacgaaccgtaacgtaaccgtacccggggtccccggtaccgggggtacccgggggtaacccgtaccggggtcccggggggtaacccccggttacccgggtacggtccccggtaaccccgggtttcccacccgttacccggg

SEQ ID NO: 188124 - DNA, 811 bp, Homo sapiens
  misc_feature: GYAE6OF02JCESE.21.28.C06.1.454.CMB.1.raw
tcagtcgtcgctcgcacgaccggtgctcgatttagagctcacgtattgggtttgggggggagaggagcccagcactggaagtcgccggtgtttccattcggtgatcagcactgaacagagaggactcaccatggtagtttgggctgggcttgggttttcctcgctgttctttttagaggtgtccactgtcaggtaacacgtggtggaggtcgggggagcgtggtccagccgtgggacatccctgagactctccttgttagctcgtggattcgagtatttggacgaccgccgccatggccacgtgggtcccaccgtaggcctaccggaggtcgaagggtcctggaggttgggttaggtattttaagaacgtgtacgatctaattcttaccgtagtaacgttttcggccgggtcttacgtcggttagggacggggtccgtatacggtacgctaacgttccgtaccggaaacgggtaaccttaacgttaccaacgtaacctaaacgtaccgtaacgttccttaaccttaccgttaaccgttaaagttacgtaaacctacgtttcccaaccgtaaccgtaccgtaaccgaaccggtaacccgtaacggttactttaaacgtttttaacgtttaagtttaccgggtaccgtaaccgtaaacggtaaccggttaccccggggtaaccccgggtaaccgggggtaacccgggggggtaccccgttaacccgggggttacccggggggtaaccccccgggtaacccgggttacccgggttaccccgtaaccccggttccccgttaccccgtaacccggg

SEQ ID NO: 188125 - DNA, 751 bp, Homo sapiens
  misc_feature: GYAE6OF01EQHKY.19.1.A01.1.454.CMB.1.raw
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (327)..(327): a, c, t, g, unknown or other
  misc_feature (327)..(327): n is a, c, g, or t
tcagtactctcgtgcacgaccggtgctcgatttagacgtctcatcaaggaagggaagggggcagcaagatggtgttgcagacccaggtcttcatttctctgttgctctggatctctggtgccgtacggggacagtcgtcatgacccctagtcctccagacctcccgtggccttgtcgtctcgtggggcgaggacgggccaaccatcaactgacacgtccagccagtagttgttttanacancctaccaaanaataagtaactacttacttagatcagtacaagaaaccaggacacgacctactaaggtcgacttcctacgtttccgngggactacgtaccggttaacccggggaaccgttcccgggggttaccctacggacccgttacgttcgtaacggtcgggactacggggtccggtcgtaggggtaacctaggtacttttccaccgtctacgacgtaccaacgtccccggtaaggccggtacccgttggaccgacgggtaccttaagggaaacggtagttcgggttacgggtagtttaacggtttttactttacggttctaaccgtagttacttaaaatttagtaacttactcccttacgttcccggtaacccgtcggttccggaaccgggtagggtacccgtaaaggggtaccgaaaattaccgaaaaccggttagtacgggttgaccggttcgaaacttacccggtaattccttaccgttagttacctccttacccccgttacccg

SEQ ID NO: 188126 - DNA, 646 bp, Homo sapiens
  misc_feature: GYAE6OF02ITEZF.19.1.A01.1.454.CMB.1.raw
  modified_base (222)..(222): a, c, t, g, unknown or other
  misc_feature (222)..(222): n is a, c, g, or t
tcagtactctcgtgcacgaccggtgctcgatttagacgtctcatcaaaggaagggaaggggcagcaagatggtgttgcagacccaggtcttcatttctctgttgctctggatctctggtgccgtacggggacatcgtcatcgacccagtctccagactccctggctgtgtctctgggcgagagggccaccatcaactgcaagtccagccagagttgttttanacagctaccaaacaaataagaacttaacttaacttggtatcagacaagaaaccaggacacgccctaccgtaaggtgcttctattttccgtgggctactccgtaacccgggaatcccgggggtccctgaccgtattcgaggtggcgaggcggtcgtggggacagtatttccactctcagcatcgagccggcctgcgaggactaggaagagtggtggacttagttttattcgtacgtcagtacttaatttatttttacttacttcccgtccggttacggtaccggtttccggaccgtaacggggtacccgaaggggttaacgaacgttacgacggtaaccgtaacgttcgggtacggtccgtacggacccgtaacccgtacgttccgttacgttccgtttaccttaccgttccccgttacccccgg

SEQ ID NO: 188127 - DNA, 790 bp, Homo sapiens
  misc_feature: GYAE6OF02JQHCN.19.1.A01.1.454.CMB.1.raw
  modified_base (248)..(248): a, c, t, g, unknown or other
  misc_feature (248)..(248): n is a, c, g, or t
  modified_base (278)..(278): a, c, t, g, unknown or other
  misc_feature (278)..(278): n is a, c, g, or t
  modified_base (478)..(478): a, c, t, g, unknown or other
  misc_feature (478)..(478): n is a, c, g, or t
tcagtactctcgtgcacgaccggtgctcgatttagacgtctcatcgaaggaaggaaggggcagcaagatggtgttgcagacccagggtcttcatttctctggttgctctggatctctggtgccgtacggggacatcgtcatgacccagtctccagacctccctggctgtgtctcgtgggcgaggacgggccacatccaacttggacaacgtccagccagagttgttttacacagcctaccaactaaanaaagtaacctaacttaacgttggtactganacaagaaaccaggacacgtcctacgtaagtcgaccttctagttccgtcggtacacgttacccggtaacccggggtaacgttccccgggggttacccctacggaaccccgttagtttccgagggttaccggaccgtacggggtcgggtaccggtacggggtacctaacggtttacttttacccgtaacttaccgttaaacncggtaacccctaggtaccgaccgggtccggggttacccgcggtaaccgggtaaccggaccgttaaggaacgggttaagttcgggtaccggtacgtttaaggtttttacgtttacgttcgttacgtaacgtagttaactttaatttaacgttaccaccgttaccctaccgttccggtaccggttacccggacgtaaccggggtaccggaacgggtaacggtaaccgtaaccgtaaaggtaccggttcggtacgtccgtaaccgaccttaacgtacgtttccgtacggttcctacgtacccgttcccctacccg

SEQ ID NO: 188128 - DNA, 689 bp, Homo sapiens
  misc_feature: GYAE6OF02I0N8F.19.1.A01.1.454.CMB.1.raw
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
tcagtactctcgtgcacgaccggtgctcgatttagacgtctcatcagggcctgggctctgctcctcctcacctcctcactcagggcacaggctcttgggcccagtctgccctgattcagcctccctccgtgtccggtctcctggacagtcagtcaccatctcctgcactggaacctgcagcgatggttaggggttatgaccttgtctcctggtatcaacagccaccaggacaaaccgaccccctaaatcttaattanaagtacactagctacctcgaggtattctaatcgnttctactgcctacgagtctggctaacgtccgtccctccgagtaacaactccgttcgcgggtacctcccgggtatcggaagggacggtacgctagtaatttaacgttgttgtcgtctctaattagtcgtacgtaaggtagtactaacgtacttaaagttcgttacgttacgggtaaacgtcgggtaaccaacggttcccaaccgggttactaacggtccgaacgttacccccggaacggtaaccccgtaaccccttacgtaccgttcccaaccgtttcccgttacccggttaccccgtccccgttaccgtaccctaccgggtaacctttcggttaccttaaccggttcgaaccggcccgggttacgtaaccgggacccgtaacgggtaccacgtaacgg

SEQ ID NO: 188129 - DNA, 782 bp, Homo sapiens
  misc_feature: GYAE6OF02HWKRQ.19.1.A01.1.454.CMB.1.raw
  modified_base (766)..(766): a, c, t, g, unknown or other
  misc_feature (766)..(766): n is a, c, g, or t
tcagtactctcgtgcacgaccggtgctcgatttagacgtctcatcaaggaagggaaggggcagcaagatggtgttgcagacccgaggtcttccatttctctgttgctcgtaggactctcgtggtcgaccgtacggggacatcgtcactacgaccctagtctccgagaccttcccgtggtctgtcgtcctcgtagggcgtacggtacgggaccaccgatccaacgtacggacaacgtcacgccgtaagtagttcgttttaacacgacgtcctaaccgaaaactaaagttaaacgtaaccttaaccgtttaacgttacgggttaattaccgaacggtaaccaaaacggtaaaccggaacggaccgttaccgtacccgttaaaccgttaaggggtctacccgttactttaaccgtttcgtacgggtaaccttacggttacccggaaccccgggtttaacggtcccccgggtaacccgttacgtaccggtactttcgggaacggtcggtcggtaccggtaccgggtcgtaaacggggaccttaggttaccgtttacccacgttaccgtaccaaacggtacctccgttaccgggacgtcccggtaacgttaccgcgtacggtacgtacgtaagggttccgtaggtacgtcgtttaacgtttactacggtatacggactaaacgtttattacgtaatccgtactacccgttcgccgttacgtcggacgtacggagacgtagaacgtacgactgggctcagcactagctcttncctatccgtactacgg

SEQ ID NO: 188130 - DNA, 125 bp, Homo sapiens
  misc_feature: GYAE6OF01ATP5Z.48.61.F06.1.454.CMB.1.raw
  modified_base (125)..(125): a, c, t, g, unknown or other
  misc_feature (125)..(125): n is a, c, g, or t
tcagagtatacatacacgaccggtgctcgatttagctacgctctaagggaaaggggctggcccagcgtgttcctgttcccgccctcctctatgtatactctgagcgggctggcaaggcgcatagn

SEQ ID NO: 188131 - DNA, 158 bp, Homo sapiens
  misc_feature: GYAE6OF01AQXI0.48.61.F06.1.454.CMB.1.raw
  modified_base (136)..(158): a, c, t, g, unknown or other
  misc_feature (136)..(158): n is a, c, g, or t
tcagagtatacatacacgaccggtgctcgatttagctacgctctaagggaaagggtgaatcttcgctgacgaaatttccttcatcttcccgccatctgatatgtatactctgagcgggctggtcaaggcgcatagnnnnnnnnnnnnnnnnnnnnnnn

SEQ ID NO: 188132 - DNA, 114 bp, Homo sapiens
  misc_feature: GYAE6OF01BY3SL.48.61.F06.1.454.CMB.1.raw
  modified_base (114)..(114): a, c, t, g, unknown or other
  misc_feature (114)..(114): n is a, c, g, or t
tcagagtatacatacacgaccggtgctcgatttagctacgctctaagggaaagggttcttcatcttcccgccatctgatatgtatactctgagcgggctggcaaggcgcatagn

SEQ ID NO: 188133 - DNA, 134 bp, Homo sapiens
  misc_feature: GYAE6OF01CXPEE.48.61.F06.1.454.CMB.1.raw
  modified_base (134)..(134): a, c, t, g, unknown or other
  misc_feature (134)..(134): n is a, c, g, or t
tcagagtatacatacacgaccggtgctcgatttagctacgctctaagggaaagggagaacttgacaaacttgatggtcttcatcttcccgccatctgatatgtatactctgagcgggctggcaaggcgcatagn

SEQ ID NO: 188134 - DNA, 134 bp, Homo sapiens; identical to SEQ ID NO: 188133
  misc_feature: GYAE6OF01CC9O6.48.61.F06.1.454.CMB.1.raw
  modified_base (134)..(134): a, c, t, g, unknown or other
  misc_feature (134)..(134): n is a, c, g, or t

SEQ ID NO: 188135 - DNA, 134 bp, Homo sapiens; identical to SEQ ID NO: 188133
  misc_feature: GYAE6OF01COWQ5.48.61.F06.1.454.CMB.1.raw
  modified_base (134)..(134): a, c, t, g, unknown or other
  misc_feature (134)..(134): n is a, c, g, or t

SEQ ID NO: 188136 - DNA, 136 bp, Homo sapiens
  misc_feature: GYAE6OF01CMQY6.48.61.F06.1.454.CMB.1.raw
  modified_base (133)..(136): a, c, t, g, unknown or other
  misc_feature (133)..(136): n is a, c, g, or t
tcagagtatacatacacgaccggtgctcgatttagctacgctctaagggaagggagaacttgacaaacttgatggtcttcatcttcccgccatctgatatgtatactctgagcgggctggcaaggcgcatagnnnn

SEQ ID NO: 188137 - DNA, 130 bp, Homo sapiens
  misc_feature: GYAE6OF02G6KLK.48.61.F06.1.454.CMB.1.raw
  modified_base (129)..(130): a, c, t, g, unknown or other
  misc_feature (129)..(130): n is a, c, g, or t
tcagagtatacatacacgaccggtgctcgatttagctacgctctaagggaaggagaacttgacaacttgatggtcttcatcttccgccatctgatatgtatactctgagcggctggcaaggcgcatagnn

SEQ ID NO: 188138 - DNA, 113 bp, Homo sapiens
  misc_feature: GYAE6OF02GSPOW.48.61.F06.1.454.CMB.1.raw
  modified_base (113)..(113): a, c, t, g, unknown or other
  misc_feature (113)..(113): n is a, c, g, or t
tcagagtatacatacacgaccggtgctcgatttagctacgctctaagggaaaggttcttcatcttcccgccatctgatatgtatactctgagcgggctggcaaggcgcatagn

SEQ ID NO: 188139 - DNA, 135 bp, Homo sapiens
  misc_feature: GYAE6OF02F1MS2.48.61.F06.1.454.CMB.1.raw
  modified_base (134)..(135): a, c, t, g, unknown or other
  misc_feature (134)..(135): n is a, c, g, or t
tcagagtatacatacacgaccggtgctcgatttagctacgctctaagggaaagggagaacttgacaaacttgatggtcttcatcttcccgccatctgatatgtatactctgagcgggctggcaaggcgcatagnn

SEQ ID NO: 188140 - DNA, 578 bp, Homo sapiens
  misc_feature: GYAE6OF02GA5XB.48.61.F06.1.454.CMB.1.raw
  modified_base (402)..(402): a, c, t, g, unknown or other
  misc_feature (402)..(402): n is a, c, g, or t
tcagagtatacatacacgaccggtgctcgatttagctacgctctaagggaaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtgggggaaccaacattggaagaagaagtgtgcactggtaccagcagaagccaggccaggacccctctcgatgatcgtctatgatgatagcgaccggccctcgagggactcccgtgagcgagtcgctggctccaactctggcaacgacggccaccctggccatcagcgagggtcgaaggccgggganggacggccgtatacgttactgtcgagggtgtagggtataagtgggtggtgagtcgtagtccggtgttcgggcggagggaccaaggttcgaccgtaccgtagtccgacgcccgaaggtcctccgcccccgtcggtacctaccgttccgttaccggtcccccgtcccctccgttaccg

SEQ ID NO: 188141 - DNA, 498 bp, Homo sapiens
  misc_feature: GYAE6OF01BB066.12.50.E06.1.454.CMB.1.raw
  modified_base (206)..(206): a, c, t, g, unknown or other
  misc_feature (206)..(206): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
tcagatacgacgtacacgaccggtgctcgatttagatctactgacaacacacaagggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaanagtcaccctctcctgcagggccagtcagagtgttagcggcaactacttagcctggtaccaacagaaacctggccaggctcccaggctcgtcatctatgatgcatccaaaagggccactggcatcccagccaggttcagtggcagtgggtctggggcagacttcactctcaccatcagcagcctagagcctgaagatttgcagtttattactgtcagcagcgtagcaactggcctcggttcacttttggccagggaccagctggagntcaacgactgtggctgcacntctgtc

SEQ ID NO: 188142 - DNA, 199 bp, Homo sapiens
  misc_feature: GYAE6OF01C9HFE.12.50.E06.1.454.CMB.1.raw
  modified_base (175)..(199): a, c, t, g, unknown or other
  misc_feature (175)..(199): n is a, c, g, or t
tcagatacgacgtacacgaccggtgctcgatttagatctactgacaacacacaagggcccatcggtcttcccctggcaccctcctccaagagcacctcgtgggggcacagcggccctgggctgcctggtcaaggactattcctagtcgtatctgagcggctgcaaggcgcatagnnnnnnnnnnnnnnnnnnnnnnnnn

SEQ ID NO: 188143 - DNA, 510 bp, Homo sapiens
  misc_feature: GYAE6OF01CFY1X.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgtagcggcaactacttagcctggtaccaacagaaacctggccaggctcccaggctcgtcatctatggtgcatccagcagggccactggcatcccagacaggttcagtggcaggtggtctgggacagacttcactctcaccatcagtagactggagcctagaagtattttgctagtttattactgtcagcagtagtggggctcgacgtcgtattctacgtttcggccgtaggacctaagtagatgtacaagactgtgctcgcacatctgtcttc

SEQ ID NO: 188144 - DNA, 676 bp, Homo sapiens
  misc_feature: GYAE6OF01CPVIB.12.50.E06.1.454.CMB.1.raw
  modified_base (207)..(207): a, c, t, g, unknown or other
  misc_feature (207)..(207): n is a, c, g, or t
  modified_base (310)..(310): a, c, t, g, unknown or other
  misc_feature (310)..(310): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgttagcggcaactacttagcctggtaccaacagaaacctggccaggcctcccgaggctcgtcatctagtggtncatccagcgacgggccagtggcactcccgagacgtaggttcaggtcggctagggtgggtacgtggggaaccaggtaccttccgacttcctaccaaccagttcgaagtacgacgtacgggacgtccgtagtaagttagttttagacgttaagttttacttacgttcgtacgtacgtacgtaggttagggttcgggggtacctaccgtacggttacgtacgtttacccgttaccggttttcccgggcccgttacggggtaacccgtaaaggttacgtaacgttaacggttaccgtaaaaccggttaacggttcgggttacgggtccttacggtaccctaaccgtactttccgttcgttccctttaccg

SEQ ID NO: 188145 - DNA, 581 bp, Homo sapiens
  misc_feature: GYAE6OF01B1O34.12.50.E06.1.454.CMB.1.raw
  modified_base (207)..(207): a, c, t, g, unknown or other
  misc_feature (207)..(207): n is a, c, g, or t
  modified_base (371)..(371): a, c, t, g, unknown or other
  misc_feature (371)..(371): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaanagtcaccctctcctgcgagggccagtcagtagtgttagcggacaactacttagcctaggtaccaacagaaacctggccaggcctcccaggctcgtcatctagtggtgcatccgagcgacggccacgtgcactccgagactaggttcaggtggacaggtggtcgngggacagtacttcactctacacatacagtacgtacgtggacgtcgtagtaagtatttgacttagtttattacgtgtacagtacgtagtagtcgggtctcgtacgtcgtattacctacgttccggccgtacgggaaccttaaaggtcgaagttacgtaccgaaacgtacgttcggacggtacgtcgacctacgtattcttgtcctttaccg

SEQ ID NO: 188146 - DNA, 565 bp, Homo sapiens
  misc_feature: GYAE6OF01ELLUY.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaancgccaccttctcctgcagggccagtcagagtcttagcacctacttagcctggtaccaacagaaacctggccaggcctcccaggctcctcatctatgatgcataccgaaaagggccacgtggcactcccagcctaggttcaggtggctaggtgggtcgtgggcagtacttcactcacaccatcagcagcctagagctagagtatttgactagtttattactgtacagcagtacgtagactaacgtcggtccgttcggttaccttacgttttcgggacccgtacggggaaccaggtcgtaggagtacgtacgaaacgtacgttcggacggctacgctacctattccttgttcctttaccg

SEQ ID NO: 188147 - DNA, 607 bp, Homo sapiens
  misc_feature: GYAE6OF01EI92C.12.50.E06.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccgggggaaangtcaccctctcctgcagggccagtcagngtgttagcggcaactacttagcctggtaccaacagaaacctggccaggcctcccaggctcgtcatctatggtgcatccagcagggccacgtggcactcccagactaggttcagtgacgaggtgggtctgggacagtacttcactctcactatcagtacgacgtggacgtccgtagtaagtatttcgtacttagttttacttacgtcgtactagtcgtaggttaggtcggggtctaccgtaccggttcgtacgtttccttaccgtttcccgggtaccccggttacgggtaacccgtaaaggttacgtaagttacggtaaccgtaaacggtacgtggtacggctacgtaccaactacttcgttcgttcttacc

SEQ ID NO: 188148 - DNA, 665 bp, Homo sapiens
  misc_feature: GYAE6OF01BHRT6.12.50.E06.1.454.CMB.1.raw
  modified_base (208)..(208): a, c, t, g, unknown or other
  misc_feature (208)..(208): n is a, c, g, or t
  modified_base (269)..(269): a, c, t, g, unknown or other
  misc_feature (269)..(269): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccgggggaaangtccaccctctcctgcagggccagtcagagtgtagcggcaactacttagcctggtaccaanagaaacctggccaggcctccaggctcgtcatctagtggtcgcagtccaggcgacgggccacgtggccatccccagtacgaggttccaggtggctagggttgggtcctaggggactacggtaccttcaccttcgtaccacgtatcgaaggtacgacgtgggacgtccgtaggtaagttacgtttacggacgttaagttttacttacgtacgtacgtacgtacgtaggttaggtcggggtaccttacgtacggttccgttaactttccgttaccgtttcccgggacccgttacgggtaaaccgtaaaggttacgtaacggttacgtaaccgtaaacggtaacgttcgggttacggtaccgtacggtaccctaccgtacgttcgttcgttccgttaccg

SEQ ID NO: 188149 - DNA, 715 bp, Homo sapiens
  misc_feature: GYAE6OF01CJ35Q.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtcttgtcgtaccggggaaangtcaccctctcctgcaggccagtcagagtgtagcggactaactactagcctaggtaaccaacgtaacgaaacctggaccaagggtcctacccgaagggtccttacgtaccatccttaagtggtcgctacgtcccgagccgaacggggccctaacgtcgggactaacgttcccgaagaccgtaggtttccgaaggttggacgtagggtgggtacgtagggactagtacctttcaccgttcgtacaaccgtactcgtaacgtacgtacgtaggacgtaccgtagtaaacgttagtttacgtacttaagttttacgttacgtgtacgtagtacgtaggtacggtcgggggtactaccggtacgttacgtacgttaccgttaccgttttacccgggacccgttacgggaaacctaaaggtacgtaagttaccggtaaaccgtaaacggtacgttcgggtaccggtacgttacggacccgtaaccttaacgttccgttaccgttcttaacccg

SEQ ID NO: 188150 - DNA, 692 bp, Homo sapiens
  misc_feature: GYAE6OF01BSTPF.12.50.E06.1.454.CMB.1.raw
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccggggaaagagtcaccctctcctgcagggccagtcagagtgttagcggcaactactagcctggtaaccaacagaaacctggcccaggcctcccaggctcgtcatctacgtgggtcgcacgtccaggcgacgggccacgtcggacactcccgaagtacgtggttacaggtggcgtagggtcggtcgtagggaactaggtaccttccaccttctaccaaccgagtacgtaagtacgtacgttagggacgtaccgtaggtaaacgttagttttacgacttaagttttacttacgtcgttacgtagtccgtaaggttacgggtcggggtaccttacgtaccggttcggttaactttccggtaaccggttttcccggaccccgttaacggggtaaaccgtaaacggttacggtaacgtttacggtaaaccgtaaacggttaaccggttgggtaccggtacttaccggacctaccggtaactttctccggttcttaccgg

SEQ ID NO: 188151 - DNA, 538 bp, Homo sapiens
  misc_feature: GYAE6OF01AL7HA.12.50.E06.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctntcctgcagggccagtcagagtgttagcggcaactacttagcctggtaccaacagaaacctggccaggctcccaggcctcgtcatctagtggtgcatccagcacgggccacgtggcactcccagacaggttcagtcggcagtggctggacagtcttcactctcaccatcagtagactggacgccgtagaagtatttgtactagtttacttacgtgtcagtcgtagtagtgggctcgtacgtcgtattctacgttccggaccgtggacctaagtacgtatacgtacaacgtacgtcgtacgtcgtcgacactatcttgtcttcg

SEQ ID NO: 188152 - DNA, 703 bp, Homo sapiens
  misc_feature: GYAE6OF01B5SZ1.12.50.E06.1.454.CMB.1.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctccagataccaccggagaaattgtgttgacgcagtctcaggcaccctgtctttgcgtccgggggaaangtcacctctcctgcagggccagtcagagtgttagcggacaactacgttagcctaggtaaccaaacgaagaaaccctggacctaggcctacccgaggctcgtcattctagtggtcnctactccaagccgagggccctacgtgggacctacgtaccccgaagtaacgtacgggtttaccaaggttcgggacgtaagggtcgggtaccgtacggggaactacggtaaccgtttaccaccttcctaccgtaaccgtattccgtaacggtacgtacgtacgggtacgtaccgtaggtaaaggttacgttttacgtacgttacgttttacttaacgttacgtacgtagtactagggtacgtcgggggtccttacgtacgttaccgttacgttccgttacggtttccggacccgttacggaaccgtaaaggtacgtagtaggttaaccgaaagtacgtacggtacggtacgttacgtactaccgtagttacttcgttcgttaccg

SEQ ID NO: 188153 - DNA, 625 bp, Homo sapiens
  misc_feature: GYAE6OF01DOZMI.12.50.E06.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagatacgacgtacacgaccggtgctcgatttagatctactgacaacacacaaggggggagaagagctgctcagttaggacccagagggaaccatggaaaccccagcgcagcttctccttcctcctgctactctggctcccagataccaccggagaaattgtgttgacgcagtctccaggcacctgtcttgtctcggggaagngtcaccctctcctgcagggccagtcagagtgttagcggcaactactagcctggtaaccaacagaaacctggaccaggcctcccgaggctcgtcatctatggtncatccagcacgggccactggcactcccaagactaggtcaggtcggctaggtgggtcgtgggaaccagtacttcaccgttctacacctatcagtagacgtaggacgtcgtagaagttatttgacttagtttacttcgtgtacgacgtcgtaggttacggttcggggacttaccggtaccggttcgtacgtttaccgttaccgtttccgggcccgttacggggaacccctaaaggttacgtaacgtacggttaaccgaaaacggtacgttgggtacgtccgtacgtaccgtaaccctagtttccgtcgttccgtttaccc

SEQ ID NO: 188154 - DNA, 634 bp, Homo sapiens
  misc_feature: GYAE6OF01DBZL1.12.50.E06.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccgggggaaagngtccaccctctcctgcagggccagtcagagtgtagcggcaactactagcctggtaccaacagaaacctggccaggcctcccaggctcctcatctatggtncatccagcgacgggccacgtgcactcccagaccaggttcaggtggctaggtgggtctgggacagtacttcactctacaccatcagtacgacgtaggacgaccgtagtaagttagttttaggactttacgttttacgttaccgttgtacgtaggtacgtaggttagggtcgggggtccttacgtacggttcgttacttccgttaccgttttcccgggtcccgttacgggtaacccgtaaaggtacgtacgttacggtaacgtaaaccggtacgtcgggttacggtacctacggtacctaaccgtagtttaccgtgtttccttaccg

SEQ ID NO: 188155 - DNA, 514 bp, Homo sapiens
  misc_feature: GYAE6OF01B65T6.12.50.E06.1.454.CMB.1.raw
  modified_base (207)..(207): a, c, t, g, unknown or other
  misc_feature (207)..(207): n is a, c, g, or t
  modified_base (367)..(367): a, c, t, g, unknown or other
  misc_feature (367)..(367): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgtagcggcaactcttagcctggtaccaacagaaacctggccaggctcccaggctcgtcatctatggtgcatccagcagggccactggcatcccagacaggttcagtgcaggtggtctgggacagaccttnactctcaccatcagtagactggagccgtagtaagtatttgctagtttattactgtcagctagtgtggggctcgacgtcgtattcgtactttcggtccgtacgggacctaagtagatgtacaaagacgtgtgctcgcacatctgtctc

SEQ ID NO: 188156 - DNA, 687 bp, Homo sapiens
  misc_feature: GYAE6OF01DH5H3.12.50.E06.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctcaggcacctgtctttgtctccgggggaaancgtcacctctcctgcgaggccagtcagagtgtagcgcaactactagcctggtacaacgagaaacctggcaggcctccgagtctcgtnatctatggtncactccagcgacgggccacgtggcactcccgaagacgtaggttccaggtcggcgtagggtgggtcgtagggaacagtaccttcgacttcctaccacctagttacgaaggttacgacgttagggacgtaccgttaaggtaacgttagttttcggactttagttttacttacgttgtacgaacggtacgtagggttacggtcgggggtccttacggtacggttaccgttacgtttaccggtaccgttttcccgggtacccggtaagggtaaaccccgttaaggtaccggtagttacccggtaaacccgtaaaaccggttcccgttgggtaccggtaccgttacggaaccccttaccgtattttaccggtcgttttcccgttaacccg

SEQ ID NO: 188157 - DNA, 727 bp, Homo sapiens
  misc_feature: GYAE6OF01BUHUR.12.50.E06.1.454.CMB.1.raw
  modified_base (684)..(684): a, c, t, g, unknown or other
  misc_feature (684)..(684): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggcctcccagactaccgaccggagtaaattggtgttgacgcagtcctccgaggccacccttgttctttgtccggtaccgggggaaagcgtccacccctctccgtgccgacgggccagtcaggtagtgttacggcggactaacgttactacgccgtaggtaaccaacgaacgaaaccgtcggacccaaggccctacccgagggcctcgtactacgttccgtagttcgggtcactacgttaccccgaggaccggacgggaccctacggtcggaccctactaccccgaaggaccgtacgggtttacagggtcggcgtaggggttcgggtcgtaggggaacctacggtacccttactaccgtccgtaccaccgtaatccgaagttagaccggtgacgttaccgtagtaagttagtttacgacgttagttttacttagtcgtacgtagtcgtaggtcgggtcgggtcctacggtacgttacgtacttcccggttaccgtttccggaccggtaacggtaccgtaagtcggtaacgttcgtaaccgtaaggttacgngggttacgtccgtagacccgttactagtcttcgtccttaaccg

SEQ ID NO: 188158 - DNA, 945 bp, Homo sapiens
  misc_feature: GYAE6OF01B6KR7.12.50.E06.1.454.CMB.1.raw
  modified_base (132)..(132): a, c, t, g, unknown or other
  misc_feature (132)..(132): n is a, c, g, or t
  modified_base (266)..(266): a, c, t, g, unknown or other
  misc_feature (266)..(266): n is a, c, g, or t
tcagatacgacgtacacgaccggtgctcgatttagatctactgacaacacacaagggggggagaagagctgctcagttaggacccagagggaaccatcggaaaccccagcgtcagcttctctttcctcctcncctactctggcctcccagataccaccggagaattgtgttgacgcagtctccacggacctaccctgttcctttggtccggttaccgggggaaagtacgtccgtacccctctccgtagccgacggccagtccaggngttggttacgacggtctaacttacttacgcttacggtaaccaacgaacgaaccgtcggacccgaccggtaccgtaccgacggtaccgtccgtactacttacgtacgttcggtcgtactacgtaccgaacggtccggaacgggtacccgtacggtcggaccctaccgtacccgaacggtaccggtacgggttcggacgggttacgggtacggtacggggttccggggtaccggttaccgggaaccgtaaccggttacccgttaccgtaaccgttacccgtaacccgtaaacccggtaacgttaaccggtaacgggttaaccggtaacccgggttacgggtaaccgttaccgggttaacggttaaacggttttaacgttttaacggttaaccgtttaacggttttaaccgttaaccggttacggtaacggtaacggtaccgggttaacggggttacggggttccggggttaccgttaacgggttaccggtttaccgtttaccggtttaccggttaacccgggtttacccgggacccgggttaaccgggtaaaccggtaaacggttacgttaacggttaaccggttaaaccgttaaaccggttaccggtaccgggtacggttaccggtacccggttaacccggtaccgttacccggtttacgttaccggttcccgttacccg

SEQ ID NO: 188159 - DNA, 664 bp, Homo sapiens
  misc_feature: GYAE6OF01CBZ3S.12.50.E06.1.454.CMB.1.raw
  modified_base (208)..(208): a, c, t, g, unknown or other
  misc_feature (208)..(208): n is a, c, g, or t
  modified_base (456)..(456): a, c, t, g, unknown or other
  misc_feature (456)..(456): n is a, c, g, or t
tcagatacgacgtacacgaccggtgctcgatttagatctactgacaacacacaagggggggagaagagctgctcagttaggacccagagggaaccatggaaaccccagcgcagcttctcttcctcctgctactctggctcccaggtgccaccggagaaattctgttgacacagtctccagcccacctgtctttgtctccgaggggaancgccaccttctcctgcagggccagtcagtagtcttagcctacctacttagcctggtaaccaacacgaaacctcggaccaggcctcccaggtcctcctcatctatgatgaccagtaaccgaaagggccctacgtacggcactacccgagccgtaggttcgaggtgaccgtggtcgggtcgtgggacctagtacttacacgtctaccgactagtccagtccacgtcctaggacgtaccgtagtaacgttnttttacgacgttaagtttacttaccgttgaacccgtaggtaccgtaggttaccggtaagtaccgttaacggtccgggtacccgtttacggttcccttaacgggtttccggacccggtaccggggactaacgggtccgtaggtacgtacggtaaccgaaacggttacgtcggtacggacctacggactaccgtacgttcgtcggttacc

SEQ ID NO: 188160 - DNA, 687 bp, Homo sapiens
  misc_feature: GYAE6OF01A956M.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctgctcccagataccaccggagaaattgtagttgacgcagtctccaggcaccctgtctttgtctccgggggaaangtccaccctctcctgcagggccagtcagagtgttagcggcaactacgttagcctaggtacccaacacgaaacctggaccaagggcctacccgaggtcctacgtactacgtctagtggtcgactactccgacgcgacgggtccacgtcggactactccccagaccgtcggttcacggtggctaggtcggtcgtacgggaactaggtacctttccaccttcgtccaaccgtatacgaggtacgaccgtggacgtcgtagtaacgttagtttacgtacttaagtttacttacgttacgtacgtacgtacgtacggtaggtcggggtaccttaccgacggttacgtacgtttaccgtaccggtttccggacccgtacgggtaaccgtaaaggtacgtaacgttacggtaacgaaacggttaccggttcggttacggtaccgttacggtaccctaacgttacgttcccgttcgttcccttacccg

SEQ ID NO: 188161 - DNA, 177 bp, Homo sapiens
  misc_feature: GYAE6OF02G052J.12.50.E06.1.454.CMB.1.raw
  modified_base (175)..(177): a, c, t, g, unknown or other
  misc_feature (175)..(177): n is a, c, g, or t
tcagatacgacgtacacgaccggtgctcgatttagatctactgacaacacacaagggcccatcggtcttccctggcaccctcctccaagagcacctctgggcacagcggccctgggctgcctggtcaaggactacttcctacgtcgtatctgagcgggctggcaaggcgcatagnnn

SEQ ID NO: 188162 - DNA, 502 bp, Homo sapiens
  misc_feature: GYAE6OF02ILYIW.12.50.E06.1.454.CMB.1.raw
  modified_base (206)..(206): a, c, t, g, unknown or other
  misc_feature (206)..(206): n is a, c, g, or t
tcagatacgacgtacacgaccggtgctcgatttagatctactgacaacacacaagggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaanagtcaccctctcctgcagggccagtcagagtgttagcggcaactacttagcctggtaccaacagaaacctggccaggctcccaggctcgtcatctatggtgcatccagcagggccatggcatcccagacaggtcagtggcagtgggtctgggacagacttcactctcaccatcagtagactggagcctgaagatttgctagtttattactgtcagcagtatggggctcgacgtcgattcactttcggccctggaccaagtagatgtcaaacgaactgtgcgtgcaccatctgtctc

SEQ ID NO: 188163 - DNA, 521 bp, Homo sapiens
  misc_feature: GYAE6OF02HE6TR.12.50.E06.1.454.CMB.1.raw
  modified_base (206)..(206): a, c, t, g, unknown or other
  misc_feature (206)..(206): n is a, c, g, or t
tcagatacgacgtacacgaccggtgctcgatttagatctactgacaacacacaagggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaatagcgacttagcctggtaccagcagatacctggccaggctcccaggctcctcatctatgatgcatccaaaagggccactggcatcccagccaggttcagtggcagtgggtctggggcagtacttcactctcacatcagcagcctagacgcctgaagtatttgctagtttattactgtcagcagcgtagacaacgtcggccttcggttctacgttttcggccgtacggggaccaagcgtggagactacgaaacgtacgtacgtcggtctgactaccatcg

SEQ ID NO: 188164 - DNA, 176 bp, Homo sapiens
  misc_feature: GYAE6OF02FPN7S.12.50.E06.1.454.CMB.1.raw
  modified_base (176)..(176): a, c, t, g, unknown or other
  misc_feature (176)..(176): n is a, c, g, or t
tcagatacgacgtacacgaccggtgctcgatttagatctactgacaacacacaagggcccatcggtcttcccctggcaccctcctccaagagcacctctggggcacagcggccctgggctgcctggtcaaggactacttctacgtcgtatctgagcgggctggcaaggcgcatagn

SEQ ID NO: 188165 - DNA, 584 bp, Homo sapiens
  misc_feature: GYAE6OF02G3XWX.12.50.E06.1.454.CMB.1.raw
  modified_base (208)..(208): a, c, t, g, unknown or other
  misc_feature (208)..(208): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccgggggaaanagtccaccctctcctgcagggccagtcagagtgttagcgcaactactagcctggtaccaanagaaacctggccaggctccgaggctcgtcatctatggtncatccagcagggccagtggcactccccagactaggttcaggtggcaggtgggtctgggacagacttcactctacaccatcagtacgactggacgctagtaagtatttgacttagtttattacgttgtacagtcgtaggtaggtggggacttacgacggttcgtacgttccgtaccgtttccggtccgtacgggtaaccgtaaaggtacgtacgtacgtaacgaaacggtaacgtcgtaggtacgtagaccgtaacgtacgtacttcgttacctacg

SEQ ID NO: 188166 - DNA, 514 bp, Homo sapiens
  misc_feature: GYAE6OF02GQYAV.12.50.E06.1.454.CMB.1.raw
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtggtctgggacagacttcactctcaccatcagcagcctgcagtctgaagtattttgctagttttattactgtcagtcagtataataacttgttcctgtctctacttcgggacgggggacagggtggagtatacgaaacgactagtggctgctaccatcgtgtc

SEQ ID NO: 188167 - DNA, 545 bp, Homo sapiens
  misc_feature: GYAE6OF02HIIBM.12.50.E06.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
tcagatacgacgtacacgaccggtgctcgatttagatctactgacaacacacaagggggagaagagctgctcagttaggacccagagggaaccatggaaaccccagcgcagcttctcttcctcctgctactctggctcccagataccaccggagaaattgtgttgacgcagtctccaggcaccctgtctttgtctccggggaaanagtcaccctctcctgcagggccagtcagagtgtagcgcaactacttagcctggtaccaacagaaacctggccaggctcccaggctcgtcatctatggtncatccagcagggccacgtggcatcccagacaggttcagtggcaggtgggtctgggacaggaccttcactctacactntcagtagacgtggacgcctagaacgtagtttagcgtagtttattacgtgtcagtcagtagtggggctacgtacgtcgattcgtactttcggccgtcgggacgtagtacgtagtcgtaacaacgtaactgtacggcgttacgtaccgtatcgtacgttctctacg

SEQ ID NO: 188168 - DNA, 560 bp, Homo sapiens
  misc_feature: GYAE6OF02HTO7F.12.50.E06.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (338)..(338): a, c, t, g, unknown or other
  misc_feature (338)..(338): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaanagtcaccctntcctgcagggccagtcagagtgttagcggcaactacttagcctggtaccaacagaaacctggccaggcctccaggctcgtcatctatggtgcatccagcagggccagtggacatcccagacnggttcagtgcaggtgggtctgggacaggtcttcactctcaccatcagtacgactggagcctagtaagtatttgctagtttattacgtgtacagtctaggtaggtggggtctacgtacgtcgtacttacgtaccgtttccggcccgtacgggtaccgtaagtacgtagtacgtacgaaacgtacgtaggtcgtcgtacgacctacctactcgtcgtacttacg

SEQ ID NO: 188169 - DNA, 568 bp, Homo sapiens
  misc_feature: GYAE6OF02I13YT.12.50.E06.1.454.CMB.1.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgttagcggcaactacttagcctggtaccaacagaaacctggccaggcctcccaggctcgtcatctatggtncatccagcagggccacgtggcactcccagacaggttcagtggcaggtggtctgggacagacttcactctcaccatcagtagactggacgctgaagtatttgactagtttattactgtcagtcgagtagtggggtctacgacgtcgtattcgtacgtttccggcccgtacgggaacctaagtacgtagttacggtaaccgtaaacgtaacgtcggttacggtcgtacggacctaaccgtactccgttacgttaccttaccg

SEQ ID NO: 188170 - DNA, 587 bp, Homo sapiens
  misc_feature: GYAE6OF02GE7MF.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgttagcggcaactacttagcctggtaccaacagaaacctggccaggcctcccgaggctcgtcatctatggtgcatccagcgagggccacgtggaccactcccaagacaggttcaggtggcaggtgggtctgggacagtacttcactctaccacctatcagtagacgtggacgcgtagtaagtatttagctagtttattactgtctagactagtaggtggggtctacgtacgtcgtacgttcgttaccgtttccggtcccgtacgggtaaccgtaagtacgtacgtacgtaacgaaacgtaacgtcgtacggtcgtacgaccgtaaccgtacgtacgttcgtaccttaccg

SEQ ID NO: 188171 - DNA, 596 bp, Homo sapiens
  misc_feature: GYAE6OF02G5WM7.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgtagcggcaactacttagcctaggtaccaacagaaacctggccaggcctcccgaggcctcgtcatctatggtgcatccagcagggccagtggcatcccagacaggttcagtgcaggtggtctgggacagtacttcactctacacctagtcgagtacgacgtgggacgtccgtagtaaagttagttttcgacgttaagttttacttacgttgtacgagtaccgtaggtacggtcggggtctaccgtacggtcgtacgtttccgttaccgtttccggacccgttagggaacctaaaggtacgtagttacgtaacgtaaacgtacgtggtcggactacgacaccgtactcgttgttcttacg

SEQ ID NO: 188172 - DNA, 627 bp, Homo sapiens
  misc_feature: GYAE6OF02FVJHS.12.50.E06.1.454.CMB.1.raw
  modified_base (206)..(206): a, c, t, g, unknown or other
  misc_feature (206)..(206): n is a, c, g, or t
  modified_base (377)..(377): a, c, t, g, unknown or other
  misc_feature (377)..(377): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccggggaaanagtcacctctcctgcagggccagtcagagtgttagcggcaactacttagcctggtaccaacagaaacctggccaggctcccaggctcgtcatctatggtgcatccagcagggccactggcatcccagactaggttcaggtggctaggtgggtctgggacagacttcactcncaccatcgagtacgacgtggacgtcctaggtaaagttagttttagggaaatttttacgttaacgttagtactaaacgtaggtaccgttaagacctaaacgttccggtacccttaccccgtaccgttttccgggaccgggtaacggggtaacctaaagggtacggaagtactacggaacggaccggtaacgtcgggttacgggccttacgaccgtaccgtattccgttaggtcccttaccgtatttccccg

SEQ ID NO: 188173 - DNA, 240 bp, Homo sapiens
  misc_feature: GYAE6OF02FWSB3.12.50.E06.1.454.CMB.1.raw
  modified_base (177)..(240): a, c, t, g, unknown or other
  misc_feature (177)..(240): n is a, c, g, or t
tcagatacgacgtacacgaccggtgctcgatttagatctactgacaacacacaagggcccatcggtcttcccctggcaccctcctccaagagcacctctggggcacagcggccctgggctgcctggtcaaggctacttcctacgtcgtatcctgagcgggctggcaaggcgcatagnnnnnnnnnnnnnnnnnnnnnnnnnnnnnnnnnnnnnnnnnnnnnnnnnnnnnnnnnnnnnnnn

SEQ ID NO: 188174 - DNA, 566 bp, Homo sapiens
  misc_feature: GYAE6OF02H3TFT.12.50.E06.1.454.CMB.1.raw
  modified_base (207)..(207): a, c, t, g, unknown or other
  misc_feature (207)..(207): n is a, c, g, or t
  modified_base (309)..(309): a, c, t, g, unknown or other
  misc_feature (309)..(309): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaanagtcaccctctcctgcagggccagtcagagtgttagcggcaactacttagcctggtaccaacagaaacctggccaggcctccgaggctcgtcatctatggtncatccagcagggccacgtggcactcccagacctaggttcaggtggctaggtgggtctgggacagtcttcactctacacctatcgagtagacgtggngtctagaagtntttgacgtagtttattacgttgtacagtcagtcgtagctaacgtcggtccttcggttacttacgtttcggaccgtacgggtaccaagtcgtaggtagtactaacgaacggtaacgtcgtaggtcgtacgcctaacctacttcgtgttacc

SEQ ID NO: 188175 - DNA, 654 bp, Homo sapiens
  misc_feature: GYAE6OF02F6B9Q.12.50.E06.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctcgggggaaanagtcaccctntcctgcagggccagtcagagtgtagcggcaactacttagcctggtaccaacagaaacctggccaggcctccgaggctcgtcatctatggtncatccagcacggggccacgtggcatcccaagacaggttcaggtgnaggtgggtctgggacagacttcactctcaccagtcagtacgactaggagtcgtagaagttagtttagacgttagtttattaacttgtactagtacgtaaggtaggttcgggggtactacggtaccggttacgttacgtttccgttaaccgttttcccgggtacccggttaaccggggtaaacccgtaaacggttacggtaacgttacggttaaaccggaaaaccggtaacgttacgggttacggttaccggtaccggtaccgtaaccgttaaccgttcgtttaccggtttcctttaacccgg

SEQ ID NO: 188176 - DNA, 573 bp, Homo sapiens
  misc_feature: GYAE6OF02HY7YN.12.50.E06.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcacctgtctttgtctccgggggaaangtcaccctctcctgcagggccagtcagagtgttagcggcaactacttagcctggtaccaacagaaacctggccaggcctccgaggctcgtcatctatggtncatccagccagggccacgtggccactccagactaggttcagtggctagtgggtcaggacagtactcactctacaccatcagtacgacgtggacgccgtagaagtacgtttgacgttagttttaattacgttggtactagtactaggtacggtggggtactacgtacgtcgtacttcgtacgtttccggaccgttacggactaacggtagtacgtacgtaacgaacgtacgtaggtacgcgtacgactacctatcgttgtccttacg

SEQ ID NO: 188177 - DNA, 539 bp, Homo sapiens
  misc_feature: GYAE6OF02F9ZE8.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgttagcggcaactacttagcctggtaccaacagaaacctggccaggctcccaggctcctcatctatgatgcatccaaaagggccactggcatcccagccaggttcagtggcagtgggtctggggcagacttcactctcaccatcagcagcctagagcctagaagtatttgctagtttattactgtcagcagcgtagcaactggacctcggttactactttggcccgaggggacccaagtcgtaggaggtactacgaaaacgaacgttggtacggcttacggacctacccagttccgtgttcc

SEQ ID NO: 188178 - DNA, 660 bp, Homo sapiens
  misc_feature: GYAE6OF02GCNBX.12.50.E06.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (304)..(304): a, c, t, g, unknown or other
  misc_feature (304)..(304): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctccagataccaccggagaaattgtgttgacgcagtctccaggcaccctgtctttgctcggggaangtcacctntcctgcagggccagtcagagtgttagcggcaactacgttagcctggtaaccaacagaaacctggccaggctcccaggctcgtcatctagtggtncatccagcagggccacgtggcactccagacaggttcaggtggactaggtcgggtactgggaacacggtactttacacttcctacaaccgtatcgaagtagtacgtagggacgtccgtagaacgttatttcgacttagtttacgttacgtgttacagtacgaggttaggtcggggtcctacggtacgttacgtacgtttacgttacccgtttccggacccgttaagggtaacccgtaaaggttaccgtaacggttacggttaaaccgtaaaaccggttaacggttacgggttaacggtaccgttacggtaacccgttaacccggttaatttacccggttacgtttaccgttaacccg

SEQ ID NO: 188179 - DNA, 575 bp, Homo sapiens
  misc_feature: GYAE6OF02JUS6I.12.50.E06.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
tcagatacgacgtacacgaccggtgctcgatttagatctactgacaacacacaagggtgagaagagctgctcagttaggaccagagggaaccatggaaacccagcgcagcttctcttcctctgctactctgctccagactaccaccggagaattgtcgtgacgcagtctcaggcacctgtcttgcgtcggggaangtcacctcncctgcacggccagtcagagtgttagcggacatacttagcctgtacacagaactgcaggactccgaggcctcgtcactcagtggtcacnctccgagcgcgggccactcggacactcccgaagcgtacggttcaagtcggctaggtgggtcctagggactacggactttcgacgttcaacgcctagtcgtacgtacgtcgtacggacgtaccgtaggtaagtcgtttagaccgttaacgtttagttaccgtgtactacgtacgtagtacggtgggtacctcgtacgttcgtattacgttaccgttccgccgttagaaccgtagtacctagtaccgtagaactgtacgcgtactacggccacgtatccgtagtc

SEQ ID NO: 188180 - DNA, 545 bp, Homo sapiens
  misc_feature: GYAE6OF02F36I4.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtgttagcggcaactcttagcctggtaccaacagaaacctggccaggctcccaggctcgtcatctatggtgcatccagcagggccacgtggcatcccagacaggttcaggtggcaggtgggtctgggacagtacttcacttctcacctatcagtagactggagccgtagaagtagtttgctagtttattactgtcagtctagtagtggggtctcgacgtcgtacttcgtacgtttccggccgtgggaacctaagtagtagtacgtaacaaacgtacgtggtacgtcgtgacgacctagtctcgtcttacg

SEQ ID NO: 188181 - DNA, 837 bp, Homo sapiens
  misc_feature: GYAE6OF02HWQDX.12.50.E06.1.454.CMB.1.raw
  modified_base (206)..(206): a, c, t, g, unknown or other
  misc_feature (206)..(206): n is a, c, g, or t
tcagatacgacgtacacgaccggtgctcgatttagatctactgacaacacacaaggggggagaagagctgctcagttaggacccagagggaaccatggaaacccagcgcagcttctcttcctcctgctactctggctcccagataccaccggagaaattgtgttgacgcagtctccaggcaccctgtctttgcgtaccgggggaanagtcaccctctcctgcagggccagtcagagtgtagcgacaactactagcctggtaccaacacgaacctggaccaggcctcccgaggtcctacgtcattctagtggtgccagtccagtccgacgggccacgtcgggaccacgttacccccgaagtaccgtacgggttcgaacggttcgggaccgttaaggggtcggggttaccgtacgggggaacgtaacggttaccgtttaccgacctttacccggtccgaaaccctagttaccgaacggtacccgacggttaccccgtacggtacccgcggtttaaccgtacgggttaaacgttcgttttttagggaccttttaaagggttttttacctaccggtttacggtaacgttacggtaacccgttaaagggtttaaaccttaaaggtttaaccggttttcccggttaaccgttaccggtttaaccgtttccccgggtttaaacggggtttttcccggggggggaacccgggggggtttaacccgtaagggggtttacggtaaacggttaaccgggttaaaccggtaaaacgggtaccggtttacgggtaacgggtccgttaccggacccgttaacccggtaacgttcccggtttagttaccccg

SEQ ID NO: 188182 - DNA, 685 bp, Homo sapiens
  misc_feature: GYAE6OF02ICN8O.12.50.E06.1.454.CMB.1.raw
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccggggaaagagtccacccctctcctgcgacgggccagtcagtagtgttaggcggactaactacttacgcctggtaaccaacaacgaaaccgtggaccacgggcctcccgaggtcctcgtcatctagtggtgctatccagcgacgggccacgtggaccactcccaagacgtacggtcaggtggctaggtcggtcgtgggacagtacttcactcctcacctatacgagtacgacgtgggacgtacctaggtaactagtttcgacgttagtttaacgttacgttgtacgagtacgtaggttagggtcgggtactacggtacgtacgttacgttcccgtacggtttttcccggacccggttaacgggtaaccgtaaacggttacgggtaacgtttaaccggtaacggtaaaaccggttaacggttaccggttcgacccggttcgaacccggtttaaccgtacgtttccggttaccggttctttaaccccgg

SEQ ID NO: 188183 - DNA, 802 bp, Homo sapiens
  misc_feature: GYAE6OF02JUL5F.12.50.E06.1.454.CMB.1.raw
tcagatacgacgtacacgaccggtgctcgatttagatctactgacaacacacaaggggggagaagagctgctcagttaggacccagagggaaccatggaaaccccagcgcagcttctcttcctctgctactctggcctccagtactaccgaccggaagtaattgtgtcgacgctacgttcctccgacggcctaccgttcgttctttgtccggtaccgggggaaatcgtccaccctctccgtgacgacgggcctagtacagtacgttgtaacgcgactaactcgttacgccgttacgaaccaacgaacgaaaccgtcggaccgacggtacctcccggacggtcccgtacgtctaacttcgtaacgttcgggttacgacctaacgtcccgaacggtccggaaccgggacctaccggttaccgggaaccctaaccgttccccgaaggtaaccggttacggtttaccggacgggttacggaccgtagggttcgggtaccggtacgggaacgtacgtaccttcggtaccgtcctaccgacctagtaccgagtacgtacgtacggaacgtcgtagtaacgtttgtttacgaccgtttaagtttacgtacgttatcgtaccgtagtaacgggttgggtaacggtacccgttaggtacccgttacgttaacgttcccgtttaacggttcccggtaccggtaacgtaaaaccgggttagtaccggttaacgtacggtaaccgtaaacggttccggttaaggtaccggtctaacgtaacccgtacgttaccgtacgttcggttactttaacc

SEQ ID NO: 188184 - DNA, 585 bp, Homo sapiens
  misc_feature: GYAE6OF02IK8JO.12.50.E06.1.454.CMB.1.raw
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattctgttgacacagtctccagcccaccctgtctttgctccgaggggaaagagccaccttctcctgcgagggccagtcagagtcttagcactacttagcctggtaccaacagaaacctggaccaggctcccaggctcctcatctatgatgcactaccgaaaacggccacgtggcactcccacgccgtaggttcaggtcggacgtagtgggtcgtgggcagacttcgactctacactatcagcagaccgtagacgtcctaggtaacgtctttcgacttagtttacgttactgtacagtcacggtcgtagcaacgtcggtccttcggttacctacgttttcggaccgtacggggaccctaaggccgtacggacgtagtaaccgaaacgtacgttcgaggtcctacgacgtaccctaagtcctagttaccg

SEQ ID NO: 188185 - DNA, 717 bp, Homo sapiens
  misc_feature: GYAE6OF02F9QOC.12.50.E06.1.454.CMB.1.raw
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccggggaagagtccaccctctcctgcgagggccagtcagagtgtagcgacaactactacgcgtgaccaacagaaacctggaccaggacctcccgaggtctacgtcatcgtagtggtcgctactccgagccgacgggaccacgtggacctacctccgaagtacgtacggttacgacggtagggcctagggtcgggttacgaggggaactaggtaccttaccgacctcgtaccaacccgtatacgtaacgtacgtacgttacggaccgtacgttacgtaaacggtttagtttacgaactttaggttttaactacgttcgtacgtacggtagtacggtacggttcggggtactaccggttaccggttacgttaccgtttccgttaccggtttcccgtacccgggtaaccggtaaccgttaaagttacgtaacgttaccggtaaaccgtaaaccggttaacggttacggaccgttacgtaccgtaccccgtacgttacgttacccgttacggttaccttaaccg

SEQ ID NO: 188186 - DNA, 631 bp, Homo sapiens
  misc_feature: GYAE6OF02F3ECY.12.50.E06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaanagtcaccctctcctgcagggccagtcagagtgttagcggcaactacttagcctggtaccaacagaaacctggccaggcctcccaggctcgcatctatggtgcatccgagcacgggccacgtggcactcccagacaggttcagtggctaggtcgggtctaggggactagggtaccttccgactaccgttacaaccgtactaccgtaaggtaacgtaccgtagggtacgtccgttaggaaacgttattttacggactaaggttttaacttaacgttcgttacgacggtcgtagttagggttcgggggtacttcgtaacgtcgtacgttccgtaccgtttccggaccgttagggtaacctaagtacggtacgtacggtaacgtaaacgtacgtggtacgcgtcgacgacctatcgttagtcttaccg

SEQ ID NO: 188187 - DNA, 690 bp, Homo sapiens
  misc_feature: GYAE6OF02HBCF2.12.50.E06.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
tcagatacgacgtacacgaccggtgctcgatttagatctactgacaacacacaagggggggagaagagctgctcagttaggacccagagggaaccatggaaaccccagcgcagcttctcttcctcctgctactctggctcccagataccaccggagaaattgtgttgacgcagtctccaggcaccctgtcttgtctcgggggaaangtcacctctcctgcagggccagtcagagtgtagcggcaactacttagcctggtaccaacacgaaacctggccaggctcccgaggctcgtcatctagtcggtncatccagcgacggccagtggcactcccgagacgtacggttcaggtcggctagggtcggtcgtacgggactaaggtacctttacgaccttccgtaccaaccttagtcctaaggtaccggtacgtacgggaacgtccgtaggtaaagttacgttttacggtaccgttaggttttaacgttaaccgtttacgtacgtacggtacgtaaggttacgggtcgggggtactaccggtacggttaccgtaacgtttccgttaccgtttccgggtaccccgttacgggtaaccgtaaagggtacgtaacgtacggtaaccgtaaaaccgtacggttacggtacggtacctacggtaccgtaacctacgtttaccgtcggttaccttaccg

SEQ ID NO: 188188 - DNA, 827 bp, Homo sapiens
  misc_feature: GYAE6OF02IMFNV.12.50.E06.1.454.CMB.1.raw
  modified_base (705)..(705): a, c, t, g, unknown or other
  misc_feature (705)..(705): n is a, c, g, or t
tcagatacgacgtacacgaccggtgctcgatttagatctactgacaacacacaaggggggagaagagctgctcagttacggacccagagggaaccatggaaaccccagcgcagcttctccttcctcctgctactctggcctcccagactaccgaccggagtaaattgtgttcgacgtacacgtcctccgaggccctacccgttgttccgttttcggtccgttaccggggggtaaagacgtcccaaccccgtccttccgtgccgacgggtccgtacgtcgaaggtacgttacggttacggaccggtaccgtaaaccgttaacgttaccgtaaccggttccggttaaaccccaaaccgtaaacggttaaaacccgtccgggtacccgaccgggtaccccgtaaccccgaacgggtcccttccgtaccgaacgttccttaacgggttcggtacgtaccgtacgttccgacggtaccgaccggggtacccaggtacggacctacgtccccgaagtaccgtagggtacaggtcggacgttagggtcggtacgacggacgtacgtaccttacgtacctcaaccgactaactacgtacgtaacgtaccgggtcgaacggtacaacggttagttacgtttcggtaaactttcgttttaactacgttacgtagacgttacgtaaggttacgggtacggtacgttacgtaccgtnttaacgtttaccgtaccgtttaccggaccggtacgtaacgttagtaacgtcgtaacggtaaccgtaacgtacgtaggtacgtacgtaccacggtacccttagttcccgttacgtcctaaccg

SEQ ID NO: 188189 - DNA, 554 bp, Homo sapiens
  misc_feature: GYAE6OF01BEE4Q.40.23.C01.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (547)..(547): a, c, t, g, unknown or other
  misc_feature (547)..(547): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagctggtaccaanagaaacctggccaggctcccaggctcctcatctatgatgcatccagcagggccacgtggcactcccagccaggttcaggtcggcaggtgggtctgggacagtacttcactctcaccatcagcgcctagacgcctgaagtactttgactagtttattactgtcagcacgcgtaccaacgtcggccgtcgtctacgtttccgggacggtacgggaccgaagggtggacgtacgtaacgaaacgtacgtaggtcggtcgtgaccgaccgtattccgttagttccttcgtnttccccg

SEQ ID NO: 188190 - DNA, 505 bp, Homo sapiens
  misc_feature: GYAE6OF01BDS1E.40.23.C01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (261)..(261): a, c, t, g, unknown or other
  misc_feature (261)..(261): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtcttagcaactacttagtctggtaccaanagaaacctggccaggcctcccaggcctcctcatctatgatgcatccagcaggccatggcatcccagccaggttcagtgcagtggctgggacagcttcactctcacatcagcgcctagacgcctagaacgtctttgactagttttatactgtcagcagctaccaactggcctctcgtacgtttcggcggtacggaccaaggtggagtatacgaaacgctgnggctgccacatctagtcttcntcc

SEQ ID NO: 188191 - DNA, 513 bp, Homo sapiens
  misc_feature: GYAE6OF01D3G2Q.40.23.C01.1.454.CMB.1.raw
  modified_base (203)..(203): a, c, t, g, unknown or other
  misc_feature (203)..(203): n is a, c, g, or t
  modified_base (435)..(435): a, c, t, g, unknown or other
  misc_feature (435)..(435): n is a, c, g, or t
  modified_base (507)..(507): a, c, t, g, unknown or other
  misc_feature (507)..(507): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcgctagagcctgaagactttgactagtttattactgtcagcagcgtaccaacgtgccnctcgtacgtttcggcggagggaccgaaggtggagatacgaaacgacgtggtggctgcacctatctgtcttcnttcccg

SEQ ID NO: 188192 - DNA, 520 bp, Homo sapiens
  misc_feature: GYAE6OF01AUYXK.40.23.C01.1.454.CMB.1.raw
  modified_base (203)..(203): a, c, t, g, unknown or other
  misc_feature (203)..(203): n is a, c, g, or t
  modified_base (510)..(510): a, c, t, g, unknown or other
  misc_feature (510)..(510): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcgcctagagcctgaagtactttgctagtttattactgtcagcagcgtaccaacgtcggccgctcacgtttcggcggacgggaccgaaggtggagagtaccgaaacgacgtgtaggctgcaccatctgtcttctnttccttcccg

SEQ ID NO: 188193 - DNA, 535 bp, Homo sapiens
  misc_feature: GYAE6OF01A7LWV.40.23.C01.1.454.CMB.1.raw
  modified_base (203)..(203): a, c, t, g, unknown or other
  misc_feature (203)..(203): n is a, c, g, or t
  modified_base (523)..(523): a, c, t, g, unknown or other
  misc_feature (523)..(523): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcagggccatggcatcccagccaggttcagtggcaggtgggtctgggacagacttcactcacaccatccagccggctagacgctagaagtacttgctagtttatactgtcagcagcgtacaacgtggccgctcgtacgtttcgggcggacgggaccgaagggtcggaagacgtacgaaacggtacgtggtggctcggcaccgatctagttccttcncgttccgtcccg

SEQ ID NO: 188194 - DNA, 544 bp, Homo sapiens
  misc_feature: GYAE6OF01CZ2DS.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctcccaggcctcctcatctatgatgcatccagcaggccatggcatcccagccaggttcagtggcaggtgggtctgggacagcttcactctcacctatcagcgcctagacgcctagaacgtactttgctagtttactactgtcagcagccgtaccacgtcgccgctcgtacgtttcgggacgggacggaccgaagggtggagtacgtacgaaacgtaacgtggtacggtctcgacaccgtacttcgttagttccttcgtacgttcccg

SEQ ID NO: 188195 - DNA, 525 bp, Homo sapiens
  misc_feature: GYAE6OF01D1LQK.40.23.C01.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (443)..(443): a, c, t, g, unknown or other
  misc_feature (443)..(443): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctcctgcagggccagtcagagtcttagcaaactacttagtctggtaccaanagaaacctgaccaggctcccaggctcctcatctatgatgcatccagcagggccagtggcatcccagccaggttcagtcggcaggtgggtctgggacaggtacttcactctcaccatcagcgcctagacgtcctagaacgtactttgctagtttatactgtacagcagcgtacaacgtgccnctcgtacgttcggacggaggaccgagggtggagtacacgaaacgtagtgtgctgacacagttctcgtcttcactcgtacccg

SEQ ID NO: 188196 - DNA, 525 bp, Homo sapiens
  misc_feature: GYAE6OF01EW4A4.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccaggggaaangccaccctctcctgcagggccagtcagagtcttagcaactacttagtctggtaccaacagaaacctggccaggctcccaggctcctcatctatgatgcatccagcagggcccacgtggcatcccagccaggttcaggtggcaggtgggtctgggacagacttcactctcaccatcagcgctagagcctgaagtacttgactagtttacttactgtcagcagctaccactcggccgctcacgtttcggcggagggaccgaagggtgagacgtacgaaacgaacgtggtaggactgaccaccactctcgtcttctatccgtcccg

SEQ ID NO: 188197 - DNA, 512 bp, Homo sapiens
  misc_feature: GYAE6OF01B9ZJ4.40.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (505)..(505): a, c, t, g, unknown or other
  misc_feature (505)..(505): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctntcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcgctagagcctgaagactttgctagtttattactgtcagcagctaccaactggaccgctcgtacgtttcggcggagggaccaagggtggagatacgaaacgactgtggctcgcaccgatctagtcttncttcccg

SEQ ID NO: 188198 - DNA, 509 bp, Homo sapiens
  misc_feature: GYAE6OF01ASRUY.40.23.C01.1.454.CMB.1.raw
  modified_base (504)..(505): a, c, t, g, unknown or other
  misc_feature (504)..(505): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtgcagtgggtctgggacagacttcactctcaccatcagcggcctagagcctgaagactttgctagtttattactgtcagtcagcgtaccaactggccgctcacgtttcggcggtacgggaccaagggtggagagtacgaaacgactgtggctgcacatctgtcttnntccg

SEQ ID NO: 188199 - DNA, 529 bp, Homo sapiens
  misc_feature: GYAE6OF01AEDJE.40.23.C01.1.454.CMB.1.raw
  modified_base (202)..(202): a, c, t, g, unknown or other
  misc_feature (202)..(202): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaangccaccctctcctgcagggccagtcagagtcttagcaactacttagtctggtaccaacagaaacctggccaggcctcccaggcctcctcatctatgatgcatccagccagggccacgtggcactcccagccaggttcagtggcaggtgggtctgggacagtacttcactctcaccatcgagcgcctagacgcctagacgtacttgctagtttatactgtcagcagctacacgtgccnctcgtacgttcggcggaggacgtaggngagatacgaacgacgtgtaggctcggactacagttacttcgttacttctacttccgttccccg

SEQ ID NO: 188200 - DNA, 540 bp, Homo sapiens
  misc_feature: GYAE6OF01BC0QR.40.23.C01.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaangccaccctctcctgcagggccagtcagagtcttagcaactacttagtctggtaccaanagaaacctggccaggctcccaggctccncatctatgatgcatccagcagggccactggcatcccagccaggttcagtggcaggtgggtctgggacagtacttcactcncacctatcgagcgcctagacgcctgaagtctttgctagtttatactgtcagctagtctaaccacgtcggcctctcgtaccgtttcgggacggtacgggaccgtaagggtcggagtatacgaaacgtacgtggtaggctgaccactactcgttcgtcttacgcttcctacccg

SEQ ID NO: 188201 - DNA, 537 bp, Homo sapiens
  misc_feature: GYAE6OF01BOJWQ.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccagttcagtgcagtgggtctgggacagacttcactctcaacatcagcggctagacgctgaagactttgctagtttatactgtcagcagcgtaccaacgtcggccgctctacgtttcggacggacgggaccaagggtggaagactacgaaaacggtacgtggtacggcgtgaccacgacttccgtgttaccctcacgttcccttccccg

SEQ ID NO: 188202 - DNA, 537 bp, Homo sapiens
  misc_feature: GYAE6OF01B84PO.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggcctcccaggctcctcatctatgatgcatccagcagggccactggcatcccagccaggttcagtggcagtgggtctgggacagactcactctcaccatcagcgctagacgctagagtcttgctagtttatactgtcagcacgcgtaccacgtcggccgtctccgtacgtttcgggacggacgggaccgtaagggtcggagacgtacgaaacggaacgttggtcggctcgaccaccgtacttctagttccttcgacgttcccg

SEQ ID NO: 188203 - DNA, 519 bp, Homo sapiens
  misc_feature: GYAE6OF01CEDIP.40.23.C01.1.454.CMB.1.raw
  modified_base (442)..(442): a, c, t, g, unknown or other
  misc_feature (442)..(442): n is a, c, g, or t
  modified_base (488)..(488): a, c, t, g, unknown or other
  misc_feature (488)..(488): n is a, c, g, or t
  modified_base (513)..(513): a, c, t, g, unknown or other
  misc_feature (513)..(513): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccagtcagagtcttagcaactacttagtctggtaccaacagaaacctggccaggctcccaggctcctcatctatgatgcatccagcacgggccagtggcactcccagccaggttcagtgcaggtgggtctgggacaggacttcactctacacatcagcggctagcgcctagaacgtctttgctagtttatactgtcagcagtccgtaaccacgtcggccnctctacgttcgggcggagggaccagggtgagatcgaaacgacgtgnggctgacacctatcgtagtcttcgnttcccg

SEQ ID NO: 188204 - DNA, 530 bp, Homo sapiens
  misc_feature: GYAE6OF01C98OM.40.23.C01.1.454.CMB.1.raw
  modified_base (384)..(384): a, c, t, g, unknown or other
  misc_feature (384)..(384): n is a, c, g, or t
  modified_base (519)..(519): a, c, t, g, unknown or other
  misc_feature (519)..(519): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccaggggaaagagccaccctctcctgcagggccagtcagagtcttagcaactacttagtctggtaccaacagaaaacctggccaggctcccaggctcctcatctatgatgcatccagcagggccactggcatcccagccaggttcagtgcagtgggtctgggacagactcactctcaccatcagcgcctagcncctagaacgctttgctagtttattactgtcagcagtcgtaccaactcggccgctctacgtttcgggacggtacgggaccgtagggtggagactacgaaacgaacgtggtaggctgacacctagtcttgtctttcngttcctacccg

SEQ ID NO: 188205 - DNA, 547 bp, Homo sapiens
  misc_feature: GYAE6OF01AOVT9.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggcctccgaggcctcctcatctatgatgcatccagcgacgggccacgtggcactcccagccaggttcaggtggctaggtgggtctgggacaggtacttcactctcaccatcagcgctagacgcctagaacgtcttgactagtttattactgtcagcagtcgtaccacgtcggccgtctcgtacgttcggacggtacgggaccgtaagggtggagtacgtaccgaaacgtacgtaggtcggcgtagaccacgtattcgtgtcttcgacttcccg

SEQ ID NO: 188206 - DNA, 508 bp, Homo sapiens
  misc_feature: GYAE6OF01DAU6J.40.23.C01.1.454.CMB.1.raw
  modified_base (203)..(203): a, c, t, g, unknown or other
  misc_feature (203)..(203): n is a, c, g, or t
  modified_base (384)..(384): a, c, t, g, unknown or other
  misc_feature (384)..(384): n is a, c, g, or t
  modified_base (500)..(500): a, c, t, g, unknown or other
  misc_feature (500)..(500): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagggtcttagcaactacttagtctggtaccaacagaaaacctggccaggctcccaggctcctcatctatgatgcatcagcagggccactggcatcccagccaggttcagtggcaggtgggtctgggacagacttcactctcaccatcagcggctagngcctgaagtactttgctagtttatactgtcagcagcgtaccaactcggccgctctacgtttcggcggagggaccaggtggagagtacaaagactgtggctgccacatctgtcttcntcctcccg

SEQ ID NO: 188207 - DNA, 760 bp, Homo sapiens
  misc_feature: GYAE6OF01CL4BQ.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtcttagcaactacttagtctggtaccaacagaaacctggccaggcctcccgaggcctcctcatctatgatgcatccagcgagggccagtcggccactcccagccctaagggttccaggtcggaccgtagggttcggggtccgtaggggaactagggtaccttttccgaaccgttccctacccgaaccctaagttcccgaacgggtcccgggtacccgttaacgggaccgtaccccgttagggtaaacggttaccgttttacggtaaccgtttaacggtttttaacgttaacgttcggttaccgaggtaccgtaacggtacccgttaaacccgtaaccggttccgggaccccgtccgttacccgttaccggttttcccggggaccggggtaaccggggtacccggtaaagggggttcgggaacggtaaaccgtaaccggaaaaccggtaccgtagggttacgggtaccgttcggaccctaaccgtaacgttccgttaggtttacccgttccgtacccgttacccccgg

SEQ ID NO: 188208 - DNA, 540 bp, Homo sapiens
  misc_feature: GYAE6OF01E3MNO.40.23.C01.1.454.CMB.1.raw
  modified_base (203)..(203): a, c, t, g, unknown or other
  misc_feature (203)..(203): n is a, c, g, or t
  modified_base (528)..(528): a, c, t, g, unknown or other
  misc_feature (528)..(528): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctcctgcagggccagtcagagtcttagcaactacttagtctggtaccaacagaaacctggccaggctcccaggctcctcatctatgatgcatccagcagggccactggcactcccagccaggttcagtggcagtgggtctgggacagacttcactctcaccatcagccggacctagacgcctagaagtactttgctagtttattactgtcagcagccgtaccacgtcggccgtctctcgtttcgggcggagggaccgaagggtggagtatacgaaacggtacgtggtaggcctgaccacctattctgttaccttctnttccgttccccg

SEQ ID NO: 188209 - DNA, 531 bp, Homo sapiens
  misc_feature: GYAE6OF01ATXB8.40.23.C01.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaanagaaacctggccaggctcccaggctcctcatctatgatgcatccagcagggccactggcatcccagccaggttcagtggcaggtgggtctgggacaggacttcactctcaccatcagcggctagacgcctagaacgtactttgctagtttattactgtcagcacgtacgtacctacgtcgccgtcgtcctacgtttcggacggtacgggacgagggtggagactacgaaacgtacgtgtaggcgtagcacactctgtcttgcgttcccg

SEQ ID NO: 188210 - DNA, 540 bp, Homo sapiens
  misc_feature: GYAE6OF01E34R2.40.23.C01.1.454.CMB.1.raw
  modified_base (203)..(203): a, c, t, g, unknown or other
  misc_feature (203)..(203): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggcctcccaggcctcctcatctatgatgcatccagcgagggcccacgtggccacgtcccagcccagggttcaggtcggctaggtgggtctggggacaggtacttcactctacacctatcgagccgcctagacgcctagaacgtacttgcttagtttatactgtcagcagccgtacacgtgcctctcgtacgttcgggcggtacggacgaaggtggagacgtacgaaacgtctggnggcngaccactagtctatcttcncgttcccg

SEQ ID NO: 188211 - DNA, 576 bp, Homo sapiens
  misc_feature: GYAE6OF01AQX9E.40.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctntcctgcagggccagtcagagtcttagcaactacttagtctggtaccaacagaaacctggccaggctcccaggctcctcatctatgatgcatccagcagggccactggcatccccagccaggttcaggtggcagtgggtctgggacagacttcactctcaccatcagcggtacctagacgtcctgaacgtactttgactagtttatacgtgtcagcagtaccgtaccaacgtcggaccgtctactacgtttcgggacggtacgggtaccgaagggttcggagtacgtaccaaacggtacgtagggtaggccgttacgacccgtaacctacgttccgttaggttcccttcgtaaccgtttccccg

SEQ ID NO: 188212 - DNA, 562 bp, Homo sapiens
  misc_feature: GYAE6OF01BK0DE.40.23.C01.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (383)..(383): a, c, t, g, unknown or other
  misc_feature (383)..(383): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactactagtctggtaccaanagaaacctggccaggctcccaggctcctcatctatgatgcatccagcagggccacgtggcatcccagccaggttcagtggcagtgggtctgggacagacttcactctcacatcagcgcctagngcctagaagtcgtttgactagtttattactgtcagcacggctaaccgacgtcggacccgtctccgtacgtttccgggacggtaacgggaccaagggtacggaagtacgtaacgaaacgtacgttagggacggtctacgtacccaacgtacgttctcggttacctttccgtcgttccccg

SEQ ID NO: 188213 - DNA, 549 bp, Homo sapiens
  misc_feature: GYAE6OF01B3PVP.40.23.C01.1.454.CMB.1.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctcctgcagggccagtcagagtcttagcaactacttagtctggtaccaacagaaacctggccaggctcccaggctcctcatctatgatgcatccagcagggccagtggcatcccagccaggttcagtggcaggtgggtctgggacngacttcactctcaccatcagcgctagacgcctagaagtctttgactagtttattactgtcagcagcgtaccaacgtcggccgtctcgtacgtttcgggacgggtacgggaccgagggtggacgacgtacgaaaacggacgtggtaggctcgacctacacgttcgtacgttacttctcgttcccgttaccccg

SEQ ID NO: 188214 - DNA, 540 bp, Homo sapiens
  misc_feature: GYAE6OF01DXHX4.40.23.C01.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (533)..(533): a, c, t, g, unknown or other
  misc_feature (533)..(533): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctctcctgcagggccagtcagagtcttagcaactacttagtctggtaccaanagaaacctggccaggctcccaggctcctcatctatgatgcatccagcagggccactggcactcccagccaggttcagtggcaggtgggtctgggacaggtacttcactctcaccatcagcggcctagacgcctagaacgtactttgactagtttattactgtcagcagcgtaccaacgtcggccgtctccgtacgtttcgggcgggtacgggaccgaagggtcggaagactacgaaacgtaacgtggtggctacgcacctatctagttcttcncttcccg

SEQ ID NO: 188215 - DNA, 535 bp, Homo sapiens
  misc_feature: GYAE6OF01DZLOK.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtcttagcaactacttagtctggtaccaacagaaacctggccaggctcccaggctcctcatctatgatgcatccagcagggccactggcactcccagccaggttcagtggcaggtgggtctgggacagtacttcactctcaccatccgagccggcctagacgtcctagagtacttgactagtttattacgtgtcagcagtcgtaccacgtcgccgcttacgtacgtttccggcggacggacgtaacgggtaggagactacgaacgtaacgtgtaggctagcactactctgttctcgtcttcccg

SEQ ID NO: 188216 - DNA, 584 bp, Homo sapiens
  misc_feature: GYAE6OF01CC5GP.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtcttagcaactacttagtctggtaccaacagaaacctggccaggctcccaggcctcctcatctatgatgcatccagcagggcccagtggcactccccagcccaggttcagtcggcgaggtggggtctggggactaggacttcactctcaccatcgagtccggcctaggacgtcctagaacgtactttgacttagttttactactgtacagcagtaccgtacctaacgtcggaccctctaccgtacgtttcggggacggacggtaccgaagggtggaagtactaaccggaaacgtaacgtgggtacggcctaggaccctaccgtagttcctggttcctttcgactttccccg

SEQ ID NO: 188217 - DNA, 553 bp, Homo sapiens
  misc_feature: GYAE6OF01BYUFX.40.23.C01.1.454.CMB.1.raw
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaanagaaacctggccaggcctcccaggctcctcatctatnatgcatccagcagggccacgtggcactcccagcccaggttccaggtggcaggtcggggtctgggacagaccttcactctaccaccatcgagccggcctagacgcctagaacgtactttgactagtttattactgtacagcacgacgtaccaacgtcggccgtcctcgtacgtttcgggacggtacgggaccgagggtacggagactacgaaacgacgtcgtaggctcgacactacgtctgtctctctcgtcccg

SEQ ID NO: 188218 - DNA, 569 bp, Homo sapiens
  misc_feature: GYAE6OF01D973O.40.23.C01.1.454.CMB.1.raw
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagcccaccctctcctgcagggccagtcagagtcttagcaactacttagtctggtaccaacagaaacctggccaggctcccaggctcctcatctatgatgcatccagcagggccactggcatcccagccaggttcagtggcaggtgggtcnggggacagtactcactctcaccatcagcgcctagacgcctagaagtactttgcttagtttattactgtacagcacgcgtaccaacgtcggaccgtctcgtaccgtttcgggacgggagggaaccgaagggtacggaggtacgtacgaaaacggtaacgttaggtacgggtctacggccaacctacgttaccttagtttccttccgtaacttccccg

SEQ ID NO: 188219 - DNA, 536 bp, Homo sapiens
  misc_feature: GYAE6OF01CKFMX.40.23.C01.1.454.CMB.1.raw
  modified_base (203)..(203): a, c, t, g, unknown or other
  misc_feature (203)..(203): n is a, c, g, or t
  modified_base (347)..(347): a, c, t, g, unknown or other
  misc_feature (347)..(347): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaacctggccaggctcccaggctctcatctatgatgcatccagcagggccagtgcatcccagccaggttcagtgcagtgggtcngggacagacttcactctcaccatcagcgactagacgctagaagtacttgactagtttattacgtgtcagcagccgtaccaacgtcggccgtctaccgtacgtttccgggacggacgggaccgaagggtggagacgtacgaaacgtacgtagtacggcgtacgacaccgtactctagtcttcacttcccg

SEQ ID NO: 188220 - DNA, 573 bp, Homo sapiens
  misc_feature: GYAE6OF01BVCRT.40.23.C01.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgtttacacagtctccagccacctgtctttgctcaggggaaanagccaccctctcctgcagggccagtcagagtcttagcaactacttagtctggtaaccaanagaaacctggccaggctcccaggcctcctcatctatgatgcatccagcagggccatcggcatcccagccaggttcagtgcaggtggtntaggacngacttcactctacaccatcgagccgtcctagagccgtagaacgtctttagactagtttatactgtacagacaggtacgtactaaccgtcggccctcgtccgtacgttccgggaggtacgggaccgtaggtacggaatacgtacgaaaacggtcgttggacggtactcgacccaacgtacttccgttgttacccttaacctccgttacccgttaccccgg

SEQ ID NO: 188221 - DNA, 697 bp, Homo sapiens
  misc_feature: GYAE6OF01BDA4A.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccgaggggaangccaccctctcctgcgagggccagtcagagtcttagcaacttacttagtctggtaccaacacgaaacctggaccaggcctcccgaggcctcctcatctatgatgcatccgagcagggccacgtgcactcccagcctaggttcaggtcggactaggtcgggtcgtacgggacaggtaccttcaccttcaccacagtccgacggcccggtacctaggaccgtaccgtaggtaaacggttaccgtttagaccgttaaggtttttacttacgttgtaccgagtaccgtacgtaccggttaacccaaccggttcgggacccgtaccttaccggttaccggtttaccggggaccggggaacgggtaacccggtaaggggttcgggaaagtaccgtaaaccgaaaaccgggtacgttacgggttacgggtacccgttacggaccctaacccgtagtttcccttacggtttaccctttacgtaccctttcccggttacccccg

SEQ ID NO: 188222 - DNA, 591 bp, Homo sapiens
  misc_feature: GYAE6OF01DB2JJ.40.23.C01.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtcttagcaactcttagtctggtaccaanagaaacctggccaggctcccaggcctcctcatctatgatgcactccagccgagggccacgtggcactcccagccaggttcagtggctaggtcgggtcgtgggacaggtacttcactctcacatcagccgcctagacgcctagaacgtcgtttagacttagtttacttacgtcgtcacgtccagtaccgtaccaacgtcggcccgtaccgttctaccggtttccggggacggtaacggggacccgtaagggttcggaacgacgtaacgaaacgggtaacgtgggtacggctcggaccaccgtattccgttgttacctcgtacgtttcccg

SEQ ID NO: 188223 - DNA, 590 bp, Homo sapiens
  misc_feature: GYAE6OF01AFPLM.40.23.C01.1.454.CMB.1.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccaggggaaangccaccctctcctgcagggccagtcagagtcttagcaactacttagtctggtaccaacagaaacctggccaggcctcccaggctcctcatctatgatgcatccagcagggccatggcatcccagccaggttcagtgcaggtggtctgggacaggtacttcacgtcacacntcgagcggcctagcgcctagaacgtctttgactagttttatacgtgtacacgcacgcgtaaccaacgtcgggccctacgttacgtaccggttacgggacgggtacggtaaccgtaaggggttcgaacggtactaccgaaaacggtacgttcgggtggacctcggacctaaccctacgtttacctcggttaccttccgtaacgttcccgttacccccgg

SEQ ID NO: 188224 - DNA, 540 bp, Homo sapiens
  misc_feature: GYAE6OF01DWGJV.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccatggcactcccagccaggttcagtggctaggtgggtctgggacagacttcactctcacatcagcgcctagacgcgtagaagtactttgactagtttattacgtgtacagtcagtccgtaaccgacgtcggcctcgttcgtacgtttcgggacgggtacggaccgaagggtgaagactaacgaaacgactggtcggctcgcacctattctagttctcgtcttcccg

SEQ ID NO: 188225 - DNA, 534 bp, Homo sapiens
  misc_feature: GYAE6OF01ATG6V.40.23.C01.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (384)..(384): a, c, t, g, unknown or other
  misc_feature (384)..(384): n is a, c, g, or t
  modified_base (527)..(527): a, c, t, g, unknown or other
  misc_feature (527)..(527): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactcttagtctggtaccaanagaaacctggccaggctcccaggctcctcatctatgatgcatccagcagggccactggcatcccagccaggttcagtggcagtgggtctgggacagacttcactctcaccatcagcggcctagngcctgaagctttcgctagtttattactgtcagcagtcgtaccacgtcggccgtctcgtacgtttcgggaccggtacgggaccgaagggtcggagagtaccgaaacgtactggtacggctcgaccacctatcttgtccttcgtnttccccg

SEQ ID NO: 188226 - DNA, 540 bp, Homo sapiens
  misc_feature: GYAE6OF01EZOJH.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctctcctgcagggccagtcagagtcttagcaactacttagtctggtaccaacagaaacctggccaggctcccaggctcctcatctatgatgcatccagcgagggccacgtggcacgtcccagccaggttcaggtggcaggtgggtctgggacagtacttcactctcaccatcacgcgcctagacgctagaatacgtttgactagtttacttactgtcagcagtaccgtaccgacgtcgcccgtctcgtacgttcggacggacggacgaaggtgagactacgaaacgtacgtggtcggctacgaccactacgttctagtccttcgcgttcccg

SEQ ID NO: 188227 - DNA, 705 bp, Homo sapiens
  misc_feature: GYAE6OF01EXJM6.40.23.C01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (358)..(358): a, c, t, g, unknown or other
  misc_feature (358)..(358): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaanagaaacctggccaggcctcccaggcctcctcatctatgatgcatccagcgacgggccagtggcatcccgagccaggttcaggtgcgtaggtgggtcnggggactaggtacttcacgtctacacctatcgacgcgcctagacgtccgtagaacgtactttcgacttaagttttacttacgttcgtacgagtaccgtaacgtacccggttaaccaacggttcgggtaccccgtaccgttaccgttaaccgggttttacccgggggacgggtaaaccggggtaacccgtaaagggggttaccgggaaacgggttaaaccgtaaacccggtaaaaaccgggttaaccggttaggggttaccgggtaccgttaccgggtacccctaaacccgttacggtttacccgtttaccgtttacccgttttacccgtaccggttttaccccccgg

SEQ ID NO: 188228 - DNA, 640 bp, Homo sapiens
  misc_feature: GYAE6OF01EK62G.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccgaggggaaanagccaccctctcctgcagggccagtcagagtcttagcaacttacttagtctggtaccaacagaaacctggccaggcctcccaggcctcctcatctatgatgcatccagcgagggcccacgtcggcactcccagcctaggttcaggtggctaggtgggtcgtgggacaaaggtcttcacttcctacacatcgacggccgtacctagacgtccgtagtaacgtacgtttgacttaagttttacttacgttgtacgacgtacgtacgtaccgttaccacgttcggcctacttcgtacggtttccggggacgggtaacgggaccgtaaggggtacgaacgtacgtaaccgaaaaccggtacgttcgggtacggtaccgtcggaccctaacccgtcgtttaccgttccgttacctttccgtcccgtttcccgttacccccg

SEQ ID NO: 188229 - DNA, 585 bp, Homo sapiens
  misc_feature: GYAE6OF01AYKQQ.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcaggtggcaggtgggtcgtggggacaggtacttcactctacaccatcacggccggacctaggacgtcctagaacgtactttgacttaagttttacttacgtgtcagcacgcgtaaccacgtcggccgtacttcgtaccgtttcgggacgggtaacgggaaccgtagggtggaagtacgtacgaaaacggtacgtggtcggacgtcgaccacctacgttccttagttaccttctactttcccgttaccccg

SEQ ID NO: 188230 - DNA, 561 bp, Homo sapiens
  misc_feature: GYAE6OF01A5IIC.40.23.C01.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (511)..(511): a, c, t, g, unknown or other
  misc_feature (511)..(511): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtcttagcaactacttagtctggtaccaanagaaacctggccaggctcccaggctcctcatctatgatgcatccgagcgagggcccacgtggcactccccagtccgaggttccagtcggctaggttgggtcgtgggacagacttcactctcactatccgagcggtacctagcgacctagaacgtacgtttgacttaggtttactacttgtacagcagtaccgtaccgactcggcctacgtcgtaccgtttccggcggtacggaccgtaggtcggacgtanacgaaacgtcgtaggcggtctgcaccgtctacgtactcttctcgttcccg

SEQ ID NO: 188231 - DNA, 637 bp, Homo sapiens
  misc_feature: GYAE6OF01CPF21.40.23.C01.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagngccaccctctcctgcagggccagtcagngtcttagcaactacttagtctggtaccaacagaaactggccaggctcccaggctcctcatctatgatgcatccagcgacgggccacgtggaccactccccgagcctaggttccaggtcggcaggttcgggtctggggacacggtacttcactctacaccagtcaggccgtctagacgccgtagaacgttacgtttacgacgttaagttttacttacgtacgttcacgcgtaacggccgttaacccgaacgttcgggcccgtcgtacgtaccgtttccgggaccgggtaacgggtaaccgtaacgggtacggtacgtaacgtaaaccgaaacggtaacgttacggtgggactcggaccaacccgttacgtccgttacgttaccttactacgttccccgttaccccg

SEQ ID NO: 188232 - DNA, 597 bp, Homo sapiens
  misc_feature: GYAE6OF01BDPVT.40.23.C01.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtcttagcaactacttagtctggtaccaanagaacctggccaggctccgagcctcctnatctatgatgcatccagcgagggccagtggccatcccagcctaggttcagtggcaggtgggtcgtgggactaggtacttacacctcgtaccaaccatcgagcgacctagacgtaccgtagaacgtactttgacttaagtttattacttgtactagacagtaccgtaaccgaacgtcggacccgtctaccgtaccgtttcgggacggtaacgggaccgtaagggtggaacgtacgtaaccgaaacggtacgttggtacgggtactcgaccgaacctacgttccgtatttccttactaccgttccccg

SEQ ID NO: 188233 - DNA, 746 bp, Homo sapiens
  misc_feature: GYAE6OF01E389V.40.23.C01.1.454.CMB.1.raw
  modified_base (207)..(207): a, c, t, g, unknown or other
  misc_feature (207)..(207): n is a, c, g, or t
tcagtctagcgactcacgaccggtgctcgatttagtacacgtgattagggagttggggggaggaactgctcagttaggacccagagggaaccatggaacgccccagctcagcttctcttcctcctgctactctggctcccagataccaccggagaaattgtgtttacacagtctccagccaccctgtctttgtctccgaggggaaangcccaccctctcctgcagggccagtcagagtcttagcaactacttagtctggtaccaacagaaaccgtggccaggcctcccgaggcctcctcatctatgatgcatccagcgacgggccacgtcggcactccccgagcccgtagggtttccagggttcggaccgtagggtcggggttcgtacgggggaacacggtacttccgacttcctacccacctatccgacggtcccgggtacccgtaagggaccgaccccggtaaagttccttttaggaccttaaggtttttaacttacgttcgtacgaacgtcgaacggtacccgttaaccgtaaccgttcgggaccccgtccttccgttaaccggttttcccgggggaaccggggtaaccggggaacccgtaagggggttacgggaaacgtaacggttaacccgaaaaaccgggtaacgttcgggttacgggtaccttacgggacccctaaaccctacgtttaccgttaccgtttccttaccgtaccgttttaccccgttccccggttaacccg

SEQ ID NO: 188234 - DNA, 876 bp, Homo sapiens
  misc_feature: GYAE6OF01CZWST.40.23.C01.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
tcagtctagcgactcacgaccggtgctcgatttagtacacgtgattagggattgggggaggaactgctcagttaggacccaggagggaaccatggaagccccagctcagcttctcttcctcctgctactctggctccagataccacggagaaattgtgttacacagtctccagccacctgtcttgctcgagggaaancgccaccctctccngcgacgggccagtcagacgtcttagactaactacgttagtccgtaggtaacccaanaacgaaaccgtcggaccgacggcctacccgaaggtccttaccctacctattacctaagttcggaattcggacctaacttacccgaacggaccgaacggggtcccaacggtcggacctaaccgtaccccgaagcccgtagggttaccgaggtcgggacgtacgggttcggggtaccggttacgggggaaacctaacgggttaacccgtttacgtaacctttaccccgtacctaaacccgtaacgttaccgggaaccgggttcccgggaacccggttaacgggacgtaccccgggtaaggtaaaccgttaacgttttcggaacgttttaaacgtttttaacgtttaccggttacgtaccgtaacggaccgtaaccgggtaacccttaaccgtaaccgggtcgggtaccctaccgttacggtacccgggtttaccggggaaccggggtaacgggtaaaccggtacggggtagggaaacctaacgggtaaaaccgaaaaccgggtaacgtttcgggggtacggtacccgttaggaaccccgtaaaccgtttacggttaccgtttaccggtttaccgttacccttaaccggttcccccgtttaaaccccccggg

SEQ ID NO: 188235 - DNA, 576 bp, Homo sapiens
  misc_feature: GYAE6OF01D56YS.40.23.C01.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (566)..(566): a, c, t, g, unknown or other
  misc_feature (566)..(566): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagcccaccctctcctgcagggccagtcagagtcttagcaacttacttagtctggtaccaacaggaaacctggccaggcctcccgaggcctcctnatctatgatgcatccagcagggccacgtggcactcccagccaggttcaggtcggctaggtgggcgtgggacagtacttcactcncacatcgagccgactagacgcctagaactacgtttgacttaagtttacttacgtgtcagtcgacgtaccgtaccacgtcggccgctacgtacgtttcgggacggaacgggtaccgtaagggtcggaagtactaacggaaaccgtacgttggtcggcgtacgccaccgtacgttctgttcccttnacgttccccg

SEQ ID NO: 188236 - DNA, 548 bp, Homo sapiens
  misc_feature: GYAE6OF01A92GQ.40.23.C01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (379)..(379): a, c, t, g, unknown or other
  misc_feature (379)..(379): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctcctgcagggccagtcagagtcttagcaactacttagtctggtaccaanagaaacctggccaggcctccaggcctcctcatctatgatgcatccagcagggccagtggcactcccagccctaggttcaggtggcaggtgggtctgggacaggtacttcactctcacntcagcgctagacgcctagagtacttgctagtttacttacgtgtcagtcgacgtccgtaaccacgtcggccgctccgtacgtttcgggacggtacggaccgtagggtgagagtacgaaacgtacgtggtgcgtcgaccacgtacttcgtagttcttctcgttcctacccg

SEQ ID NO: 188237 - DNA, 637 bp, Homo sapiens
  misc_feature: GYAE6OF01BX9H1.40.23.C01.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (390)..(390): a, c, t, g, unknown or other
  misc_feature (390)..(390): n is a, c, g, or t
  modified_base (618)..(618): a, c, t, g, unknown or other
  misc_feature (618)..(618): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccacggagaaattgtgtttacacagtctccagccacctgtctttgctccgaggggaaancgccacctctcctgcaggccagtcagagtcttagctaactacttagtctaggtaccaanagaaacctggccaggcctcccgaggcctcctcatctatgatgctatccagcgaggccacgtggccactcccagccgtaggttcaggtggcaggttcgggtctgggactaggtaccttcgactctacactancgacgccgacgtagacgtcctagaacgttactttgacgttagttttatacgttgtacacgactacgacgttaccaaccgttcgggacccctattacccgtacggttttaccgggaccgggtaacggacccggtaagggtaccgggtaagaaccttaccggaaaaacggttaccgtgggtacggtccggtacgtaccgaaccctacgtttcggtacgtttaccttaccncgtttccccttacccccgg

SEQ ID NO: 188238 - DNA, 756 bp, Homo sapiens
  misc_feature: GYAE6OF01A4NBA.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagcccaccctctcctgcagggccagtcagagtcttagcaactcttagtctggtaccaacagaaacctggccaggcctcccaggcctcctcatctatgatgcatccagcgagggccatggcactcccagccaggttcagtcggcaggtgggtctggggacaggtacctttcaccttctaccgaacccagtccgaaggtccggaccgttaacggacgtcccgttaggaaacggttaccttttacggacctttaaggtttttaactttaaccgttacggtttaccgaacggtacccgtaacggtaccccgttaaacccgtaaccggttaccgggtaccccggtaccctttaccggtaacccggtttttaccggggacccgggggtaacggggtaaccccggtaaaggggttaccgggaaacggtaaacgttaacccgggtaaaaaccggtaacccggtttacgggttacggggtaccgttaccgggtaacccgtaaccccgttaacggtttaccccgtttaacggtttcccctttacgttacccgtttacccccgg

SEQ ID NO: 188239 - DNA, 640 bp, Homo sapiens
  misc_feature: GYAE6OF01CUHKF.40.23.C01.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (590)..(590): a, c, t, g, unknown or other
  misc_feature (590)..(590): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttacacagtctccagccaccctgtctttgtcctccgaagggaaacgacgccacccttctcctgcgagggccagtacagagtcttagcaaactacgttagtctcggtaaccaanaacgaacctggccaggtcctccgaggcctcctnacttctatgatcgcatccagcgacggtccacgtggactacgtcccgagccgtaggtcaggtcggcgaggtcggtcgtggacacgtctcactcgtacaacatacgacgccggtacaggtcgaccgtaggtactacgtttgactttaggtttaacttacgttcggtaccaggtaccctaagtacccgttaacgtaccggttcggaccgttacctacccggttacgggttaccggggacggtacggaaccgtacggtaggaacacgtaacgaaacgtacgtggacggtntaacgccaacgttgttaccgttctacgtttaccgaccttcccggttaccc

SEQ ID NO: 188240 - DNA, 558 bp, Homo sapiens
  misc_feature: GYAE6OF01CD7I3.40.23.C01.1.454.CMB.1.raw
  modified_base (203)..(203): a, c, t, g, unknown or other
  misc_feature (203)..(203): n is a, c, g, or t
  modified_base (550)..(550): a, c, t, g, unknown or other
  misc_feature (550)..(550): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggctcccaggctcctcatctatgatgcatccagcgagggccacgtggcactcccgagccaggttcaggtggcaggtgggtctgggacagtacttcactctcaccatcgagcggcctagacgtcctagaacgtactttgtactagtttattactgtacgacgcacgaccgtaccaacgtcggaccgtcgtcgtacgtttcgggacgggtacgggaccgaagggtacggagactacgaaacgtacgtagtaggctagccgactacttctagttccttntcttcccg

SEQ ID NO: 188241 - DNA, 757 bp, Homo sapiens
  misc_feature: GYAE6OF01AHXEH.40.23.C01.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (738)..(738): a, c, t, g, unknown or other
  misc_feature (738)..(738): n is a, c, g, or t
tcagtctagcgactcacgaccggtgctcgatttagtacacgtgattagggagttgggggaggaactgctcagttaggacccagagggaaccatggaagccccgagctcagcttctcttcctcctgctactctggctccagataccaccggagaaacttgttgtttacacagtctccagccacctgtcttgtctccaggggaaangccaccctntccgtgcagggccagtccgagngtcttagcacttactagtctggtacccaanagaacctggaccaggtcctccaggctaccctcgatctaagtcgacgtcggcaacgttccaaggccgaacggggcctacgtacgggcctaaacgttccccgaagggtcccctaaggggttttccaacgggtttcggggaccgtaagggttcggggttactcgggggaacctaaggtactttccgaactttcccggcctaaaccgattccgaaacggtccgggtaccgttaacgaacggtccgtagtaaccgtaaccgtttgtaccgtaacggttttattaacccgttgtaccgtacgtaccgtaaggtcccgttaaacgaccgtacggtacccgtccttaaccggttaccgtttcgggaccgggtacgggtaacccggtaaggggttagggaaccgtaggttccgaaaaacggttcccggtaagggtccggtacggtcggacgtacctacgggttaccttacggtactttaacnccgttaaccgttaccccgg

SEQ ID NO: 188242 - DNA, 710 bp, Homo sapiens
  misc_feature: GYAE6OF01DTO7M.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagactaccaccggagtaattgtgttgacacagtctccagccaccctgtctttgtcctcgaagggaancgcctaccctctcctgcgaggccagtcagtagtcttagactaacttacttacgtctaggtaacccaacgagtaaaccgtggaccgacggccctacccgacggtccttcccgtacacttcctagtgacttcgacctacgtccaaggccgacgggcctacggtcggaccctacgtaccccgacggtaccgtacgggttacgaggttcggacgtacgggttcgggtacgttcgggaactacgtacctttcgaccttcgtacacctatacgagtacggacctagacgtacgtagtaacgttacgtttgactttagtttacttacgttctacgtacgtccgtacgaccgttaaccacggtccggtaccgtccgttaccgttacggtttaccgggaccggtaacgggtaaccggtagggtacgacgtaacgttaaccgaaaccggtacgtacgggtcgtaccgtacggtaacccacgtactttccgttagttacctttccgtacgtttccccg

SEQ ID NO: 188243 - DNA, 635 bp, Homo sapiens
  misc_feature: GYAE6OF01EKHRF.40.23.C01.1.454.CMB.1.raw
  modified_base (203)..(203): a, c, t, g, unknown or other
  misc_feature (203)..(203): n is a, c, g, or t
  modified_base (279)..(279): a, c, t, g, unknown or other
  misc_feature (279)..(279): n is a, c, g, or t
  modified_base (361)..(361): a, c, t, g, unknown or other
  misc_feature (361)..(361): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaangccaccctctcctgcaggccagtcagagtcttagctaactacttagtctggtaaccaacagaaacctggccaggcncccaggctcctcatctatgatgcatccagcgacggccacgtgcactcccgagccgaggttcaggtcggactgggtcggtcgngggacctaggtacttcgaacctctaccgacctagtccgacggccggacctaaggcgaccttaaggaactacgtttgacttaagttttactacttgtacaggacctacggacctaaccgacgttccggaccgtccgacgttaccgttcggggacgggacggtaaccggaaggtacgggaagtaccgtaaaccggtaaacgtaccggttagggtcggtaccgtacgacccaaccgttacgttccgttacgttaacccgttctaaccgtttcccccg

SEQ ID NO: 188244 - DNA, 728 bp, Homo sapiens
  misc_feature: GYAE6OF01BG9Q2.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtcttagcaactacttagtctaggtaccaacagaaacctggaccaggcctcccgaggcctcctcatctatgatgcatccagcgagggccagtcggacactcccgagcctaagggttcaggtaggccgagggttcggggtcgtggggaactaggtacctttccgaacttccgtacacctacgtacgacggtccggtacctaggaacggtcccgttaaggtaaacgttaaccgttttcggacgtttaagtttttaacttaaccgttcggttaccaacggtacctaacggtaccgtaaccctaacgttccgggtacccgtaccgttacccgtttaccggtttaccgggggacggtaacggggtaacccggtaaaggggttaccgggaaggtaacgtaaacccggtaaaacggtacccggtttagggtacggcgttaaccggaccgttaacccgtacgttacccgttagtttacccgttacgttacccgtttacccccg

SEQ ID NO: 188245 - DNA, 706 bp, Homo sapiens
  misc_feature: GYAE6OF01CEY3R.40.23.C01.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccacggagaaattgtgtttacacagtctccagccaccctgtctttgtctccgaggggaaangccaccctctcctgcgagggccagtcagagtcttagcaactacttagtctggtaccaacagaaacctggccaggcctccaggctcctnatctatgatgctatccaggccgacggggcccacgtgggaccacgtccccaagcccgtagggttaccgaggttcggggctaagggttcggggtcgtacggggactaacggtcctttcgaacccttctacccacctaacgtccgacgggccggtacccgtaagggaccgtacccgttaaggtaaacgttaccgtttggtaacgttaagtttttaacttacgttgtacgacgtacgcggtaaccgttaacccaacggttccgggccctactaccgttacggtttccggggaccgggtaaccgggtaaccggaaggggtcggaaacgtagtaaaccggaaaacgtaccggttggtacgggtctaccggacctaacctcgttaccttacgttaccgtttaccaccgtttcccgtacccccg

SEQ ID NO: 188246 - DNA, 617 bp, Homo sapiens
  misc_feature: GYAE6OF01A5ERN.40.23.C01.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctccngcagggccagtcagagtcttagcaactcttagtctggtaccaacagaaacctggccaggctcccaggcctcctcatctatgatgcatccagccgagggccacgtggccactccccgagtcctaggttcaggtcggcgtaggtgggtcgtagggactacgtacttcacgttctccgacctagtcgagccggacctacggacgtacgtagacgtactttcgacttagtttacgttacttcgtactagtactacgccgtaacctaacggtcgaccgtccgttaccgtaccgtttccgggacgggtacgggaccggtaacgggtagggaacgtacgtaccgaaacgtacgttaggtacggtccgtacgaccgaccgtacttaccgttcgttccttcgtcttccccg

SEQ ID NO: 188247 - DNA, 623 bp, Homo sapiens
  misc_feature: GYAE6OF01CPZ5Q.40.23.C01.1.454.CMB.1.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaattgtgttgacacagtctcagccacctgtcttgctcgagggaangccacctctcctgcaggccagtcagagtcttagctaatacttagtctaggtaccaacagaaacctggaccaggctcccgaggcctcctnactctatcgatcgacatccagcgacgggccacgtcggactactcccgaagccgtaaggttcgaaggttcggacgtagggttcggggtaccgtaggggacctagtaccgtttacaccttcctacactagccgaggccgtactaggacgtaccgtagtaacgttactttagacttaggttttacttacgtgttaccgagacgacgtaccttaaccgacgttcggacctccgtacgtccggtttaccgggacggaacggtacggaaggtcggtaacgtacgtaacgaaaccggtacgtaggtaccgtcgacgtaccactacgtctagttctctacgttcccg

SEQ ID NO: 188248 - DNA, 809 bp, Homo sapiens
  misc_feature: GYAE6OF01AUILP.40.23.C01.1.454.CMB.1.raw
  modified_base (493)..(493): a, c, t, g, unknown or other
  misc_feature (493)..(493): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctccagactaccgaccggagtaaattggtgttagacacagtctccagcccaccttgttctttgctcgaaggggaacacgccaccttctacctgcgacgggccagtacaggtacgttcttaacgacctaaacttacgttacgtcgtacggtaaccaaacgacggtaaacctcggacctacggcccgttacccgagggtcccttaccctacacttacctagtgaacgttcgactacctcgaacgtcggacggtaccacggtcggacctaccgtacccgacgtaccgttaggtaccgagggtcgacggtacgggttacgggtcgtaacggaccgtaacgtccttcgaccttccgaaccaccgntacggaccggtccggtactaacggccgttaaccgtaagttaacgttacgtttcgtaacgttttacgtttaacgtttcggtaacgtactaacggtaccgaacggttttaccccggaacttaccggtccgggtaaccccttaggtacccggtttaccggggtacccggggaaaggaccgggttaaccgtaaggggtaacgtaacgtaaccggtaaacccggttaaagtccggttcgggtaacggtaccctaccggtaaccttaacggtttacgtacccttttaacggtttccccttaaagttccccgtttaaccccgg

SEQ ID NO: 188249 - DNA, 755 bp, Homo sapiens
  misc_feature: GYAE6OF01CVR9I.40.23.C01.1.454.CMB.1.raw
  modified_base (211)..(211): a, c, t, g, unknown or other
  misc_feature (211)..(211): n is a, c, g, or t
  modified_base (434)..(434): a, c, t, g, unknown or other
  misc_feature (434)..(434): n is a, c, g, or t
tcagtctagcgactcacgaccggtgctcgatttagtacacgtgattagggattgggggaggaactgctcagttaggacccagagggaaccatggaagccccagctcagctttctcttcctcctgctactctggctcccagataccaccggaagaaattgtgtttacacagtctccagcccaccttgttctttgtcctccgaaggggaaacncgcctacccttctccgtgccagggccaggtcagagtctagcaatacttagtctaggtaaccaacaagaaacctcggaccacggcctccgaggcctcctcatctatcgatcgcaactcgagcgacgggccacgtcggacactccccgagcccgtaaggttccaggtacggcgtaagggtcggggtacgtagggaacctaggtacctcgtaccttcaccgtaacncgtacgacggaccggtcctaacgacgtaccgtaggaacgttacgtttagtacgtttaacgttttaacgttacgttacgttacaaggtcgtaacggtacccgtaaccgtaaaccgttccggggtacccgtaccgtttaccgtaaccggtttccgggggaaccgggtaacgggggtaacccgtaaagggggtaacgggtaaaggtaaccgttaaaccggaaaaaacggttaacgttacggggtacggtaccggttacggaacccgttaccgtaaacgttccgtttacgttccgtttacgttacccgttcccgtttacccccgg

SEQ ID NO: 188250 - DNA, 754 bp, Homo sapiens
  misc_feature: GYAE6OF01EG739.40.23.C01.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtctagcaactacttagtctggtaccaanacgaaacctggccaggcctcccgaggcctcctcatctatgatgcactccagcgacgggcctacgtggcactcccgagccgtaggttcaggtcggcgtagggtcggggtcgtagggggactacggtaccttcgaccttcctaccaaccgtacgttaccgacggtacccgggaccgtaacggaccgtacccgttaaggtaaacggttaccgttttacggacgttttaacggtttttacctttaccggttacggttaccgtaacggtaccgtaaccggtacccgttaacccgaaccggttccgggacccgttaccgttaccgtttacccgggttttcccgggggaccgggtaaccgggtaccggtaacgggggttacggtaacggtaaccgtaaacggaaaacccggtacggttacgggtacgggtccgttacgacccgtaacccggtacgtttacccgtttacggttaccctttaccgtacccgtttacccccgg

SEQ ID NO: 188251 - DNA, 555 bp, Homo sapiens
  misc_feature: GYAE6OF01ERSDB.40.23.C01.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccacctgtctttgtctccaggggaaangccaccctctcctgcagggccagtcagagtcttagcaactactagtctggtaccaanagaaacctggccaggcctcccgaggctcctcatctatgatgcatccagcaggccagtgcatcccagccgtaggttcagtcggcgaggtgggtcgtgggacaggtaccttcactctacacctatcgagcgactagacgcgtagaagtacgttgagtagtttattacgtcgtacagcacgtaccgtacaacgtcgccgtcgtccgtacgtttcggacggtacgggaccgagggtcggagtactaccgaaacgtacgtagacggtctagaccaccgtactcgtagtcttcgcttacccg

SEQ ID NO: 188252 - DNA, 855 bp, Homo sapiens
  misc_feature: GYAE6OF01AP4IG.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggcctcccagatacccgacggagaaattgtgttagacacagtcctccagcccacccttgttctttcgtccgtaccgaagggggaaacgccgacccctaccccttccgtcctaggaccggacgggaccctaggtcaggtacgttacgttagacctaacttacgtttacgtccgtacggtaaccaaacgtaacgtaaccgtcggaccgacggtccctacccgacggtcccttaccctactacttcttaacgtgtaacgtctaccgtacttacccggaacgaccggtacgggaccctacggtcggtaacctacccgtaccccgacggtaccggttaggttccggaggggttcggaaccgttggggttcgggtacgtacgggaccgtaacgttaccttaccgtaccttaccacccgtaacgtaccgttccggaaccgggtacccggtacgtaacggaccggttaccttaacgggttaaccgtttacgttaccgtttaaccgttttaacgttttaacgttaccgttacgtaccggtacgtacccggtacggtacccgtaacccgtacgggtacccgttacccgtccgttaaccggtttaccgggtaccggggtacgggtaaaccggggacggttaacgggtaacggaacggtaaccgtacggaaacgttcggttaggacggttcgacgtacgtaccgttacgttcgttctaccgttcgtacccttacccg

SEQ ID NO: 188253 - DNA, 787 bp, Homo sapiens
  misc_feature: GYAE6OF01B97IJ.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtcctccagccaccctgttctttgtctccgaggggaagcgccacctctcctgcgaggccagtcagagtcttagactaacttacgttagtcgtacggtaccaaacgacgaaaccgtcggaccacggtcctacccgaggtcctccgtactaacttcctatgtacttcgcctacgtcccgaaggtccgacgggccctaagtcgggtaccaccgtacccgacggtaccccgtacgggtttacaacgggttcggacggttaacggggttcggggttaccgttacggggaacctaaggttaccctttaccgaccttacccgttaccaacccgttaacgtaccgtacgggtacccggtaccgttaacggaccgtaccgttaagggtaaccgtttaaccggtttcgtaacgtttaacggttttaacctttccggttaggttaccgtaaccgtacgtaacgttaacccggtaaacccgtaccggtccggtaccccgttacgttacccgttccggttaccgggaacggtaccggacgtaaggggtaacggtacgaacgtaacgaaacggttacggtaggtcggacgtactacgtaccgtacgttacgttcgttaccttcgccttaccccgg

SEQ ID NO: 188254 - DNA, 703 bp, Homo sapiens
  misc_feature: GYAE6OF01C9S9U.40.23.C01.1.454.CMB.1.raw
  modified_base (243)..(243): a, c, t, g, unknown or other
  misc_feature (243)..(243): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctccagataccaccggagaaattgtgttgacacagtctccagccctaccctgttctttgtcctaccgaaggggaaagacgcccaccctctcctgcgagggccagtcagtnttctacgactaacttacttagtcgtacggtaaccaacagaaaccgtggaccacggtcctaccccgaggtcctcctacacttactatgatcgccaatcccgagccgacgggcccacgtacggacctactcccgagccgtaggttcaggtcggacgtaggtcgggtactgggaacagtaccttacacctttcaccgtacctacgccgacggccggtacctacggacgtccgtaacggtaaacttcgtttacgtaacgtttacgttttacgttacgttgtacgatccggactaccggttaaacaaccggtcggtcccgtaccttacgtaccggtttaccgggaaccgggtaacgggtaacggtagggtacggaacgttaacgaccggaaaacggttacggtaggttaccggtactaccggacctaacgtacgttaccgttacgttccttacgtcccttacccg

SEQ ID NO: 188255 - DNA, 622 bp, Homo sapiens
  misc_feature: GYAE6OF01CAU8S.40.23.C01.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaaactcttagtctggtaaccaanagaaacctggccaggctcccaggcctcctcatctatgatgcatccagcagggccacgtggcactcccagcctaggttcagtggctaggtgggtctgggacaggtaacttcgacttctaccgacctacgtcacggccggacctaggacgtcctaggaacgtaccttttggaccttagtttacgtttactgttaccagtaccacgtaccgtaacccaacgtcggccctacgtccgtaccgtttcgggacgggtaacgggacctaggggtacggagtaacgtaccgaaacgacgttcggtaggaccggtcgaccgtaaccctagttccgttacgttcccttacctagttcccgttaccccgg

SEQ ID NO: 188256 - DNA, 886 bp, Homo sapiens
  misc_feature: GYAE6OF01A9Z20.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggcctcccagataccaccggagaaattgtgttgacacagtcctccacgccaccctgttctttcgtcctccgaaggggaaagcgcccaccctctcctgcgacgggccagtcaggacgttcttacgactaacttactttagtcctacggtaaccaacaacggaaacccgttggaccccgaacgggtccctaccccggagggtcccttaccctacgacttacctaattgacttcggacctaactcccgaacggaccggtacggggaccccaacgttcgggacctaccgtacccccgacggtaccccggttaaggggtttccaacggggtcggtacgtaacggggtttcggggtaccggttagggggtaacctaacggtcccgtttacgaacccttccgtaccaacccgtagtcccggaaggtcccgggtaacctaacggggtaccgtacccgttaacgggtaaacggtttaccggtttttacggaacgttttaacggtttttaacctttaccgtgggttaacctacggtacgtaccggttacccggtaaaccgtaacgggtcccggtacccgttacgttaccgtttacccggggtttacggggaaccgggtaacggggtaacccgtaaagggggtacggtaaccgtaaacgttaaaccccggaaaaccgggttacggttacgggacgggttaccggtaccgtacccgtaaccgtttaacttcgggttaacctttccgttcccgttaacccttcccccgg

SEQ ID NO: 188257 - DNA, 949 bp, Homo sapiens
  misc_feature: GYAE6OF01BVQB5.40.23.C01.1.454.CMB.1.raw
  modified_base (207)..(207): a, c, t, g, unknown or other
  misc_feature (207)..(207): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctccagactaccacggataattgtgtttacactagtctccacgcctacctgttctttgtctaccgaaggggaancgcccacctctcctgcgaggccagtcagtagttctagacctaacttacttagtctacggtaaccaaagaacgaaccgtggacacggcctacccgaggtcccttacctactattacgttaacgtgtaacgtcgactactacccgacggaccggaacgggtccctaacggtcggaccctaccgttaccccggaaccggtacccgttaacgggttaccgtacgggtacggaccggttaaggggttccggggttaaccgggttacggggaccttaaacgggttaaccctttaccggtaaccttcccctaaccggaaaccctagtacccggaacgggtacccgggtacctaacgggtaaccggtaccgttaacggtaaacgttaccgttttaacgggtaaccgttttaacggtttttaacgtttaccgttacggttaacgtaccggtaacccggttaacccggtaacccgtttaacccggttaaccgggtacccgggtttacccgtacccggtttaacccggttaacccggggtttacccgggggtaaccggggttaaacccgggtaaaccggggttaacggggttaacgggtaacccggtaaaaccggtaaacccggtaaaaaccgggttccgggttaacgggtacgggttacccgtaaacccggtacccgtaaacgtttaacccggtttcgtttaaccggtttacccggtttacccttacccggttttacccccgttaaccccgg

SEQ ID NO: 188258 - DNA, 578 bp, Homo sapiens
  misc_feature: GYAE6OF01A7DP8.40.23.C01.1.454.CMB.1.raw
  modified_base (213)..(213): a, c, t, g, unknown or other
  misc_feature (213)..(213): n is a, c, g, or t
  modified_base (563)..(563): a, c, t, g, unknown or other
  misc_feature (563)..(563): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctntcctgcagggccagtcagagtcttagcaactacttagtctggtaccaacagaaacctggccaggctccaggctcctcatctatgatgcatccagcagggccacgtgcatcccagccaggttcagtgcaggtggtcgtggacagacttcactcctacaccatcgacgcggcctagacgccgtagaacgctttagacgtaacgtttagtactcgtacgagtcgacgtacgtaccaacgtcgcgtaccttcgtaccgtttcgggaccgggtacgggaacccgtaagggtcgggaagacgtaaccgaaaacgtacgtcggtacggctcggtaccactcgtcgttacgtccttcncttcccgttaccccg

SEQ ID NO: 188259 - DNA, 710 bp, Homo sapiens
  misc_feature: GYAE6OF01A69DI.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgaggggaaagcgcccaccctctcctgcacgggccagtcagagtcttagctaactacttagtctaggtaaccaacgacgaaacctggaccaggcctaccaggcctcctcatctatgatgcatccgagcgagggccacgtcggcactcccagccgtacggttcaggtcggacgtagggtcggggttcgtaggggaccgtaacgtaccgttaccgacgttcctacaacccgtaactccgtaacgggtcccggtaccgtaacggacggtacccgtagtaaaccggttctttacggtacttagttttacttacgttcgtactacggtcctaacggtaccgtaacccgtaacggtccggacccgtaccgtttacccggtaaccggtttccggggaccgggtacgggtaacccggtaaggggtacggtaacgtaacgtacccggtaaaaccggtaggtttcgggacggtcctacggaccctaccgtacgttacccgttgttacccgttccgttccgttacccg

SEQ ID NO: 188260 - DNA, 927 bp, Homo sapiens
  misc_feature: GYAE6OF01B1HJ2.40.23.C01.1.454.CMB.1.raw
  modified_base (364)..(364): a, c, t, g, unknown or other
  misc_feature (364)..(364): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagactaccaccggagaaattgtgttgacacagtctccagccacccttgtctttgtcctccgaaggggaaacgcgccctaccccttctccgtgcgaggggcccaggtcaaggtacgttcttaacgacctaacttactttaggtccgttacggtaacccaaacgaacgaaaaccgtcggaccgaacggccctacccgacggtccttaccttcgtattacctagttacgntacgacctacgtccgacggaccgacggggtaccctacggtcggtcccaacctaccccggtacggtcccgttaaacgggtttccgaggttcgggaccggttaacgggtcgggggtttaccgtaggggaccgttaacgtaccgtttaccgtacccgttacctaccaaccgtacgttacgaccggggttacccggttaccgtaaccgggcgttaacccgtaacggtaaacggtttaccgttttcgtaaccgttttaacggtttttaccgtagttaccgggtaccgtaacgggtaccgttaccggtttaaccccggtaaacccgttacggtaccccggggtaccgttaccggttaccccgggtttaacggggtttcccggggaacgggggttacccgggtaaaccggggtaaccggggttacggggaaacctttaaacccgggtaaaccggtaaaacccggttaaccggggttcgggtaaaccggtttcccgaacgggtaccccttaaaccggtttcgtacccggtttaaccgttttcccttcggttaaacccccgtttccccccgg

SEQ ID NO: 188261 - DNA, 719 bp, Homo sapiens
  misc_feature: GYAE6OF01B4BAF.40.23.C01.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (271)..(271): a, c, t, g, unknown or other
  misc_feature (271)..(271): n is a, c, g, or t
  modified_base (399)..(399): a, c, t, g, unknown or other
  misc_feature (399)..(399): n is a, c, g, or t
  modified_base (516)..(516): a, c, t, g, unknown or other
  misc_feature (516)..(516): n is a, c, g, or t
  modified_base (539)..(539): a, c, t, g, unknown or other
  misc_feature (539)..(539): n is a, c, g, or t
  modified_base (681)..(681): a, c, t, g, unknown or other
  misc_feature (681)..(681): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctccagatacccaccggagtaaattgtgttacacagtctccagcctaccctgtcttgctcgagggaacngccaccctccncctgcgacggccagtcagtacgtctagactaacttacgttacgtctacggtaaccaanaaccgaaccgcgaccgacggtcctacccgaggtccttacctactaattccaagttgattacgacctacgacccgaggaccggacgggtccctaacggtcgaccacgtaccaacggtcgtacgggtacngggtcgacggtagggtcggggttacgagggaacctacggttaccttacgacttcccaaccgacgtacgtccgaacgggcccgtaccgtaacggcgttccgtaagtaacgttacgttnaacgtttaaattcttaccggtancgaccgacttaggaccctttaaccggaaccgttcgaccccggttataccccggtttcggggtaacccggggaccggggttaacgggtaacggaacgggtgtaaacggtactaaaccggaccggtagttcggcggtcgtaacnctacgtattccgacgttaactccttcctcccgttaccg

SEQ ID NO: 188262 - DNA, 620 bp, Homo sapiens
  misc_feature: GYAE6OF01EBJOD.40.23.C01.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccgaggggaaancgccaccctctcctgcagggccagtcagtagtcttagcaacttacttagtctggtaaccaanagaaacctggccaggcctcccaggcctcctcatctatgatcgcactccagcgacgggccacgtggcactccccacgccgtaggttcgaggtggctaggtcgggtcgtggggacacggtaccttcgactcctccgaacctagtaccaggcccggtaccgtagacgcctagaacgtactttgacttagtttacttacgtgtacagccagtacgtacctaacgcggtccgccttcgtacgtttccgggaccgggtaacggaaccgggaggtaggaagtacgtacgaaacggtacgttcggtcggacgttcgaccgtacctacgttcctcgttccttaccgttcgtcccgttaccccg

SEQ ID NO: 188263 - DNA, 908 bp, Homo sapiens
  misc_feature: GYAE6OF01A4SE9.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccgaggggaaanacgccaccctctcctgcagggccagtcagagtcttagacaacttacttagtctaggtaaccaacagaaacctggaccaggcctcccgaggcctcctcatctatgatcgcatccaggccgacgggcccacgtcggacctacgtaccccgaggtccgtaacgggtttccaacgggttcgggaccgtaggggttccggggttacggtacgggggaactaaacggttaccgtttaccaccgttacctacccaacccgttaacgtaccggaccgggtacccggggtacccgttaaagggtacccggttaacccggtttaagggtaaaccgggtttaacccgtttttacggtaaccggtttttaaacggttttttaaacctttaaccgggttttcggtaacccggtaacggtacccgaaacggggtttaaccccgttaaacccgtaaaccgggttcccgggttacccccgtaccggttttacccggttacccgggggttttacccgggggaaaccggggggttaaacccgggggtaaacccggtaaagggggttaacggggtaaacccgggttaaacggttaaaacccggaaaaccgggttaaccggtttcggggtaaccgggtaccgtttaaccgggaaccctacccttaaacggtttcccgtttacgtttaccctttacccgttacccgtttcccccggttacccccg

SEQ ID NO: 188264 - DNA, 708 bp, Homo sapiens
  misc_feature: GYAE6OF01AHFYI.40.23.C01.1.454.CMB.1.raw
  modified_base (207)..(207): a, c, t, g, unknown or other
  misc_feature (207)..(207): n is a, c, g, or t
  modified_base (427)..(427): a, c, t, g, unknown or other
  misc_feature (427)..(427): n is a, c, g, or t
tcagtctagcgactcacgaccggtgctcgatttagtacacgtgattagggattgggggaggaactgctcagttaggacccagagggaaccatggaagccccagctcagcttctccttcctcctgctactctggctcccagataccaccggagaaattgtgtttacacagtctccagcccaccctgttctttgtctccgaagggaaancgccacctctctgcgagggccagtcagagtcttagacctaaacttcgttagtccgtacggtaacccaaacgaacgtaaacccgtcggacccgagggccctcccgaggccttccctcatctagtgatcgctatccgacgccgagggcccacgtcgacctaccgccgacgcggtacggtcgagggtggacgtgggtcgggtcgacggactacgtccgttacncctacctacacctgaccgacgggccgtacgacgaccggtcgtaacggttaacgttcttacggttactttaacggtttacgtaccgttacgtacacgtacgaccggttacctacccgtacgtccgggtaccctacggttcccggttacgggttaccggggaaccggggtaacggtaccgggtaagggtaccggtaaacgtaccgtaaacggaaccggtacggtcgtacggtctacgaccctaacgtcgttacttacgttaccttcttcccgtttcccgtccg

SEQ ID NO: 188265 - DNA, 844 bp, Homo sapiens
  misc_feature: GYAE6OF01A0A7S.40.23.C01.1.454.CMB.1.raw
  modified_base (99)..(99): a, c, t, g, unknown or other
  misc_feature (99)..(99): n is a, c, g, or t
  modified_base (420)..(420): a, c, t, g, unknown or other
  misc_feature (420)..(420): n is a, c, g, or t
  modified_base (516)..(516): a, c, t, g, unknown or other
  misc_feature (516)..(516): n is a, c, g, or t
  modified_base (667)..(667): a, c, t, g, unknown or other
  misc_feature (667)..(667): n is a, c, g, or t
  modified_base (698)..(698): a, c, t, g, unknown or other
  misc_feature (698)..(698): n is a, c, g, or t
  modified_base (808)..(808): a, c, t, g, unknown or other
  misc_feature (808)..(808): n is a, c, g, or t
tcagtctagcgactcacgaccggtgctcgatttagtacacgtgattagggagttgggggaggaactgctcagttaggacccagagggaaccatggaacnccccagctcagcttctcttcctcctgctactctcggcctccagactaccgaccggaagtaaattggtgttcacacagtcctaccgacgccctacccgttgttctttcgtaccgtaccggaaagggggtaaacaccgccctaccccttcgtcccgtcggaccgacggggaccctaaggaccgtaaggttacgttaccgttaacgaacccttaaaccgtttacgttacggttaccgttaaccgggtaaaccaaaaccggaaacgttaaacccgcggaacccgtacggtacccctaccggaccgtcctacctactaactcctanacgtactcgacctaccaccgacgaccggtaccggacctacggtaccgccgtaacccgcccggtaaccggtccggtttaacggtacgtaccgggggnggtacggttacggggttcgggtaaccgtaggggtaacccttacggaccctttacccgtacgtaccctaacccggtaacttaccgggaccggacccggttacccggtaaccggtacggtaaccgtaccctttaaggttaacgttaccggttnttaacgttttaaccggtttacttacgggttnaccgtacacccggtacgtacccgaccgtacggtccgcttacccgtacgggtacggtccgggaacgggtacgacggtacggacgtacgtaacgtaaacggacgtgtaccgngtaccgaccactcgttctcggtatccgtatccctcg

SEQ ID NO: 188266 - DNA, 785 bp, Homo sapiens
  misc_feature: GYAE6OF01DLN9M.40.23.C01.1.454.CMB.1.raw
  modified_base (199)..(199): a, c, t, g, unknown or other
  misc_feature (199)..(199): n is a, c, g, or t
tcagtctagcgactcacgaccggtgctcgatttagtacacgtgattagggagttgggggaggaactgctcagttaggaccagagggaaccatggaagccccagctcagcttctcttcctcctgctactctggctccagataccacggagaattgtgtttacacagtctccagccaccttgtctttgctcgaaggggaancgccaccctctccgtagcgacgggccagtcagtcgtacttagacctaacttaccgtttagtaccgttaggtaaacccaaactacggaaaaccgttcggaccgaacggtccctacccgaggtcccttcctactacttccgtaagttcgacttcgacctacgtccgaggccgacgggccacgtcggaccactcccgaggtacccgtaggtttaccgaggtcggcgttaagggttcgggtcgtacgggggaacctaggttaaccttcgtacccgtaccgttaccaaccgtagttaccggacggtacccgggaccttaacgaccggtaccgttaaggtaaacgttcgttttacggaacttttaaggtttaccttacgtcgtacacgtacgtaccggtacgttaacccgtagtaccgggttccctagttaccccgttacggggttaccgggaccggggttaacgtaaaccggggttaagggtacggtaaccggtaactaacccggtaaaacgtccgtagggttagccgtttacggacccttccggtaattccggtttacgtaccgtttcctaaccgtttcccccggtaccc

SEQ ID NO: 188267 - DNA, 771 bp, Homo sapiens
  misc_feature: GYAE6OF01D0BZK.40.23.C01.1.454.CMB.1.raw
tcagtctagcgactcacgaccggtgctcgatttagtacacgtgattagggattggggggaggaactgctcagttaggacccagagggaaccatggaagccccagctcagcttctcttcctcctgctactctggctcccagataccaccggagaattgtgttgacacagtctccagcctaccctgttctttgtcctaccgaaggggaaagcgccctaccctctcccgtgccgagggccagtcagagtcttagactaacttacttagtctaggtaaccaacgtaacgaaacctcggaccacggtcccgtaccccgaggccttccctactacttacttaagtcggtaacttcggacctaacgtcccgtaacgggccgaaccgggggtacccctaacggtcggacctaacccgtaccccggacgtacccgtaacgggttaccgagggtacggcgttaagggttcggggtcgtaggggactaacgtacccgttacgaccttccgtacaaccgtacgttacgacgggtaccgaccgtacggtaacgtccgtaacggtaaacgtttcgttacgtaccgtttaaagttttacgttacgttcggtacctacggtaccgtaacgtacccgttaaccgtaccggtccgggtaccgtccttaaccgggttacggttaccggggacgggtacggtaaccgagggtagaacgtacgtaacgaaacgtacggtggttacggcacggacctaaccgtattcccgttagtaccttacctcgtcccccg

SEQ ID NO: 188268 - DNA, 846 bp, Homo sapiens
  misc_feature: GYAE6OF01CJ330.40.23.C01.1.454.CMB.1.raw
  modified_base (374)..(374): a, c, t, g, unknown or other
  misc_feature (374)..(374): n is a, c, g, or t
tcagtctagcgactcacgaccggtgctcgatttagtacacgtgattagggattgggggaggaactgctcagttaggacccagagggaaccatggaacgccccagctcagcttctcttcctcctgctactctggcctccagactacccaccggaagtaattgtgttgacacgagtcctccacgccctacccttgttccttttgtaccgtaccggaaacgggggaaaacgccgacccctaccccttctccgtcggccggacgggccaggtcgagtacgttcttaacgacctaaacttacgttacgtccgtacggtaaccaaacgaacgtaaaccgtcggaccgacggtcctacccgaggtccctcctacactcgtntacgtacgtcactacaccgacgccggacggtacccacgtcggacctaaccgtcccgacggtaccgttaacggtccgtaaggtcggaccggtaggggtcgggttaccgagggtaactacggttaccttaccgtacctcctaaccgacctagaccgggacccggacgtaaccgtacggacttaccgggtaagttaacgtttccgttacgtaacttttaagtttaccgttagtcggaacctacgtaccggaacggttaccgtaaacccggtcgttcccgggtaaccttccgggtttaacccgttaccgggggttacggggaaccggggtaaaccgggtaaccgggttaaaggggtaacggttaaaccaaaccgggttaaccgaaaaccggggttccgtttaggggacctacgttacccggaacctttacgtaacctttccggtacgtttcccttaaccggtcccgtttacccccg

SEQ ID NO: 188269 - DNA, 661 bp, Homo sapiens
  misc_feature: GYAE6OF01B3NT2.40.23.C01.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
tcagtctagcgactcacgaccggtgctcgatttagtacacgtgattagggagttgggggaggaactgctcagttaggacccagagggaaccatggaagccccagctcagcttctcttcctcctgctactctggctccagataccacggagaattgtgttgacacagtctccagccacctgtctttgctccaggggaangccacctctcctgcagggccagtcagagtcttagcaacttacttagtctaggtaccaanagaaacctgggaccaagggccctcccgaggtcctcctanaacgttctatgatcgacatcccgagccgacgggtccctacgtcggaccaccgtaccccaggtcccgtaaggttccagggtcggaccgtagggtcggggtactaggggacctaggtacctttcgactctaccaaccctgtaccgaggtaccggcctaaggaccgtccgttaggaaacgttcgtttagtacctttaggttttattaccgtgtacgtaacgtcgtaacggtaccgtaacctacggttcggacccgtcttaccgttaccggttccgggacgggtacgggtaccgtagggtagaacggacttaaacgaaacggtcgtagggcggtactcggacacgtacttcgtcgttctcgtcttcccg

SEQ ID NO: 188270 - DNA, 796 bp, Homo sapiens
  misc_feature: GYAE6OF01DY6AH.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccacctgtctttgtctaccgaggggaaancgccaccctctcctgccgagggccagtccagtacgtcttagacctaacttacttagtctcggtaaccaacgaagaaaccgtcggccacggcctacccgaggtcctcctacacttactagtagtatcgaccaacgtccgagcgacgggaccacgtcggactacctaccgacgtccgtaaggttcacggtggtacgtacgggtgggtaccggtagggactacggttaccttaccacgttcccaacctaaccgtacgttaccggaacggcccggtaaccggtacgtacgtaccgttacggtaaacgtttacgtttacggactttaacggttttacctttacggttacgtactaacggtaccgtaaccggtaccgtaaacccgttaccggtacgggtacccctacgttacccgggttaccgggtttaccgggaccggggttaaacggggtaaccggtaacggggtaggaaaccgtaccggtaaaaccggaaaaccgggttaacggttacgggtaccggtaccgttaaccggaccctaaacccggttacgtttacccggttaccgtttaacccgtttaccctccggtttaacccccg

SEQ ID NO: 188271 - DNA, 657 bp, Homo sapiens
  misc_feature: GYAE6OF01CC0ZM.40.23.C01.1.454.CMB.1.raw
  modified_base (210)..(210): a, c, t, g, unknown or other
  misc_feature (210)..(210): n is a, c, g, or t
  modified_base (392)..(392): a, c, t, g, unknown or other
  misc_feature (392)..(392): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
  modified_base (487)..(487): a, c, t, g, unknown or other
  misc_feature (487)..(487): n is a, c, g, or t
tcagtctagcgactcacgaccggtgctcgatttagtacacgtgattagggattgggggaggaactgctcagttaggacccagagggaaccatggaacgccccagctcagcttctcttctcctgctactctggctccagataccacggataattgtgttacgacacacgtctccacgcctacctgttctttgaccgttcgaaggggaaacncgcccaccctctcctgcgacgggccagtcagtactcttacgactaacttacgttagtcgtacggtaccaacaacgaaaccgtcggaccacggtcctccgagtcctcctcacttctaagtcgatcgctaactccgagtcgacggtccagtcgactaccgcctacggaccgtagtccaggtcgngtagggtcggtacgtcgggactacgtactcactcacaccgactacgcgcgtacnggcgtactagtactnttacgacttagttactcgtacgtacngaccgtacggtcctaacgacgttccggcttaccgtcggttccggtaaccgggtaggggtaaccgtaccgggtaaggtacggaactaaaccggtaacgaaccgttagggttccgcggttcctacgacccgtaattccttaccgttagttaccttacccgtctttaccccgg

SEQ ID NO: 188272 - DNA, 680 bp, Homo sapiens
  misc_feature: GYAE6OF01CR9JW.40.23.C01.1.454.CMB.1.raw
tcagtctagcgactcacgaccggtgctcgatttagtacacgtgattagggattggggggaggaactgctcagttaggacccagagggaaccatggaagccccagctcagcttctcttcctcctgctactctggcctcccagataccgaccggagtaaattgtgtttacactagtctccagccacctgtctttgtctccgaaggggaaacacgcccaccctctcctgcgacgggccagtcagtgttctagctaactacttagtcgtacggtaaccaacaacggaaacctggaccgaggtccctcccgaacggtcctaccctacacttactagtgtatcgacactccgacgcgacgggccacgtcggacctacctcccgagtaccgtaggtcgaggtcggcgtagggtcgggtacgagggactacgtcctctactctacactagtcgacgtcggtactacggacgtaccgtagaacgttacgtttcgtacgttagttttaactcgtacgtacgtacgtaccgtaacgtaccgttaaccgacgttcggtcctcgtaccggttaccggttcgggacgggtaacggtaacggacggtaggtacgtacgaaaccggtaacgtacggttcggacgtcgtaccgacctacgtcgttcgttacgtccttaccgtacgttcccgtaccgg

SEQ ID NO: 188273 - DNA, 863 bp, Homo sapiens
  misc_feature: GYAE6OF01CMYGU.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagactaccacggaagtaattgtagtttacacagtcctaccagcccaccttgttctttgtctaccggaaggggaaacgcgcccacccgttctccgtgcgacgggccagtcagtacgtcttacgacgtaacttacttaacgtcgtacggtaaacccaacgtaaacgaaaccgttcgggacccgtagggtaccctcccgaacggttcccttcccttacaacttcttaaccggttgacgtacgtaccgtaccgtaccgaacggaccggaccggtaaccgaccggtacgggaccttaccgtacccccgaaggtacccggtaacggtccgtaagggttcggtacggtacgggttacggggtacgtaacggtaaccgtaaagttccttactccggttacctaccctaccgtacgtacgacccggtacggtaccggtaaacggacgttaccggtaaggtaaacgtttccgtttacgtaccgttttaaagtttaccttacgttacggtaccgtaacgtacggtaaccgttaaccgtaccgtaacgggtccggttaccgtaccgttaccggtttaccgggtcggggtaaaccgggggactaaacggggtaggtaaacggaacgtaaccggaaaccggttaaacgggtacccggtagggttaacggtactaccgttaacccgaccgttaacgtttcccgttaacgtttcctacccgttaccgttccccgttacccgg

SEQ ID NO: 188274 - DNA, 797 bp, Homo sapiens
  misc_feature: GYAE6OF01DOF4B.40.23.C01.1.454.CMB.1.raw
  modified_base (217)..(217): a, c, t, g, unknown or other
  misc_feature (217)..(217): n is a, c, g, or t
tcagtctagcgactcacgaccggtgctcgatttagtacacgtgattagggattggggggaggaactgctcagttaggacccagagggaaccatggaagccccagctcagcttctcttcctcctgctactctggctcccagactacccgaccggagtaaattgtagttttacacagttcctccagcccacccttgttctttgctaccgaggggaaacncgccctaccctctacctgccgacgggccagtacagtcgttccttagactaactacgttagtcctacggtaacccaagtaaccggaaaaccgtcggacccgacggtccctacccgacggcccttacctacctatccgttaattcggattcgacctaactcccaggccgacggggcccacgtcggcctaccgtacccaggtaccctggtaccgtaggtcggtacgtaggggttcgggtacgaggggtacctacggttaccttaccgactttccgacctaacccgtataccggtaccggaccggtacccgtagtaccggtacccgttagtaaacggttacccgttttagaaccgtttaggtttaactttacgtacgtactaacggtcctaacggtaacccgttacctacccgggttaccgtcccgtaaccggttaccgttaccgggttacccgggggaaccggggtaacggaaccggtaggggtaaggaactaccgtaaaccgtaaaccggtcgtagggtccgacgttccgaaccgtaccgtacttacggttcttaccgtaccgttccgtcccgttaaccccg

SEQ ID NO: 188275 - DNA, 806 bp, Homo sapiens
  misc_feature: GYAE6OF01DUEG5.40.23.C01.1.454.CMB.1.raw
tcagtctagcgactcacgaccggtgctcgatttagtacacgtgattagggattggggggaggaactgctcagttaggacccagagggaaccatggaacgccccagctcagcttctcttcctcctgctactctcggcctaccagactaacccgaccgggaagtaaatttggttcgttagaccaacgtacgtcctacccacgcccctacccgttcgtttcttttcgtaccgtaccgggaaagggggtaaacgaccgtcccaccccttcctcctcggaccgacgggccagtcgagtacgtacttacgactaaccttacgttacgtcgtacgtaaccaacgaacgtaaccgtcggaccgacggtccctaccgaccggtccttaccgtactacttctacgtagtacacgtacacctccgacggcgaccgggcctacgtcggacctactcccgacgtccggtacggttgaacggtcggacgtacggggttcgtgacggtactacgttcctcgaccttcaccgacgtcacgtcggaccgtactaaggccgtacgtacgttaacgttacttacgtacgttttaacgttacttacgtcgttacgagttaccgtacccgtacgtaccgtacggtccgtccgtacgtccggttacggttaaccggggacgtaacgggtaacgggaagggttaccggtaacgaccggttaaacgtaaccgggttcggttccgggaaaccggttccggtaaccgtaaccgttaacccgttcggttttcccgtttaccgtttaccccgtttaatttccccggttaccccg

SEQ ID NO: 188276 - DNA, 733 bp, Homo sapiens
  misc_feature: GYAE6OF01A72FR.40.23.C01.1.454.CMB.1.raw
  modified_base (208)..(208): a, c, t, g, unknown or other
  misc_feature (208)..(208): n is a, c, g, or t
  modified_base (452)..(452): a, c, t, g, unknown or other
  misc_feature (452)..(452): n is a, c, g, or t
  modified_base (520)..(520): a, c, t, g, unknown or other
  misc_feature (520)..(520): n is a, c, g, or t
  modified_base (709)..(709): a, c, t, g, unknown or other
  misc_feature (709)..(709): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccaggactaccaccggagtaaattgtgttgacacagtctccagccacctgtacttgtctccgaaggggtaaancgcccacctctccgtgacaggggccagtcgagtacgttacttagcctaaacttacttacgtctacggtaaccaaactaaccggtaaaccttcggaccgtacgggtacctccccggaacgggtcccttacccgtactaacttccgttaatggtaaacttcggacctacgttacccgtaggccggtaacgggccctaaacggttcggccctaaactcccccgaaaggtcccgttaaggttacccgnggttacggactacggggtcggttaccgagggaaccgtacgtaacttaccggacctctaaccgacctanccggtaacgccggtaaccgtagcgtacggtagtaacgtctttacggactttaaaccgtttcttagtacgtacgacggtctacgtaccgtaaccacggtcgaccgacttacgttacgttcggggacgtaacgggaccgtaagggtgaacgtacgaaccgaaggtactggggttcacggtcacgtaacgtnttcgtactcgtccctagtccccgg

SEQ ID NO: 188277 - DNA, 726 bp, Homo sapiens
  misc_feature: GYAE6OF01ESHOW.40.23.C01.1.454.CMB.1.raw
  modified_base (208)..(208): a, c, t, g, unknown or other
  misc_feature (208)..(208): n is a, c, g, or t
  modified_base (674)..(674): a, c, t, g, unknown or other
  misc_feature (674)..(674): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctcccagataccaccggagaaattgtgttgacacagtctccagcccaccttgtctttcgtctaccgaggggaaancgccctaccctctcctagccgaggccctagtcgagagttcttagactacttacgttgtctacggtacccaacgaacgtaacctcggaccgacggcctcccgtagggccctcctacactacttacgtagacgtgacctaactcccgaaggcgacgggccctacggcgtaccacctacccggacgccgtagggttcacgggtggtacggtagggttcggtaggttacggaacgtacgttcttaccgtaccttcctaacctaaccgtactaccggaacgcccggtacgtacgacgtccgtaacgtaaggttcttcgtaattacgttttactcgttacgtacacgtaccgtacgtaccctaactacggtccggccttccggtccgttacgggtccgggtaacgggtaccgggtaacgtaacgggtaggtacgtaaacgtaaccgggtaaccgtcggttaggtacggttcnccgaacgtaccctcgttacgttccgttaccctttacgtaccccttaccccgg

SEQ ID NO: 188278 - DNA, 735 bp, Homo sapiens
  misc_feature: GYAE6OF01DWDB4.40.23.C01.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagatacccaccggagaaattgtgttgacacagtctccagcccacctgtctttgtctccgaggggaancgcccacctctccngcagggccagtcagagtctagcaacttacttagctaggtaccaanagaaacctggaccaggcctccgaggtcctcctnatctatgatgacatccgagcgacgggccagtcggacactcccgagacctaggttcaggttcggacgtagggttcgggtcgtaggggactaaggtacctttccgacttcctacaaccgtataccgaacggtaacggtacccgtaaggaaccgtacctaacgggtaaactttacgtttacggtaactttacggtttttattaccgtttcggtacctaggtacccgtaacggtacccgttaacccgtaacggttccgggaccccgttcgttaccggttacccgggttttaccgggggaaccgggtaacggggtaacccggtaaggggtacggaaacggtaccgtaaacccggtaaaacggtacgttacggggtcggtaccgtacggtacccctaaccgttacgtttaccgtccgtttaccgttccttaccgtttacccccgg

SEQ ID NO: 188279 - DNA, 752 bp, Homo sapiens
  misc_feature: GYAE6OF01CKPQZ.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggcctccagactaccgaccggagtaattgtgttacgacacagttcctaccacgccctacccttgttctttcgtccttccggaaggggaacgacgccctaccctcctccgtcggaccgacggggccagtcgaagtacgttcgttacgactaacttacgtttacgtcgtacggtaccaacgaacgtaaccgtcggaccgacggtcccgttacccgacggttccctcctactacgttaccttagtaacgtgtacgacctaaccgtaccaaccggacggacccggggtccctaacggtccgaccgtaccctacccgaccggtaccgtacggttacgtaggtcggacgtacgggttcgggacggtacgggactaccgttacgttaccgtaccttcgtacctaccgacgtcgtaccgggccgtacgttagccgttacgtaggtacttacgtttgacgttttacgtttacttcggtctagacgtaccggacgtacgttaaccgcggttccgcccggtacttcggttacggttcgggaccggaggtaccgtagggtagacgactaacggaaccgtgttcggactcgtacaccgtacgttacgttactaccgtttctaccttccggtcccg

SEQ ID NO: 188280 - DNA, 1023 bp, Homo sapiens
  misc_feature: GYAE6OF01EFE8W.40.23.C01.1.454.CMB.1.raw
tcagtctagcgactcacgaccggtgctcgatttagtacacgtgattagggagttggggggaggaactgctcagttaggacccagagggaaccatggaagccccagctcatcttctcttcctcctgctactctggctcccagactaccgacggataaattgtgttgacacgtacgtctccacgccctaccgttgttctttgtcctaccggaaggggtaaacgacgcccctaacccttccgttcccgtaggaccggacggggtacccagggtaccgtacgtacggttaccgtttaacggaccttaaaccgttttaccgttaagggttccgtttaaaccgggtaaaccccctaaaagaaaccgggtaaaacccgttcggaacccgtaacggggttccccctttaccccgggaaggttccccttacctttacggtaaaccttaccgttaaaggtcggttaacttccgggaaccttaccggttaaacccggcggggtaccggaaaccccgggcccgttaacgggtttccgggaccctttaaccggtacccgaaccggggttaaccgtacgggtttaaaccggcggggttacggaccgggttaaacggggtttccggggtccggggttacgggaaacccgttaaccgggttaacccctttaccaaaacccccgtttgtaacccctaaaacccgttaaacggtttaacccgggaaccggggtacccggttaacccgttaaccgggttaacccggtaccgggtttaaaccggttaacggtttacggtttaccgggttaaacgttttaaccggttttaacgtttaaccggtttacgtaaccgtaaccggtacgttaccggtaaccggttaccggtaaccgtccgggtaaccgtaccgttaccgttaccgggttaccgggtacggaacgggttaaccggtaagggtaaggtacgtaacggtaaccgtaacctacggttacggtcgtaccgtaccgacgtacctcgtacttagttcccccttgtccgttacccg

SEQ ID NO: 188281 - DNA, 961 bp, Homo sapiens
  misc_feature: GYAE6OF01CBALR.40.23.C01.1.454.CMB.1.raw
tcagtctagcgactcacgaccggtgctcgatttagtacacgtgattagggagttgggggaggaactgctcagttaggacccagagggaaccatggaagccccagctcagcttctcttcctcctgctactctggctcccagactacccacggaagtaatttggtgtttagacctactagttccacccacgcccgtacccttgttcgtttagtcctaccggaaggggaaagtcgccctacccgtccttccgtacggccgacggggccagtaccgagggtaacttccgttacgaacctaaccgtttactttacggttaccgtaccggttaaaccgaaaccgtaaccggtaaaacccgttcgggaccgtaaccgggtaccctacccggacggtaccctttccgactacgttaccttagtacggcttacgcgtaccgtaccgacggtaccggacgggtaccctcggtaccgaccgtacccgttaccgacggtacccgtttaacgggtacgtacggtacggtacggtacgggttccgggtaggtcggggaactacgggtaccttaaccgcccgtttacacctactaaccggttcaaccggggaccgtcccgtaaggtaacccgttaccccggtaagttaaacggttaccgtttacgttaaacggttttaacttttacgtaaacgttcgtaaacggtaccaagggttacccgaaccgttaaaccccgggtacggttcccggacccggttaccgttcccggttttaaccggggttacccgggaccggggttaaacccggggtaaacgttcccgggggtttaaagggaaccggttaaaacccggttaaacggttaaacccggggttaccttacggggttttaacccggtaggacccgttaaccggtacccggttaccgttaccgggttttaaaccttcccggttttaaaacccgttccggtttcccccgg

SEQ ID NO: 188282 - DNA, 886 bp, Homo sapiens
  misc_feature: GYAE6OF01BTE96.40.23.C01.1.454.CMB.1.raw
tcagtctagcgactcacgaccggtgctcgatttagtacacgtgattagggagttgggggaggaactgctcagttaggacccagagggaaccatggaacgcccagctcagcttctcttcctctgctactcgtggcctccagatacccgaccggaagtaaattgtacgtttaacacgagtcctccacgccctacccttggtctttcgtccgtaccggaagggggaaacgcctacccctaacccgtccttaccggcggaccggagggaccacggtacagtacgtacgttagacttaaacttagttcttaccgtacggtaaaccaaacgtaaacggtaaaccgtcggacccgtaacgggtacccaccccgtagggtacccttaccgtactaacggttactaagtacggtaataccgtaaccgtaactaccggaacggacccgacgggtacccgtaacgacggtaaccctaacgtaccccgaacgtaccgggtaaacggtttcccgaagggtaccggtacgtaaggggttacggggtacgaacggggtaactaccgtaccgttacaacccgtttccaacgaacgaactcgggaccgacgtaccgtaaggacgtaccgtaacgtaacggttcttaacggtaaccgttaagttttaacgtacgtaccgttagaacggtacctaaccgggttaaacctaaccggaccgtacggtacccgtaccgttacggtaacccggttacgggaaaccgggtaacgggtaccggtaacgggtaggttaaacggaaccttaaacggtaaaccggtcggtacggtacggtaccgttaccggacccttaaaccggtaccgttaccgtttactacccgttacccgtaacctttcccccggaacccg

SEQ ID NO: 188283 - DNA, 835 bp, Homo sapiens
  misc_feature: GYAE6OF01C4ZBZ.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtagtttacacagtctccacgccaccctgttctttgtctccgaagggggaaagcgcccaccctctccgtgcgacgggccagtcagtacgttcttagctaactacttagtcgtcggtaaccaaacgaacgaaaccgtcgaccgaggcctcccgacggcctcctacgtactctaatcgatcgctactccgcgcggacggcccacgtcggctaaccgcccgagccggttacgggttcgacggttacggcggtacgggttaggggtccggtacggggtaacgaacggttccttaccgtaacccgttcctaccaacccgtacgttaccgaccgggtccggtaaccgtaacgggtacccgtaccggttaacgggtaacgttaccgttttacggtaccgtttttaacgttttaacgtttacgttaccggttcgtaaccggtaaccggtaacgttaaccccgttaaccccggttaacggttcccggtcccggttaacccttttccggttaaccggggtttcccggggaaccggggttaacgggaaccggtaacgggggtaacgtaaccgggtaaccgtaaaaccggtaaaccggtaacggttcgggtacggttccgtaaccggttaccctaaaccgttacgtttcccgttaacgttccttaaccgttacccgttcccggtttacccc

SEQ ID NO: 188284 - DNA, 835 bp, Homo sapiens
  misc_feature: GYAE6OF01BGNZT.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccacggagaattgtgttgacacagtctccagccaccctgtctttgtcctccgaggggaancgcccaccctctcctgcgacgggccagtcagtacgttcttagctaacttacttagtcgtacggtaaccaacgacgtaaacccgtggacccgacggtccctaccccgaggtccctacccgtactacttcctagtggtactcggacctactcccgaaggcccggaacggggtccctacggtcggacctaccgtacccccgaggtacccgttacggttccgacgggttcggacggtaggggttcggggtacgtacgggggaactacggtaccttccaccgttacctaccgaacccgtagtaccgacggggtcccggtaccgttaacggtaccggtacccgttaaggtaaccgtttaccgttttacggtaaccgttttacgtttttacttacggttacgtacccggaacgtaccgtaacggtaaccccggttaaccctacgggttcccggtacccgttaccgttacccggtttaccgggttaccggggaaccggggtaacgggtaacccggtaaggggttacggaacgttaacgtaaaaccccggaaaggttaccggtacggtacgggtccctaacgtacccgtacccgttacggtttacccgttacgtttcccttaccggtccctttacccccggg

SEQ ID NO: 188285 - DNA, 878 bp, Homo sapiens
  misc_feature: GYAE6OF01AK5WW.40.23.C01.1.454.CMB.1.raw
  modified_base (201)..(201): a, c, t, g, unknown or other
  misc_feature (201)..(201): n is a, c, g, or t
tcagtctagcgactcacgaccggtgctcgatttagtacacgtgattagggattggggggaggaactgctcagttaggacccagagggaaccatggaagccccagctcagcttctcttcctcctgctactctggctcccagataccaccggagaaattgtgttgacacagtctccagccaccctgtctttgctcgagggaancgccaccctctcctgccagggccagtcagactcttagactaactacttagtctaggtaaccaacagaaacctggccctaggccttcccgaggtcctccctactactccgtatcgacgtcggtaccactccggaagcccggacggggtaccccacggtcggtacccaaccgttacccccgacgggtaccccgtaacgggttttccgaacggggttcggggccgtaacgggggttttcgggggtaacccggtttcggggggtaaacccgtaacgggtttacccttttacccgggacccccttacccgttaccccgtaaccccgtaataccccgggaccgggtacccgggtaccccggtaaccgggttaccgtacccggttaaccggtaaaaccggtttaaccggttttacggttaaccgttttaacggttttaacgttttaccggtttagtaccgtaacggtaccgttaaccggttacccggtaaacccgtaaccggttcccgggtacccggtaccgttacggtttacccggggttaccgggtaccggggtaaccgggtaaccggtagggtaacgggtaacggtaaaccgtaaccggtaaacccgtaacgggttacggtacggtccgttacgacccgtaccgtaccgttacgttacggttccttctaacccgttccccg

SEQ ID NO: 188286 - DNA, 832 bp, Homo sapiens
  misc_feature: GYAE6OF01DAUXW.40.23.C01.1.454.CMB.1.raw
  modified_base (791)..(791): a, c, t, g, unknown or other
  misc_feature (791)..(791): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagactaccgaccggagtaaattgtgttgacacagtctccacgcccacccttgtcgtttgtctaccggaaggggtaaagacgccctaccctcctccgtcgccgacgggccagtcgagtacgttacttacgacctaaccttactttacgtccttacggtaacccaacgaaacgaaacccgttcggacccgaccgggtccctaccccggaggtacccctaccttaccaacgtttactaagttacggtaacttcggaacctacgtacccgaggtaccggtaaccgggccctaagggtccgaaccctaccgtaccccgacgtccccggttaaggttccgaaggtcggaccggtagggttcggggtccgtaggggaacctacggtacctttaaccgcttacccgtaccgtaacctacgtaccggacgggtaacccgtacccgtaacggaccgtaacggttacgtaaacgtttacgtttacggtaaccgtttacttttacgtacgttacgttacgaccgtacgtacggtacccgtaacgtaccgtcggtacccttaccgtaccggttacgggttccgggaacgggggtaaccgtacgggtaaagggttaccgaagtaaccgtaaccgaaacgggttacgttggaccggtctacccggtaanacccgtcgtttacttaccgtaccctttcgtcccgttacccc

SEQ ID NO: 188287 - DNA, 504 bp, Homo sapiens
  misc_feature: GYAE6OF02JAR9V.40.23.C01.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccnctcacttcggcggagggaccaaggtggagatacgaacgaactgtggctgacacatctgtcttcatccg

SEQ ID NO: 188288 - DNA, 793 bp, Homo sapiens
  misc_feature: GYAE6OF02GH1NY.40.23.C01.1.454.CMB.1.raw
tcagtctagcgactcacgaccggtgctcgatttagtacacgtgattaagggaagttggggtaggaactgctcagttagggaccccacgagggaaccatagggaaagccccaggcgtcacgcttcgttccttccctcctgcgtacgtcctggctccccagataccgacccggagaaacttggtcgttcgacacaggtctccgacgccgaccctggtctttagtcctccgaggggaaacgagcccaccctcttcctgccagggccagtcgagacgtccttagcaactacttaggttcctggtaccgaacaggaaaccctggcctacggctacccgaagggcctccgtcagtctagtgatgcaatccgagcaagggccacgtgggcatcccacgcctaggtccagttaggctaggtgggtctaggggacaggtaccttcgaccgtctcctaacccgtactaccgaacggtccgggtacccttacggacggacccgtaggtaaacggtaccgttttacggaccgttaggttttaacgttaaccggttcggttaccgtacggaccgtaacgggtacccgttaaacccgtaaaccgtttcgggtacccggtcgttacccgtaaccggttttaccggggacccggggtaacggggtaacccgaaacggggttaccgggaacggtacggtaaccggaaaaccggtaaccgttacggggttaccgggtaccgttacggtacccgtaacccggtacgggttacccggttacgggttcccgtttacccgtacggtttacccccg

SEQ ID NO: 188289 - DNA, 546 bp, Homo sapiens
  misc_feature: GYAE6OF02I1KD3.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtcttagcaactacttagtctggtaccaacagaaacctggccaggctcccaggctcctcatctatgatgcatccagcagggccacgtggcatcccagccaggttcagtggcaggtgggtctggggacaggacttcactctcaccatcgagcgcctagacgcctagagtacttgctagtttattactgtcagcagtcgtaccacgtcggccgtctacgtacgtttcggacgggacgggaccgaagggtggacgtacgtacgaaacggtaacgtggtacggcgtacgacaccgtatccgttgtccttctacgttcccg

SEQ ID NO: 188290 - DNA, 559 bp, Homo sapiens
  misc_feature: GYAE6OF02JA02J.40.23.C01.1.454.CMB.1.raw
  modified_base (201)..(201): a, c, t, g, unknown or other
  misc_feature (201)..(201): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccacctgtctttgtctccaggggaanagccacctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacaggacttcgactctcaccatcagcgctagcgctgagtactttgactagtttacttctgttcagtccagtccgtaccaacgtcggccgtctacgtaccgtttcgggacggacggtaccgaagggtaggacgtagtaaccgaaacggacgttaggtcggacctacgaccgaacctgttaccgtcgttacctttaccgacctttcccg

SEQ ID NO: 188291 - DNA, 523 bp, Homo sapiens
  misc_feature: GYAE6OF02IW783.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctcccagataccaccggagaaattgtgtttacacagtctccagtccaccctgtctttgtctccaggggaangccacctctcctgcagggccagtcagagtcttagcaactccttagtctggtaccaacagaaacctggccaggctcccaggcctcctcatctatgatgcatccagcagggccagtggcagtcccagccaggttcagtcgcagtgggtctagggaactagacttcgactctcaccatccagccgcctagacgcctgaacgtacttgctagtttatactgttcagtcagcgtaaccacgtcgccgctctacgttcggcggacgggaccaggtgagtatacgaacgtacgtggagtcgtgacacatctgtctctactctcccg

SEQ ID NO: 188292 - DNA, 535 bp, Homo sapiens
  misc_feature: GYAE6OF02FSOKJ.40.23.C01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtcttagcaactacttagtctggtaccaacagaaacctggccaggctcccaggctcctcatctatgatgcatccagcagggccacgtggcatcccagccagttcagtgcagtgggtctgggacagacttcactctcaccatcagcgacctagacgctgaagtactttgctagtttattacttgtcagcagtcgtaccaacgtcggccgctcgtacgtttccggacggtacgggaaccgtaagggtcggagacgtacgaaacggtaactgtacggctagcaccactcttcggtcttctattcccg

SEQ ID NO: 188293 - DNA, 511 bp, Homo sapiens
  misc_feature: GYAE6OF02I2EPS.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcgcctagacgcctgaagactttgctagtttatactgtcagcagcgtacaactggccgctcactttcggcgagggaccaaggtggagacgtacgaaacgacgtgtgcgtgacaccgatctgtctctactctcccg

SEQ ID NO: 188294 - DNA, 504 bp, Homo sapiens
  misc_feature: GYAE6OF02HJ4AX.40.23.C01.1.454.CMB.1.raw
  modified_base (202)..(202): a, c, t, g, unknown or other
  misc_feature (202)..(202): n is a, c, g, or t
  modified_base (479)..(479): a, c, t, g, unknown or other
  misc_feature (479)..(479): n is a, c, g, or t
  modified_base (500)..(500): a, c, t, g, unknown or other
  misc_feature (500)..(500): n is a, c, g, or t
tcagtctagcgactcacgaccggtgctcgatttagtacacgtgattagggattgggggaggaactgctcagttaggacccagagtgaaccatggaagccccagctcagcttctcttcctcctgctactctggctcccagataccaccggagaaattgtgtttacacagtctccagccaccctgtctttgtctccaggggaanagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcgcctagagcctgaagactttgctagtttattacgtgtcagcagctaccaactggccgctccacttcggccggagggaccaagggtgagatacgaacgactgnggctgcactatcctgtcttcntccg

SEQ ID NO: 188295 - DNA, 565 bp, Homo sapiens
  misc_feature: GYAE6OF02GP9JH.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggcctcccaggcctcctcatctatgatgcatccagcagggccactggcactcccagccaggttcaggtggcaggtgggtctgggacagtacttcacctctacaccatccgagccggcctagacgcctaggaacgtactttgactagttttattacgttgtcagcagtcgtaaccacgtcggacctctctacgtttcgggacggacgggaccgaagggtcggagtacgtacgaaacggtaacgtggtacggcgttagacctaccgtagtccgtgttaccttccgacttcccg

SEQ ID NO: 188296 - DNA, 505 bp, Homo sapiens
  misc_feature: GYAE6OF02FY32B.40.23.C01.1.454.CMB.1.raw
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacagacttcactctcaccatcagcgctagngcctgaagacttgctagtttattactgtcagcagcgtacactcgccnctctacgttcggcggagggaccaaggtggagatacaaacgacgtggtggctgcacatctgtctcactctcccg

SEQ ID NO: 188297 - DNA, 546 bp, Homo sapiens
  misc_feature: GYAE6OF02H60D0.40.23.C01.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaanagcccaccctctcctgcagggccagtcagagtcttagcaactacttagtctggtaccaanagaacctggccaggcctcccaggcctcctcatctatgatgcatccagcaggccagtggcactcccagccaggttcaggtcggcaggtgggctgggacaggacttcactcncaccatcagcgctagngctagagtcttgactagtttattacgtgtcagcagctaccacgtcggaccgtctcgtaccgttcggacgggtacgggaccgaagggtcggagtacgtacgaaacggtaacgtggtaggacctacgaccacgtacgtcgttcgttcttactacttcccg

SEQ ID NO: 188298 - DNA, 608 bp, Homo sapiens
  misc_feature: GYAE6OF02I1SRO.40.23.C01.1.454.CMB.1.raw
  modified_base (215)..(215): a, c, t, g, unknown or other
  misc_feature (215)..(215): n is a, c, g, or t
tcagtctagcgactcacgaccggtgctcgatttagtacacgtgattagggagttgggggaggaactgcctcagttaacggacccagagggaaccatggaagcccagcctcagcttctcttcctcctgctacgtctggcctcccgagatacccaccggtagtaaagttggtgttgacacagtctccgagcccacctgtctttgtctccaggggaangtcaccctctcctgcgaggccagtcagagtccttaggccaactacttagctcggtaccaacagaaacctggccctagtctcccaggctcctacattctatgatgcatccgagcgacgggccacgtggcagtccgagcctagggttcaggtcggcagtgggtctgggacagcttcgactctcaccatcagcgcgtagacgcctagagtacgttgcgtagttacgttacgtgtacgacgcacgtccgtaacctaacgtcggaccgtacctcgtaccgtttcggacggtacgggaccgaagggtcggaacggtacgttacgtaacggtaaccgttaggtccggtaccgtcgaccgtacccgtacggttccgttcggttcgttaccgtacgttcccg

SEQ ID NO: 188299 - DNA, 539 bp, Homo sapiens
  misc_feature: GYAE6OF02F44WU.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggctagagcctgaagtactttgctagtttattactgtcagcagcgtaccaacgtggcccgctccgtacgtttcgggacgggacgggaccaagggtggagactacgaaacggacgtggtcggactgcctaccagttccttggtcttactacttccttccccg

SEQ ID NO: 188300 - DNA, 819 bp, Homo sapiens
  misc_feature: GYAE6OF02HF0G6.40.23.C01.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
tcagtctagcgactcacgaccggtgctcgatttagtacacgtgattagggtagtttggggggaggaactgcctcagttaggacccagagggaaccatggaagccccagcgtccagcttctcttcctccgtgcctactctggctcccagatacccaccggagaaattgtgttgacacagtactccagccaccctgtctttcgtcctccaggggaagngccaccctntccgtgccagggccagtccagacgtcttagcgaactacttagctggtaccaacagaacctggtacctaggcctcccgaggcctccgtacaagtacctagtcgtaactccgcaactccgaggtccgaggggtacccctacgtggggaccaacgttcccccgaaggcccgtaagggttccgaagggtcgggcccaagggtttcgggtaccgtgggggaactacggtaccgtttaccgaaccttccgtaccgaacccgtagtacccgaacggtacccggtacccgtaaggtaaccgtccccgtaaggtaaaccggttaccgttttcggacccgttaacgttttaaccgttaaccgttcggttaccgaacggtaccgtaacggttaccgtttaaacccgtaacgttaccgggtacccgttaccgtaccgttaacccggttttaccggggaccgggttaaacgggtaacccggtaaacggggttcgggtaacggtacggttaacccgtaaaccgggtaaccggttaggggtaccggtaacgtcggtaaccgtacccgtaacggttaccgttacggttaccctttaccgacgttaccccg

SEQ ID NO: 188301 - DNA, 523 bp, Homo sapiens
  misc_feature: GYAE6OF02FH885.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggcctcccaggcctcctcatctatgatgcatccagcagggccatggcatcccagccaggttcagtggcagtgggtctgggacagacttcactctcaccatcagcgcctagcgcctgaagtactttgctagtttattactgtcagcagcgtaccacgtcggccgctctacgtttcgggcgacgggaccgaagggtggagactacgaacgtaacgtggtcggctgaccacactctggtcttcacttcccg

SEQ ID NO: 188302 - DNA, 552 bp, Homo sapiens
  misc_feature: GYAE6OF02GWPP0.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcagggccactggcatcccagccaggttcaggtggcagtgggtctgggacagacttcactctcaccatcagcggcctagacgcctagaagtactttgctagttttacttactgttcagcagacgtaccaacgtcggcccgtcttccgtaccgtttccgggcggtacgggtaaccgaagggtgggagtacgtacgaaacggtacgtggtggcgtagcaccgattctcgttcttctacttcctcccg

SEQ ID NO: 188303 - DNA, 520 bp, Homo sapiens
  misc_feature: GYAE6OF02H3POX.40.23.C01.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
  modified_base (441)..(441): a, c, t, g, unknown or other
  misc_feature (441)..(441): n is a, c, g, or t
  modified_base (475)..(475): a, c, t, g, unknown or other
  misc_feature (475)..(475): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccagccaccctgtctttgtctccaggggaaangccaccctctcctgcagggccagtcagagtcttagcaactacttagtctggtaccaacagaaacctggccaggctcccaggcctcctcatctatgatgcatccagcagggccagtggcatcccagccaggttcaggtcggcaggtgggtctgggacngacttcactctcacatcagcgcctagacgcctagaagtctttgactagttttattactgtcagcagcgtaccacgtcggccnctctacgttcgggcggagggacctaagggtgganagtacgaaacgactggtggctgccacatcctgtcttcacttcccg

SEQ ID NO: 188304 - DNA, 719 bp, Homo sapiens
  misc_feature: GYAE6OF02JNN6O.40.23.C01.1.454.CMB.1.raw
  modified_base (208)..(208): a, c, t, g, unknown or other
  misc_feature (208)..(208): n is a, c, g, or t
  modified_base (265)..(265): a, c, t, g, unknown or other
  misc_feature (265)..(265): n is a, c, g, or t
tcagtctagcgactcacgaccggtgctcgatttagtacacgtgattagggattgggggaggaacgtgctcagttaggacccagagggaaccatggaagccccagcctcagcttctcttcctcctgctactctggctcccagataccaccggagaaacttgtagtttacacagtctccagcccaccctgtctttgtctccgaggggaancgccaccctctcctgcagggccagtcagagtctagcaactcttagtctggtaccaanagaaacctggccaggctcccgaggcctctcatctatgatcgcactccgagcgacgggcccagtcggaccactccccgaagtcccgtaagggtttccaaggttcgggacgtagggttcggggtacgtacggggacctaacggtaccttttaccgaccttcgttacccaacctacgtccgaaggtcccggtacctaaaggaccgtaccgtagtaaacggttctttaggacctttaagtttacttacgtcgttacagtactacgggtacccgttaaccacgttaccgggtccaccgtttaccggtaaccgttttcccggggaacgggtaaacggggttaacccgtaaaggggttacgggaaccttaacggtaccgaaaacggtaccggttgggtaaccggtcgtacggacctaccgtacgttccgtaggttccctaccgtttactccccgtttaccg

SEQ ID NO: 188305 - DNA, 577 bp, Homo sapiens
  misc_feature: GYAE6OF02HDIDT.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccagccaccctgtctttgtctccaggggaaangccaccctctcctgcagggccagtcagagtcttagcaacttacttagtctggtaccaacagaaacctggccaggcctccaggctcctcatctatgatgcatccagcagggccatggcactcccagccaggttcaggtgcgaggttgggtctgggacaggtacttcactctcaccatcagcgctagacgcctagaagtctttagcttaagtttacttacgttgtcagctacgtccgtaaccaacgtcggacccgtcttacctacggtttccgggacgggtaacggggaccgaagggttgggaagacttaacggaaaccgtaacgttggtacggtcgtcgaccgtacctcgttaccgtgttaccttccacttccccg

SEQ ID NO: 188306 - DNA, 506 bp, Homo sapiens
  misc_feature: GYAE6OF02GY0AZ.40.23.C01.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtcttagcaactacttagtctggtaccaacngaaacctggccaggctcccaggctcctcatctatgatgcatccagcagggccactggcatcccagccaggttcagtggcaggtgggtctgggacagacttcactctcaccatcagcgctagagcctgaagactttgcagtttattactgtcagcagcgtaccaactggccgctcactttcggcggacgggaccaaggtggagatacaaacgaactggtggctgcaccatcgtgtcttcattcc

SEQ ID NO: 188307 - DNA, 538 bp, Homo sapiens
  misc_feature: GYAE6OF02J0JP3.40.23.C01.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (391)..(391): a, c, t, g, unknown or other
  misc_feature (391)..(391): n is a, c, g, or t
  modified_base (445)..(445): a, c, t, g, unknown or other
  misc_feature (445)..(445): n is a, c, g, or t
  modified_base (516)..(516): a, c, t, g, unknown or other
  misc_feature (516)..(516): n is a, c, g, or t
tcagtctagcgactcacgaccggtgctcgatttagtacacgtgattagggagttgggggagggaacgtgctcagttaggacccagagggaaccatggaagccccagctcagcttctcttcctcctgctactctggctcccagataccaccggagaaattgtgtttacacagtctccagccaccctgtcttgtctccaggggaanagccaccctntcctgcagggccagtcagagtcttagcaactactagtctggtaccaacagaaacctgccaggctccagctcctcatcatgatgcatccagcacgggccacgtggcatcccagccaggttcagtggcagtgggtctgggacagacgttcacgtctcaccagtcaggccggcctagacnccgttagacgtacttgctagttacttactgtctagcagcttacacgtgcctacnctacttcggcggacggaccgaggtggatacgtacgaacgacgtggtcggtactcggacaccgacgttcgtntcgttacctattcccgttaccg

SEQ ID NO: 188308 - DNA, 814 bp, Homo sapiens
  misc_feature: GYAE6OF02G64K1.40.23.C01.1.454.CMB.1.raw
tcagtctagcgactcacgaccggtgctcgatttagtacacgtgattagggatgggggaggaactgctcagttaggacccagagggaaccatggaagccccagctcagcttctcttcctcctgctactctggctcccagataccaccggagaagttgtagtttacacagtctaccagccaccctcgtacctttagtccttccgtaggggtaaagtaggtccaccccgtacggtaccctaggccacgggccctagtccagacgtcgttacgacaactacgttagtctaggtaccaacacgaaaccttggccgtaggcctacccgacggactaccgtcgactcgtactcgagtcgcctactacctacgtcgacgggtcctaccgtacggaccgacgtcccgacggtccgtacggttacgacggtcggtacgtagggttcggggtcgtacggggtacgtacggtacgtttcgacctcgtaccgtacctactccgacgtccggacttacggacgtcccgtaggtaaccgtcgtttacgacgttaaggtttttaacgtaacgttcggtttaccaaggttacgttacgttacccgttaaccgtaacgttccgggacccttaaccgtttacgttaaccggttttacggggaccgggttaaccggggtaaccccgttaaaggggttacgggtaaccgttaaccgtttacccgggttaaaaccgggtaccggttaggggttaaccggaacgttcccgggaaccgtaacccggtaactttcccggtaaacggttccctttacggtaccgttccccgttaccccgg

SEQ ID NO: 188309 - DNA, 533 bp, Homo sapiens
  misc_feature: GYAE6OF02IMH0L.40.23.C01.1.454.CMB.1.raw
  modified_base (202)..(202): a, c, t, g, unknown or other
  misc_feature (202)..(202): n is a, c, g, or t
  modified_base (513)..(513): a, c, t, g, unknown or other
  misc_feature (513)..(513): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacagacttcactctcaccatcagcggcctagacgctgaagtactttgctagtttattacgttgtcacgcacgtccgtaccacgtcggccgtctcctacgtttcggcggtacgggaccgaagggtgagagtacgaaacgacgtgtcggtctgacgtaccngttctgtcttcgacttcccg

SEQ ID NO: 188310 - DNA, 565 bp, Homo sapiens
  misc_feature: GYAE6OF02H7TPR.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcaggccactggcatcccagccaggttcagtgcagtggtcgtgggacagacttcactctcacatcacgcgcctagacgcctagacgtactttgcttagtttattacgtgtacagctagacgtaccaacgtcggccgtctacctacgtttcgggacgggtacgggaccgaagggtacggagtacgtaccgaaacggtacgtacggtacggacgttacggacctaccgtacgttccgttggttcctttccgacttccccg

SEQ ID NO: 188311 - DNA, 591 bp, Homo sapiens
  misc_feature: GYAE6OF02G7E8T.40.23.C01.1.454.CMB.1.raw
  modified_base (449)..(449): a, c, t, g, unknown or other
  misc_feature (449)..(449): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (564)..(564): a, c, t, g, unknown or other
  misc_feature (564)..(564): n is a, c, g, or t
tcagtctagcgactcacgaccggtgctcgatttagtacacgtgattagggagttggggggaggaactgctcagttaggacccagagggaaccatggaagccccagctcagcttctcttcctcctgctactctggctcccagataccaccggagaaattgtgttgactacagtctccagccaccctgtcctttgtcttccaggggtaagaggccaccctctccctcgccagggccaggtccagagtcttagcaactacttagtctggtaccaacagaaacctggccaggctcccaggctcctcactctactgatgcatccagcgagggccacgtggccactcccgagccaggtcaggtgcgaggtgggtcgtagggacagtacttcactctacaccatcagccgcctagacgtcctaggaacgtactttgtactagtttacttagtcgtnacggctagacgtactacgnggtacccnctcgtacgttccggcggaacgggtacccaaaggggtcgtaacgagtttaccgaaaacggtacgttggtacggtactcgacctaccgtntccgttaggtaccttcgactttccccg

SEQ ID NO: 188312 - DNA, 525 bp, Homo sapiens
  misc_feature: GYAE6OF02HI265.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctccaggctcctcatctatgatgcatccagcagggccacgtggcatcccagccaggttcagtggcaggtggtctgggacagacttcactctcaccatcagcgcctagacgctagaacgtactttgctagtttattacttgtcagcagctaccaacgtcggccgctctacgtttcggcggacggaccgaagggtgagatacgaaacgtactggtcggacgtgacgaccactcgttgtcttcacttcccg

SEQ ID NO: 188313 - DNA, 584 bp, Homo sapiens
  misc_feature: GYAE6OF02FTEHC.40.23.C01.1.454.CMB.1.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaagngccaccctctcctgcagggccagtcagagtcttagcaactacttagtctggtaccaacagaaacctggccaggcctcccgaggctcctcatctatgatgcatccagcagggccacgtggcatcccagcctaggttcagtggcaggtgggtcngggactaggacttcactctcaccatcgagcgcctagacgcctgaacgtactttgactagtttattactgtacagctacgtaccgtaaccaacgtcggccgtcttaccgtacgtttccggggacgggaacgggtaaccgtaagggtaggaggtacgtaacgaaaccggtaacgtggtacgggaccgtacgacccgaactacgttccgttcgttaccttccgactttcccg

SEQ ID NO: 188314 - DNA, 602 bp, Homo sapiens
  misc_feature: GYAE6OF02GYN1E.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctccaggctcctcatctatgatgcatccagcaggccacgtggcatcccagccaggttcagtgctagtgggtctgggacagacttcactctcaccatcgagcgctaggacgtcctagaagtactttgactagtttacttacttgtacagcgagtccgtaccaacgtcggacccgtctccgtaccgtttccgggacgggtaaccggggaaaccgtaagggtacgggaacggtacgttaaccggaaaccggtaacgttacggtcggtaccgttacggacccgtaaccgtacgttccgttaccggttactttacccgtactttaccccg

SEQ ID NO: 188315 - DNA, 592 bp, Homo sapiens
  misc_feature: GYAE6OF02IN9SX.40.23.C01.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaacagaaacctggccaggcctcccaggcctcctcatctatgatgcatccagcagggccacgtgcactcccagccaggtcaggtcgcagtgggtctgggacagcttcactcncaccntcagcggcagacgctagagtactttgcttagtttacttacgtgtacagcacgtcgtaccacgtcggcccgtcgttaccgtaccgtttccggggacgggtaacgggaacccgtaagggtacgggaacgtaacgtaccggaaacgtacggtggtaccggacgtacggaccaaccgtacgttccgttacgttccttaccgttaccgttcccttaccccgg

SEQ ID NO: 188316 - DNA, 540 bp, Homo sapiens
  misc_feature: GYAE6OF02IBIJ9.40.23.C01.1.454.CMB.1.raw
  modified_base (202)..(202): a, c, t, g, unknown or other
  misc_feature (202)..(202): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaangccaccctctcctgcagggccagtcagagtcttagcaactacttagtctggtaaccaacagaaacctggccaggctcccaggctcctcatctatgatgcaatccagcaggccactggcatcccagccaggttcagtggcaggtggtcngggacagtactcactcncaccatcacggccgctaggacgccgtagaaacgtctttgacttagtttattactgtcagcagccgtaacactggcctctacctacgtttcgggcggaacgggaccaagggtgaagataccgaaacgtacgtgtacgctcgaccaccattctgttccttctacttcctaccccg

SEQ ID NO: 188317 - DNA, 533 bp, Homo sapiens
  misc_feature: GYAE6OF02G9OPH.40.23.C01.1.454.CMB.1.raw
  modified_base (203)..(203): a, c, t, g, unknown or other
  misc_feature (203)..(203): n is a, c, g, or t
  modified_base (513)..(513): a, c, t, g, unknown or other
  misc_feature (513)..(513): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggcctcccaggctcctcatctatgatgcatccagcagggccacgtggcatcccagccaggttcagtggcaggtgggtctggggacagtacttcactctcaccatcagcggcctagacgcctgaagtctttgctagtttattactgtcagcagccgtaccaacgtcggccgtctacctacgtttcggcgggtacggacgaaggtggagactacgaaacgtacgtggtgcgtgacacctntccgtgtcttctacttcccg

SEQ ID NO: 188318 - DNA, 518 bp, Homo sapiens
  misc_feature: GYAE6OF02G5XT9.40.23.C01.1.454.CMB.1.raw
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacagcttcactcncaccntcagcgctagngctgagactttgctagtttattactgtcagcagcgtaccactcggccgctcacgtttcggcggacggaccgaaggtggagataccgaaacgtacgtggtcgcgtgccaccattcctgttacttcatccctcccg

SEQ ID NO: 188319 - DNA, 574 bp, Homo sapiens
  misc_feature: GYAE6OF02IN9MW.40.23.C01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggcctcccaggctcctnatctatgatgcatccagcagggccacgtggcactcccagccaggttcagtggcaggtgggtctgggacagacttcgactcacacatcagcgctagagcctagaagtcttgacgtagtttattactgtcagcagtaccgtaccacgtcggaccgtctacgtaccgtttcgggaccgggtacgggaccgtaagggtggaagacgtaacgaaaccggtacgttaggtacggtccgtacggaccaacccgtacgttaccgtacggtttccttacgtacgtttccccg

SEQ ID NO: 188320 - DNA, 539 bp, Homo sapiens
  misc_feature: GYAE6OF02F7NTB.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctccaggctcctcatctatgatgcatccagcagggccactggcatccccagccaggttcaggtcggcaggtgggtctggggacagtacttcactctacaccatcagcggcctagacgcctgaagtactttgctagtttattacttgtcagcagcctaccactcggcctctccgtacgtttccggacggacggaccgaagggtgagagtacaacggtaactggtaggtctagccacctattccgtgttccttactacttcccg

SEQ ID NO: 188321 - DNA, 597 bp, Homo sapiens
  misc_feature: GYAE6OF02I2PV1.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactactagtctggtaccaacagaaacctggaccaggcctcccaggctcctcatctatgatgcatccagcagggccacgtggcatcccagccaggttcagtggcagtgggtcgtggacagtacttcactcgtacctacaactccgacgtccggacctagacgtccgtaggaacgtactttgacttagtttaattacttgttacagtacaggtaccgttaacctaacgtcggaccgtacctccgtacgtttccgggacgggtaccggaaccgtaggtacggtacgatacgaaaccggtacgtggtacggacgttcgacgtaccgagttacttgtacctttactacgttcccttacccg

SEQ ID NO: 188322 - DNA, 565 bp, Homo sapiens
  misc_feature: GYAE6OF02JFDXF.40.23.C01.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttaacacagtctccagccaccctgtctttgtctccaggggaaanagccaccctctcctgcagggccagtcagagtcttagcaactacttagtctggtaccaanagaaacctggccaggcctcccaggcctcctcatctatgatgcatccagcaggccagtggcactcccagccgtaggttcagtcggcaggtcgggtctgggactaggacttcactctcaccatcgacgcggtacctagacgtcctagaacgtctttgcttaagtttactacgtgtcagcacgcctaaccacgtcggccgtctcgtacgttcgggcggacggtaccgaggtcggagtactacgaacgtacgtggtcgactcgactaccgtcttaccgttcgtaccttacgtacttcccgtacccg

SEQ ID NO: 188323 - DNA, 580 bp, Homo sapiens
  misc_feature: GYAE6OF02HMXG1.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctcccaggcctcctcatctatgatgcatccagcagggccacgtggcatcccagccaggttcagtgcaggtgggtctgggacaggacttcactctcaccatcagcggacctagacgcctagaacgtactttgctagttttatacttgtcagcacgcgtaaccaacgtcggacccgtctactacgtttcgggacgggtaacgggaccaaagggtggaacgtacgtaccgaaaccggtaacgttcggtacgggtacgttacggacctaccgtacttccgttacggtttcctttacacgtttccccg

SEQ ID NO: 188324 - DNA, 588 bp, Homo sapiens
  misc_feature: GYAE6OF02H7KAM.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagatacccaccggagaaattgtgtttacacagtctccagccacctgtctttgctccgaggggaangccaccctctcctgcagggccagtcagagtcttagcaactacttagtctacggtaccaacagaaacctggaccaggcctcccaggcctcctcatctatgatgcatccagcgagggccacgtcggcactcccagccaggttcaggtcggcgaggtgggtctagggacagtcttcactcacaccatcacgccgactagcgcctagaacgtactttgacttagtttagttactgttcagcgtagtaccgtaaccaacgtcggccgacttccgacgttcgggacgggacgtaccgagggtacgacgtactaacgtaacggtacgttagggcgtacgtcgaaccaccgttacgttcgttacgtttaccttcctaccgttcccgttaccccg

SEQ ID NO: 188325 - DNA, 601 bp, Homo sapiens
  misc_feature: GYAE6OF02IQE2W.40.23.C01.1.454.CMB.1.raw
tcagtctagcgactcacgaccggtgctcgatttagtacacgtgattagggattggggggaggaactgctcagttaggacccagagggaaccatggaagccccagctcagcttctcttcctcctgctactctggctcccagataccaccggagaaattgtgtttacacagtctccagccaccctgtctttgtctccgaggggaaagagccaccctctcctgcgacgggccagtcagagtcttagcaactacttagtctggtaccaacagaaacctggccaggcctccgaggcctcctcatctatgatgcatccagcaggccacgtggcactcccagcctaggttcaggtggctaggtggcgtgggacagtacttcgactcacaccatccgagccggtactaggacgcccgtagaacggtactttgacttagtttacttacgtagtcgaagcaacgtccgtaacacgtcggccgtactcctacggttccgggaccggtacggaaccggtaagggtcggaacgtagtaccgaaacggtaccgtgggtcggactacggaccctaccgagttccgtacgttacctacggttactccccttacccgg

SEQ ID NO: 188326 - DNA, 516 bp, Homo sapiens
  misc_feature: GYAE6OF02GUO5T.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacagacttcactctcaccatcagcgcctagacgcctgaagactttgctagtttatactgtcagcagcgtaccaacgtcggccgctctacgtttcggcggtacgggaccaagggtgagatacaacgacgtggtggctcgacacatctgtcttcactctcccg

SEQ ID NO: 188327 - DNA, 733 bp, Homo sapiens
  misc_feature: GYAE6OF02IJUKV.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaacagaaacctggaccaggcctcccaggctcctcatctatgatgcactccgagcgacgggccaacgtggacactaccccagccgtaaggtttcaaggttcggacgtagggttcggggttacgtagggggaactaggtacctttacgaaccttaccttacccaaccctaactcgaacggccggtacctaggacgtcccgttaggaaacgttacttttaggacttaaggtttttaacttaccgttaggttaccgtaacggcgtaacggtaccgttaacccgaacgtcgggtcccgtactttaccgtaaccggttttccggggaccggggtaaccgggaaccggtaaaggggtcggtaacggtaacgtaaccgaaaaccggtaccgttgggttaaccgggaccgttaacggaccctaaacccggtacgttaccgtttaccgttaccgtttaccgtaccgtttccccgttacccccgg

SEQ ID NO: 188328 - DNA, 523 bp, Homo sapiens
  misc_feature: GYAE6OF02FTV7Q.40.23.C01.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaanagaaacctggccaggctcccaggctcctcatctatgatgcatccagcagggccacgtggcactcccagccaggttcaggtggcaggtggtctgggacagacttcactctcaccatcagcgctagacgctgagtcttgactagtttatactgtcagcagcgtacacgtcgccgctctacgtttcggcggtacggaccagggtcgacgtatacgaacgacgtggacggtactcgacctacgatcgtagtctctactcctcccg

SEQ ID NO: 188329 - DNA, 555 bp, Homo sapiens
  misc_feature: GYAE6OF02FPRFJ.40.23.C01.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccacctgtctttgtcctcgaggggaaancgccaccctctcctgcagggccagtcagagtcttagcaactacttagtctggtaccaacagaaaacctggccaggcctccaggcctcctcatctatgatgcatccagcagggccacgtggcatcccagccgtaggttcaggtcggcaggtgggtctggggacaggtacttcacttcgcacatcagcgacctagngcctagaacgtactttgctagttattactgtcagcgagtccgtacctaacgtcggccgtctctacgtttcgggcgggtacggaccaagggtggacgtataccgaaacggtactaggtacggctacgccacctacttcgttacgtcttcactttccccg

SEQ ID NO: 188330 - DNA, 612 bp, Homo sapiens
  misc_feature: GYAE6OF02JAJBQ.40.23.C01.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtcttgtctcgagggaangccacctctcctgccagggccagtcagagtcttagctaactacttagtctggtaaccaacagaaacctggaccaggcctcccgaggtcctcctcatctatgatgcatccagcgaggccacgtggcatcccgagccaggttcagtgctaggtcggtntagggacagtacttcaacttccacacctatccgagccgacctagacgacgtagaacgtacttcgacttagtttacttacgtcgtacgacgtacgacgtaccgtaaccacgtcgaccgtcgtacgtaccgttcgggacggtaacggtaccgtaagggtacgggaagtacgtaacgtaaaccggtacgttacggtacggtaccgtacgtacctaaccgtacgttccgttacggttcctttaccgtacctttaccccgg

SEQ ID NO: 188331 - DNA, 550 bp, Homo sapiens
  misc_feature: GYAE6OF02G99BC.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctcctgcagggccagtcagagtcttagcaaactacttagtctggtaccaacagaaacctggccaggctcccaggctcctcatctatgatgcatccagcagggccacgtggcatcccagccaggttcaggtgcaggtgggtctgggacagacttcactctcacatcagcgcagcgcctagaatctttgctagtttatactgtacagacagcctaccgaacgtcgccgtctctacgttcggacggtacgggaccgtaaggtcggaagacgtacgaaacggtacgtggtcggactagaccaaccgtcgttacgttcgttaccttctaccttccgttaccccg

SEQ ID NO: 188332 - DNA, 529 bp, Homo sapiens
  misc_feature: GYAE6OF02GD1ZY.40.23.C01.1.454.CMB.1.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (439)..(439): a, c, t, g, unknown or other
  misc_feature (439)..(439): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaccaacagaaacctggccaggcctcccaggcctcctcatctatgatgcatccagcagggccagtggcatcccagccaggttcagtggcaggtgggtctgggacagtacttcactctcaccntcagcgctagngctagagtactttgctagtttattactgtcagcagtcgtaaccactcggccnctctacgttcggcggaggaccaagggtgagtacgtacgaaacggtacgtggtacggctgacctaccgattccgtgttccttcacgttccc

SEQ ID NO: 188333 - DNA, 589 bp, Homo sapiens
  misc_feature: GYAE6OF02GR3NB.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactacttagtctggtaccaacagaaacctggccaggctcccgaggcctcctcatctatgatgcatccagcacgggccacgtggccactccccagccaggtttcaggtggcaggtggggtctggggacaggtacttcactctcaccatcagccggcctagacgcctagaacgtacgtttgacttagtttattacgtgttacagcgagccgtaaccacgtcggcccgtctaccgtacgtttcggacgggacgggtaccgaagggtggacgtacgtacgaaacggtacgtcggtacggtcgtacggaccgtacctacgttccgttcgttccttctaccttccgttaccccg

SEQ ID NO: 188334 - DNA, 593 bp, Homo sapiens
  misc_feature: GYAE6OF02FXBGP.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctccaggctcctcatctatgatgcatccagcagggccatggcatccccagccaggttcagtggcagtgggtctggggacagacttcactctacaccatcagccgacctagcgcctagaagtactttgctagtttacttctgtacagtcagtccgtaaccaactcggacccgtctacccgtacgtttccgggaccggtaacgggacccgtaaaggggttcgggaacgtacgtaacgaaaccggtaacgttacgggtacggaccgttacggacccgaaccctagttcccgttagttaccctttaccacgtttcccccg

SEQ ID NO: 188335 - DNA, 516 bp, Homo sapiens
  misc_feature: GYAE6OF02HNUAG.40.23.C01.1.454.CMB.1.raw
  modified_base (203)..(203): a, c, t, g, unknown or other
  misc_feature (203)..(203): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggccaggctcccaggcctcctcatctatgatgcatccagcagggccatggcatcccagccaggttcagtgcaggtgggtctgggacaggacttcactctcaccatcagcgcctagcgctagaagtactttgcttagttttatacttgtcagcagcctaccacgtcggccnctctcgttcggcggaggaccgagggtgagacgtacgaacgactggtggctcgactacactcttgtcttcnttcccg

SEQ ID NO: 188336 - DNA, 694 bp, Homo sapiens
  misc_feature: GYAE6OF02GDYG3.40.23.C01.1.454.CMB.1.raw
  modified_base (207)..(207): a, c, t, g, unknown or other
  misc_feature (207)..(207): n is a, c, g, or t
tcagtctagcgactcacgaccggtgctcgatttagtacacgtgattagggattgggggaggaactgctcagttaggacccagagggaaccatggaacgccccagctcagcttctcttcctcctgctactctggcctccagataccacggagaattgtgttgacacagtctccagcccaccctgttctttgtcctccgaagggggaancgcccaccctctcctgcgacgggccagtcagagttcttagcctaacttactttagtctacggtaaccaaacgaacggaaacctcggacccgaagggtccctaccccgaaggtcctccctacaacttctagtggacttcgacactccgacggccgacgggcccaagtcggcactcccaggcctaggttccaggtcggacgtacggggtgggtccgtaggggaactaggtaccttacgacttccctaccaacctagtccgacggccggtacgtaacggacgccgtaggtaacgttactttggtacttaagttttacttactcgtactacgtcaacggtcctaaccgaacgtcgggacctccgttacctaccggttaccggggacgggaaccgggtaaccggaaggggtaggaacgtagtaaccgaaacggtacgtggtacggtactacggaccaacgtcgttaccgttcgttcctttacgaccttcccg

SEQ ID NO: 188337 - DNA, 614 bp, Homo sapiens
  misc_feature: GYAE6OF02GI30M.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagcaactacttagtctggtaaccaacagaaacctggccaggctcccagctcctcatctatgatgcatccagcacgggccacgtggcactcccagccaggttcaggtcggctaggtggggtctggggacaggtaccttcgacttcgtaccacctatccgaggtccggacctaggaccgtccgtaggaacgttactttggacttacggttttattacgtgtacgagccgtagtccgtaaccgtacgtcggaccgtccgtaccgtaccggtttcgggaccgggtaacggaaccgtagggtcggaacgacgtaacgaaccggtaacgtggtacggtctacgacctaccgtacttccttacggttccttaccgacgttccccg

SEQ ID NO: 188338 - DNA, 556 bp, Homo sapiens
  misc_feature: GYAE6OF02GA8M1.40.23.C01.1.454.CMB.1.raw
  modified_base (376)..(376): a, c, t, g, unknown or other
  misc_feature (376)..(376): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccagtcagagtcttagcaactacttagtctggtaccaacagaaacctggccaggcctccaggctcctcatctatgatgcatccagcacgggccagtcggcactcccagccaggttcaggtggcaggtgggtctgggacagacttcactctcacntcgagcgcctagacgcctagaacgtactttgacttagtttacttacttcgtcacgcagtccgtaaccaacgtcggccctctacgtaccgttcggacgggtacggaccgtaagggagagactacgaaacgtacgtcggtacggctcgacaccgtacttcgtacgttccttacgattccccg

SEQ ID NO: 188339 - DNA, 553 bp, Homo sapiens
  misc_feature: GYAE6OF02HPXKT.40.23.C01.1.454.CMB.1.raw
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaanagccaccctctcctgcagggccagtcagagtcttagcaactattagtctggtaccaacagaaacctggaccaggctcccaggcctcctcatctatgatgcatccagcgaggccacgtggcactcccagcctaggttcagtggctaggtgggtctgggactagacttcactctcactntcagccgctagcnctagatcttgcttagtttactactgtacagtcgacgtcgtaccacgtcggcccgtactccgtacgtttcgggacggtacgggaccgaaggtcggaagacgtacgaacgtacgtggtcggtctcggaccactagtcctgttaccttctacttcccgtcccg

SEQ ID NO: 188340 - DNA, 549 bp, Homo sapiens
  misc_feature: GYAE6OF02HANFV.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaancgccaccctctcctgcagggccagtcagagtcttagcaactacttagtctggtaccaacagaaacctggaccaggcctcccaggcctcctcatcatgatgcatccagcgaggccagtggcactcccagcctaggttcagtggctaggtgggtctgggacagtacttcactcacacatcgagcgcctagacgccgtagaacgtactttgacttagtttatcttgtcagcacgacgtacacgtcggccgtctacgtacgttcggacggaacgggacgaagggtagacgacgtacgaacgtacgtggtacggcgtcgaccgactagtccttgttaccttacacttcccg

SEQ ID NO: 188341 - DNA, 769 bp, Homo sapiens
  misc_feature: GYAE6OF02H7JZ1.40.23.C01.1.454.CMB.1.raw
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtcttgtctccgaaggggaanagccaccctctcctgcgagggccagtcagagttcttagacaactacttagtctggtaaccaacagaaacctggaccaggcctcccaggcctccncatctatgatgacactccagccgagggcccacgtggacctacgtccccgaacggtccgtaagggtttcaagggttcgggtacgtacggggttcggggttacgtagggggaacctaggtaccttcacccgttccaccgaccctagtaccgacgggcccggtacctacgggaccgtacccgttaaggtaaacgtaccgttttaggaccgtttaaagtttttacgtttaacgtttcgtacgtaacgtaccgtaacgttaccggtaaaccctaaggtccggggtaccctaccgttaccgtaccggttttccgggggaacgggtaaccggggtaaccgtaaaggggtacgggtaaccgtaagtaaccggaaaaccggttacggtacgggtaccggttaccggtaccggtaacccgaccgtttacgttaccgtttaccgtttcccctttacgttaccccgttcccgttaaccccccgg

SEQ ID NO: 188342 - DNA, 717 bp, Homo sapiens
  misc_feature: GYAE6OF02ISY02.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggcctcccgaggcctcctcatctatgatgctactccgagcgacggccacgtcggcactaccgaagtcccgtaggttcgaggtcggacgtagggtcgggtccgtaggggaactacggtaccttacgaccttcctaccctacccgtagtaccgacggtcccggaccgttaacggacgtcccgtaaggaaacgtttacgtttacggaccgtttaaggtttttaccgttacgttacgttaccgtacggtaccgtaacggttaccgtaacccgtaacggttccgggtacccgtccgttaccgttaccggtttaccggggaccggggtaacggggtaacccgtaagggggtacggaacgtacgttaaccgaaacgggttacgttacgggtcgtaccgttacgaccgtaccgtacgtttccgtacggtttaccttacgtaccttccccg

SEQ ID NO: 188343 - DNA, 588 bp, Homo sapiens
  misc_feature: GYAE6OF02IIY3Q.40.23.C01.1.454.CMB.1.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
tcagtctagcgactcacgaccggtgctcgatttagtacacgtgattagggagttgggggaggaactgctcagttaggacccagagggaccatggaagccccagctcagcttctcttcctcctgctactctggctcccagataccaccggagaaattgtgtttacacagtctccagccacctgtctttgtctccaggggaaanagccaccctctcctgcagggccagtcagagtcttagccaacttacttagtctcggtaccaacagaaacctggccaggctcccaggctcctcatctatgatgcatccagcagggccacgtggcactcccagccaggttcaggtgcaggtgggtctagggacaggtacttcacttcnccacatcgagccgcgtagacgccgtagaacgtacttgactagttttatatcgtctagcagtacgtaccacgtcggcctcgtcgtacgttcgggacggtacgggaccgtaagggtggaacgtacgtacgaaacggtacgtacggtacggtaccgtacgaccctaacgtacgttacgttccgttaccgtttacctaccgttcccgttaccccg

SEQ ID NO: 188344 - DNA, 604 bp, Homo sapiens
  misc_feature: GYAE6OF02FSXY7.40.23.C01.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccaggggaaangccaccctctcctgccagggccagtcagagtcttagcaactcttagtctggtaccaacagaaacctggccaggctcccaggctcctcatctatgatgcatccagcagggccacgtggcatcccagccaggttcaggtgcaggtcgggtctggggacnggacttcactctcaccatcagcggacctagacgccgtgaacgtactttgactagtttactactgttacaggtcagtccgtaacctaacgtcggcccgtctcgtaccgtttcgggacgggtacgggaccgaagggttaggaacgtacgtaccgtaaacggtaacgttcggtacggtaccgtgggtaccctaaccgtagttaccgttaccggttacccgtttactaaccgtttcccgttaaccccgg

SEQ ID NO: 188345 - DNA, 610 bp, Homo sapiens
  misc_feature: GYAE6OF02HXXHB.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagagtcttagcaactacttagtctggtaaccaacagaaacctggccaggctcccaggctcctcatctatgatgcatccagcgagggccacgtggccactaccccagccacgggttcaggttcggcgtaggttcgggtcgtggggaactagaccttcactctaccaccatcaggcgacgtagcgaccgtagtaagtacgtttagcgtaagttttacttacttgtacagccagtaccgtacccgaacgtcggaccgtctccgtacgtttcgggcgggtacgggaacccgaagggtacggagtacgtaccgaaacggtaacgttcggtagggtaccgtacggaccgaactacttccgttacgtttaccttaccgtaccttaccccg

SEQ ID NO: 188346 - DNA, 684 bp, Homo sapiens
  misc_feature: GYAE6OF02INMTP.40.23.C01.1.454.CMB.1.raw
tcagtctagcgactcacgaccggtgctcgatttagtacacgtgattagggattgggggagaactgctcagttaggacccagagggaaccatggaagccccagctcagcttctcttcctcctgctactctggctcccagataccaccggagaaattgtgttgacacagtctccagccaccctgtctttgtctccgagggaagcgccaccctctcctgcagggccagtccagacgtcttagactaacttacttagtcctaggtaaccaacagaaacctggccaggcctcccgaggcctcctcatctatgactgcactccaggaccgacgggccacgtcggcctactcccgaacgccgtacggttcaggttcggaccgaggttcggggtcgtacggggacacggtaccgttcacctctaccaccctattccgaacggtccggtacctacggacgtaccgtaggtaacgttacgtttacggactttaacgttttacttacgttcgtacgacgtacgtacgtacctaaccgtacgtcggaccgtaccttacgtacccggttacgggaccggtaacggggtaccggtaagggttacgggaacgacgtaaccgtaacggtaacggttgggtacgtacgtacgggaacctaccgtacgttaccgttaccgttacgttacctcgtttaccccg

SEQ ID NO: 188347 - DNA, 750 bp, Homo sapiens
  misc_feature: GYAE6OF02JN695.40.23.C01.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgctccaggggaangccacctctcctgcagggccagtcagagtcttagcaactcttagctggtaccaacagaaacctggaccaggcctaccaggcctccncattctatcgatcgctatccagccgacgggccaacgtcggaccacgtccccgaagtcccgtaaggttccaggtcggacgtagggtcgggtcgtaggggactacggtacttcgaacgttcctaccgaaccctagtccgaacggtccggtaccttaacgggacgtacccgttaggtaaacggttacgtttacggtactttaaggttttaacgttaccgttaggttaccaaggttcctaaacggtacccggttaaacccgtaaaccggttccgggaacccgttccgttaacccgttaccgggtttaccgggggaccggggtaaacgggtaccccgtaaaagggggtccgtaaacggtacgttaaacccggtaaaacggttccgggtacggttaacgggtccgtaaccggtaaccggtacccttaagttcccgtttaacgggttccctttaccgtaaccgtttcccc

SEQ ID NO: 188348 - DNA, 710 bp, Homo sapiens
  misc_feature: GYAE6OF02HVRHD.40.23.C01.1.454.CMB.1.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagtctagcgactcacgaccggtgctcgatttagtacacgtgattagggattgggggagggaacgtgctcagttaggacccagagggaaccatggaagcccagctcagcttctcttcctcctgctactctggcctccagtatacccaccggacgaaatttgtgttgacacagtctccagccaccctgtctttcgtctccgaaggggaaagagcccaccctctcctgccagggccagtcaagacgttcttaggcaactacttgtctggtaccaanacgaacctggcacggcnccgagcctcctcatctatcgatgctatccgagtcggacggtccacgtcgcaacctcccacggacccaggttccgacggtggtccgaggtcgggtcgtagggggaacacggtaccgttaccacgttcctaccgaccctataccggacggtccgacccgtagtaccgggcctacggtaacggttaccgttaggtacccgttaagttttaacgttaccgttacggtttacacggacgttaacgccggtaaacccggttacgtaccgggacccgtcccgttacccgttaccggtttccgggaccgggtaaccggggtaacccgaaggggtaccggtagaaccggtaccgaaaggaacccgttggtaccggacgtaccgaccgacgttacgtccgttaccggtttctacccgttagtccccgg

SEQ ID NO: 188349 - DNA, 751 bp, Homo sapiens
  misc_feature: GYAE6OF02GVK4Q.40.23.C01.1.454.CMB.1.raw
  modified_base (148)..(148): a, c, t, g, unknown or other
  misc_feature (148)..(148): n is a, c, g, or t
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagtctagcgactcacgaccggtgctcgatttagtacacgtgattagggattgggggaggaactgctcagttaggacccagaggaaccatggaagcccagctcagcttctcttcctcctgctactctggctccagataccaccgganaaattgtagttgacacagtctccagccaccctgtcctttgtcctccaaggggaaangcccaccgtctccgtgctacggccagttcagngtcttagcaactacttagcttcggtaaccaaacgctaaaccgtggaccaggtcctcccgaaggtcctcccgtanaacttcagtgaactgacactcctacgagacggacctacgtcgggaacctacgtccccgaagtccccggtaagtttccggaagtcggaccgttaaggttccgggtccgttaggggtaaccaacggtacgtttacccaacgtttccctaacgaacccgtagttacggaacgtccgggtaacccgtgaaccgtccggtaacgtaaacgtacgttttaccggacttaaccgtttaagtttacccgtgtaccgtaacgtacggaacgtccggttaaacctaacggttcggaccgttacgttaaccgtaccggtttaccgggaaccgggtacggtaaccgggtaaaggttacgtaacggtacggtaactaaacccggggttaatacggggttcgaaccgttacgtacccacggttactaaggttcccgttaacgtcttaccgttccg

SEQ ID NO: 188350 - DNA, 545 bp, Homo sapiens
  misc_feature: GYAE6OF02GXV45.40.23.C01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (288)..(288): a, c, t, g, unknown or other
  misc_feature (288)..(288): n is a, c, g, or t
  modified_base (453)..(453): a, c, t, g, unknown or other
  misc_feature (453)..(453): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtcttagcaactacttagtctggtaccaacagaaacctggccaggctccaggctccncatctatgatgcatccagcagggccactggcactcccagccaggttcaggtgcaggtgggctgggacagacttcactctacaccatccgagccgtacctagacgtcctagaagtctttgacttagtttacttacgtgtcacgcacgtccgaaccgacgtcggccncgtacgtaccgttcgggcgtacgggaccgaagggtggagacgtacgaaacgagttgtacggctacgcactcgtcgtcgtacttcgacttccc

SEQ ID NO: 188351 - DNA, 537 bp, Homo sapiens
  misc_feature: GYAE6OF02G664L.40.23.C01.1.454.CMB.1.raw
  modified_base (203)..(203): a, c, t, g, unknown or other
  misc_feature (203)..(203): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagtctagcgactcacgaccggtgctcgatttagtacacgtgattagggattggggggaggaactgctcagttaggacccagagggaaccatggaagccccagctcagcttctcttcctcctgctactctggctcccagataccaccggagaaattgtgtttacacagtctccagccaccctgtctttgctccaggggaaangccaccctctcctgcagggccagtcagagtcttagcaactacttagtctggtaccaacagaaacctggccaggcctcccgaggcctcctcatctatgatgcatccagcagggccacgtggcactcccagccaggttcaggtggcgaggtggtctgggacagacttcactcncaccntcagcgctagagctgaagtcttgctagtttatactgtctagcagcgtaccaacgtcgccgtctacgtacgttcggcggtacgggacgaggtgagtacacgaaacgacgtggacggtctagacctaacgtacttcgtgttcttactacttccgtacccg

SEQ ID NO: 188352 - DNA, 657 bp, Homo sapiens
  misc_feature: GYAE6OF02GHUO4.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgtttacacagtctccagccaccctgtctttgtctccaggggaaangccaccctctcctgcagggccagtcagagtcttagcaactacttagtctggtaccaacagaaacctggaccaggctcccaggcctcctacatctatcgatcgcactccgagcgacgggccacgtcggacactcccgagcctaggttcgaggtcggactagggtcggtcgtacggggactacggactttcgaccttctacgaacctagtccgaggccggtacctaagacgtccgtagtaacgtctttggaccttaagttttacttacgtgtacgagcgtagtccgtaaccacgtcggcctcttaccgttaccgtttaccggggaccgggtaacgggtacccgtaaagggtacggacgaacgttaacggaaaccggtacgttcgggtacggtacgtaccgaccgtacttaacgttccgttaccggtttccttaccgttaccgttcccgttaccccgg

SEQ ID NO: 188353 - DNA, 637 bp, Homo sapiens
  misc_feature: GYAE6OF02GYIH9.40.23.C01.1.454.CMB.1.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
tcagtctagcgactcacgaccggtgctcgatttagtacacgtgattagggattgggggaggaactgctcagttaggacccagagggaaccatggaagccccagctcagcttctcttcctgctgctactctggctcccagataccaccggagaaattgtgtttacacagtctccagccaccctgtcttgtctccaggggaaangccaccctctcctgcgagggccagtcagagtcttagcaactacttagtctggtaccaacagaaacctggccaggcctcccaggcctcctcatctatgatgcatccagcagggccagtggcactcccagccgaaggttcaggtcggcgtaggtcgggtcnggggacaggacttcgacctcncacctntacgacgccggacctaggacgtccgtaggaaacgtacgtttagaccgttaagttttacttacgttgttacgacgcgaacgtccgtaacctaaccgtcggcccgtctaccgtaaccggttttcgggaccgggtaacggggaacccgtaaggggtgggaacgtacgttaaccgaaacggtaacgttcggtacgggtaccttcggacctaaccgtacgttaccgttacgttaccgttacgtacgttaccccg

SEQ ID NO: 188354 - DNA, 731 bp, Homo sapiens
  misc_feature: GYAE6OF02FZUPI.40.23.C01.1.454.CMB.1.raw
  modified_base (205)..(205): a, c, t, g, unknown or other
  misc_feature (205)..(205): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccgaggggaaagngccaccctctcctgcgagggccagtcagagtcttagcaactacttagtctaggtaccaacacgaaacctggccaggcctcccgaggcctcctcatctatgatgcactccagccgacgggcccacgcggcactcccgagccgtaggttcgaggtcggcgagggttggggtcgtggggactacgtacctttcgacttcctaccaacctagtccgacggccgggtacctaaggaccgtaccgtaggtaaacgttcgtttagaccgtttaagtttttaacgttacgttcggttaccacggtaccgtaacggtacccgttaaacccgaaccggttccgggacccgttaccgttacccggttaccgggtttccggggaccggggtaacggggtaacccgtaggggttaacgggaagtaaccgtacggaaaaccgtaaccgggttcgggtacgggtaccgtacggtaacccgtaaccgttacgtttccggttcgtttacccgtttaccgttaccgtttccccggttaaccccg

SEQ ID NO: 188355 - DNA, 749 bp, Homo sapiens
  misc_feature: GYAE6OF02HWOB4.40.23.C01.1.454.CMB.1.raw
  modified_base (199)..(199): a, c, t, g, unknown or other
  misc_feature (199)..(199): n is a, c, g, or t
  modified_base (470)..(470): a, c, t, g, unknown or other
  misc_feature (470)..(470): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccagccacctgtctttgtctcgagggaancgccacctctcgtgacgacggccagtcaggtacgttacttagacctaacttacttagtcgtacggtaacccaacgaacgaaaccgttcggccgttacggcctaccccgaggtcccttcccctacaacttccttaagtcggtaattcgactacgtacccgaggaccggaccgggccctaacggtcggacctaccgtcccgagtcccgtaggttcagggttcggcgtagggtggtacgacgggaactagttacctcaccttctaccaaccgtntaccgacggccgtaccgtagacgtaccgtaggtaacgttactttcgactttaaggtttacttacgttgtacgtacgacgtaacgtacccgtaaccgaacggtccggtacccgtaccgttaccgtttaccgggtttaccgggaccggggttaacgggtaacccggtaaggggtcgggaacgtaccgtaaccgtaaaccgggtacggttccgggtacggtacgtacccgtaccgtaccgtacgttccgttacggttacctttaccgttaccttacccccgg

SEQ ID NO: 188356 - DNA, 749 bp, Homo sapiens
  misc_feature: GYAE6OF02INGNN.40.23.C01.1.454.CMB.1.raw
  modified_base (204)..(204): a, c, t, g, unknown or other
  misc_feature (204)..(204): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccgagggaaagngccaccctctcctgcagggccagtcagagtcttagcaactacttagtctggtaccaacagaaacctggaccaggcctcccgaggctcctcatctatgatgcacgtccagcagggccacgtggacacgtcccaacgcctaggttacaggttggacctaggtcgggtcgtagggaactacggtactttacgaacttcctaccaaccgactaccgacggaccggtacccgtaaaggaccgtaccgtaaggtaaacgttacctttaggacctttaagtttttaacttacgttacggtacgtaacgtacctaaacggtacccgttaaaccaacggttacggacccgttaccttaacccgttaaccgggtttttcccggggaaccgggtaaaccgggggttaaaccctaaaacgggggttacgggaacgttaacgttaaccgtaaaaccgggttaaccgttagggttaccggttcccgtaacggacccttaaacccggtacgttttacccgttacggttttaaccttaccccgttaacgtttaccccccgg

SEQ ID NO: 188357 - DNA, 571 bp, Homo sapiens
  misc_feature: GYAE6OF02I64DJ.40.23.C01.1.454.CMB.1.raw
  modified_base (202)..(202): a, c, t, g, unknown or other
  misc_feature (202)..(202): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaanagccaccctctcctgcagggccagtcagagtcttagcaactacttagtctggtaccaacacgaaacctggccaggctcccaggcctcctcatctatgatgcatccagcgacgggccacgtcggcactcccagccaggttcaggtgcaggtgggtcngggacngacttcactctcaccatcagccgctacgacgctcgatcttgctagttntactgtcagcacgctacactcggccgctaccgtcgtttcgggacggtacgggaaccgtaggacggagtaacgtacgaaaccggtaacgttcggtacggtccgtacggtacctacccgtagttccgtacgttacctttccgtacgtttcccgttaccccg

SEQ ID NO: 188358 - DNA, 582 bp, Homo sapiens
  misc_feature: GYAE6OF02GA8DS.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtcttagcaacttacttagtctaggtaaccaacagaaacctggaccaggcctcccgaggcctcctcatctatgatgcatccagcgagggccacgtggcactcccagcctaggtcagtcgctaggtgggtctgggactacgtacttcactctacaccactcgagccgtactaggacgtcctagtaacgtactttgacgtagttttatcgtgtacagtccagtaccctaaccacgtcggcctacgtccgttacggttcgggacgggtaaccggacgtaagggtcggtaagagtaccgaaacgtacgtcggtcgacgtcgaccacgtacgtccgttctacgttcctcgttacccg

SEQ ID NO: 188359 - DNA, 622 bp, Homo sapiens
  misc_feature: GYAE6OF02F7N50.40.23.C01.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (409)..(409): a, c, t, g, unknown or other
  misc_feature (409)..(409): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaangccaccctctctgcagggccagtcagagtcttagcaactacttagtctggtaccaanagaaacctggccaggcctaccgagcctcctcatctatgatgcatccgagcgagggccagtggacactcccgagccgtaggttcaggtcggcgtaggtcgggtcgtgggactacgtacttcgactctaccacatcgagtccgactagacncgtagtaagtcttgacttagtttactacgttgtacagtacgacgtccgtaacctacggtcggcctacttaccgttaccggttccgggacgggtaaccgggaaccgtaagggtacggagtaacgtacggtaaacgtacggttagggtccggacgttaccgacctaaccgttacgttcgttaccgttacctttacgtaccttccccgttaccccg

SEQ ID NO: 188360 - DNA, 646 bp, Homo sapiens
  misc_feature: GYAE6OF02HZKPO.40.23.C01.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccagcccaccctgtctttgtctccaggggaaangccaccctctcctgcagggccagtcagagtcttagcaactacttagtctggtaaccaanagaaacctggaccaggcctcccgaggcctcctcatctatgatcgcactccaaggccgaagggcctacgtcggcctaacgtccccgaaggtccccgtaggggttccggacggtaccgtagggttccggggtcgtagggggaacctacggtacctttacgaccttccgtacgaccctagtccgacggtcccggtaccgtacgacgtccgtagtaacgtacgtttacgtacgttagttttacttacgttcgtacgtagcgacgtaccgtaaccgaaccgtcgccgtcctaccgtacgttcgggacggtacgggacgaaggtacgagactacgaacgtacgtggacgtcgtacgacactactcgttcgttcttactactccgttaccg

SEQ ID NO: 188361 - DNA, 656 bp, Homo sapiens
  misc_feature: GYAE6OF02GWBR5.40.23.C01.1.454.CMB.1.raw
  modified_base (206)..(206): a, c, t, g, unknown or other
  misc_feature (206)..(206): n is a, c, g, or t
tcagtctagcgactcacgaccggtgctcgatttagtacacgtgattagggattggggggaggaactgctcagttaggacccagagggaaccatggaagccccagctcagcttctcttcctcctgctactctggctcccagataccaccggagaaattgtgttgacacagtctccagccaccctgtctttgtctccgaaggggaaanacgccaccctctcctgcgagggccagtcagagtcttagcaacttacttagtctaggtaaccaacagaaaccgtggaccaggcctccgaggcctcctcatctatgatgctatccgagcgacgggccacgtcggacactcccgagtacccgtaggttcaggtcggactaggggtcgggtaccgtagggaactagttaccttaccgacttccaccaacctacgtcgacggccggtacctaggacgtacgtaggaaacgttcgttagacttaagttttaacttcgttacgtacgtacgacgtacgtaccgtaaccgacgtcggcccgtcttaccgtacggttccgggaccggtaacgggaacgtagggtagaacgtacgtaacgaaaccggtagttcgggtacggtactacggacctacgtacttccgttacgttaccttaccaccgttccccg

SEQ ID NO: 188362 - DNA, 714 bp, Homo sapiens
  misc_feature: GYAE6OF02HJT6G.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccaggggaaanagccaccctctcctgcagggccagtcagtagtcttagacaactacttagtctggtaccaacagaaacctggaccaggctccgaggctcctcatctatgatcgacactccgagcgaagggccagtcggcactcccgagcctaggttcaggtcggcaggttgggtctaggggactaggacctttcactcgtaccactactccgaggccggtacctaggtacgccgttagaacgttacgtttgacgttaagtttactacgtagtaccgtagaccgtacggaacccgttacctaaaccggttcggacccgttacccgtaccgtttaaccggtttccggggaccgggtaaaccggggtacccgtaaaggggtccgggaaacgttaacgtaaccccgtaaaagggtacccttcggggtaccggtaacccttaccgggaacccgttaacccgttaccgtttacccgttaacgggtttacccccttttaagtacccccgttttccccggttaaccccccg

SEQ ID NO: 188363 - DNA, 630 bp, Homo sapiens
  misc_feature: GYAE6OF02FENJW.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtcttagcaactacttagtctggtaccaacagaaacctggccaggcctccaggcctcctcatctatgatgcatccagcgagggccactggcactcccagcccaggttccagtcggcaggtgggtctggggacacggtacttcaccgttctccacctatcgacgtccggacctagacgtccctaggaacgtacgttttgacttagtttacttactgtaccaggacacgtaccgtaaccaacgtccggccgtaccttccgtaccgtttcgggaccgggtaacggtaaccggtaagggtacgggaacgtacgtaaccgtaaacggtaaacttcgggtacggtaccgttacggacccgtaaccgtacgttccgttacgttacccgttactaaccgtttcccccg

SEQ ID NO: 188364 - DNA, 741 bp, Homo sapiens
  misc_feature: GYAE6OF02I26F8.40.23.C01.1.454.CMB.1.raw
  modified_base (206)..(206): a, c, t, g, unknown or other
  misc_feature (206)..(206): n is a, c, g, or t
  modified_base (273)..(273): a, c, t, g, unknown or other
  misc_feature (273)..(273): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagatacccaccggagaaattgtgtttacacagtctccagccaccctgttctttgtctccgaggggaaanagccaccctctcctgcagggccagtcagagtctagctaactacttagtctgtaccaacacgaaccgngccaggctcccagcctcctcatctatgactgctacgtccagcgacgggccacgtcggaccactcccgacgtccgtaacggttacgacggtggcgagggttcgggtacgtacgggacgtaacgtaccttacgtactacctacacctacgtacgaccggtaccggtaccgtaaggaccgtacgtacggtaacgttaccgtttacgtaaccgtttaaggttttaacctacggtttacggtaccgtaagtaccgtaacgtaacccgttaaccccgtaaccggtacggtcccgtaccttaccccggttaccgggtttaccggggaaccggggttaacggtaaccgggtaaagggttaaccgggaagttaaccgtaaccgtaaaaccggtaacggttacgggtaccggttagtaccgtaacctaccgttacgttaccgttccgtttacttacttaccgttccccgtttaccccg

SEQ ID NO: 188365 - DNA, 656 bp, Homo sapiens
  misc_feature: GYAE6OF02IUVLD.40.23.C01.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
  modified_base (464)..(464): a, c, t, g, unknown or other
  misc_feature (464)..(464): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctntcctgcagggccagtcagngtcttagcaactacttagtctaggtaccaanagaaacctggaccaggctcccaggcctccgtacatcgtatgatcgcactccagcaggccacgtggacactcccagccaggttcagtggcaggtcgggtntacgggacagtacgttcaacgtctacaaccgtntacgaggaccggtcctaaggacgtcccgttaggaaacgttcttttacggacttaaggttttacttacggtntaccgtaagtccgtaacgtaccggttaaaccaggtccggtacccgtacgttaccgttacggtttccgggaacgggaacggggttaacccaaagggggttcgaacgtaacgttaaccgaaacggtaacgttgggtacggtcctaacgaccgtaaccttcggtacgtttccggtacctttcaaccgtttccccg

SEQ ID NO: 188366 - DNA, 525 bp, Homo sapiens
  misc_feature: GYAE6OF02GVVU1.40.23.C01.1.454.CMB.1.raw
  modified_base (203)..(203): a, c, t, g, unknown or other
  misc_feature (203)..(203): n is a, c, g, or t
  modified_base (488)..(488): a, c, t, g, unknown or other
  misc_feature (488)..(488): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtcttagcaactacttagtctggtaccaacagaaacctggaccaggctcccaggctcctcatctatgatgcatccagcagggccactggcactcccagccaggttcagtggcaggtggtctgggacagacttcactctcacatcagcgctagcgctgaacgtacttgactagtttattacttgtcagcagtccgtaaccacgtcggaccgtctcgtacgtttcgggcggacggacgaggtgagtatacgaacggtntagcggctcgacacgtatcctagtcttacacttcccg

SEQ ID NO: 188367 - DNA, 669 bp, Homo sapiens
  misc_feature: GYAE6OF02G9RQU.40.23.C01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttttacacagtctccagccaccctgtctttgctccaggggaaangccaccctctcctgcagggccagtcagagtcttagcaactacttagtctggtaccaanagaaacctggccaggcctcccaggcctcctcatctagtnatgcatccagcgagggcctacgtgggccactccccagtccctagggttacaggtcggactgggttcggggtctcggggacagtaccttcattcctacaccgatcgacgtccggtacctagacgtaccgtgtaaacggttctttagaccttaaggtttttaactacgttcggttacacgttacgaacggtcccgttaaaccaaccgttcgggccctacttcccgtaacggttttccgggaaccgggaacgggttaaccggaggttacgggaacgtaataccggtaaaaccgtacggtcggttacggccttacggacctaaccctgttccggttaacgtttacctttaccgtactttccccggttaccccg

SEQ ID NO: 188368 - DNA, 511 bp, Homo sapiens
  misc_feature: GYAE6OF02FO8K3.40.23.C01.1.454.CMB.1.raw
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcgctagagcctgaagtactttgctagtttattacttgtcagcagcgtaccactggccgctctactttcggcggaggaccgaaggtcgagatacgaacgaacgtgtcggctacgcaccatctgtcttcattcccg

SEQ ID NO: 188369 - DNA, 757 bp, Homo sapiens
  misc_feature: GYAE6OF02I0W9C.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaancgccaccctctcctgcagggccagtcagacgttcttagcaactacttagtctaggtaccaacagaaacctggaccaggcctacccgaggcctcctcatcctatgatcgcatccagcaggcctacgtgcactcccagcctaggttcaggtggactaggtcgggtcgtacgggactacggtactttacgaacttcctaccgaacctacgttacgaacgggcccggtaaccgtaaggaccggtcccgttaaggtaaacgtaccgttttacggaaccgttaaggtttttaaccgttacgttccggtacgtacggtaccgtaacggtacccgttaaaccctaaccggtcgggttaccccgtacttccgttaacccggtttaccggggacccggggtaaacgggtaaccccggtaaagggggttccgggtaaacggtaacgtttaacccggaaaacggttaaccggtttcggggtaaaccggtcccgttaccggtaacccgaacccgttaacgttccggtttaacgttaccccgttttaccgacccgttttaccccccgg

SEQ ID NO: 188370 - DNA, 816 bp, Homo sapiens
  misc_feature: GYAE6OF02HEEGM.40.23.C01.1.454.CMB.1.raw
  modified_base (203)..(203): a, c, t, g, unknown or other
  misc_feature (203)..(203): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctcccagataccaccggagaaattgtgttgacacagtctcagccaccctgtctttgtctccaggggaaanagccaccctctcctgcagggccagtcagagtcttagcaactacttagtctaggtaaccaaacgacgaaaaccttggacccaaggcccttaccccgaaggcccttacccctacgtaactaccgttaatggtaacttcggacctaacgttccccgaaggtccgaacgggggaccccaacgttacgggacctaaccgttccccgaaacggtccccgtaacgggttttcaacgggttcggaccgtaagggtttcgggggttacgttacggggaactaacggtaaccttttacgaacccgttcctaccgaaaccctaggttaccgaacggtaccggtaccctaacggaaccgttacccgtaagggtaaacgttacgttttacggaccgttaaggtttttaactttaaccggttcgttaccgacgtaccgaacggtaccgttaaaccgacgttcgggacccgtacttaccgtaccgtttaccggggacggtaaccgggtaccgaaaggggttacggaaccgtacgttaaccgaaaaccggttaacgttacggtacggtacgttacgacccgttaaccgtacgtttccgttacggtttaccttaccgtacctttacccgg

SEQ ID NO: 188371 - DNA, 673 bp, Homo sapiens
  misc_feature: GYAE6OF02JWLF6.40.23.C01.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcacgggccagtcagagtcttacgcaactactagtcaggtaccaacagaacctggaccaggcctccgaggcctcctcactctatagactgctaatccgagtcgacgggaccncgtcggacactacccgacgtccgacggtcacggtcgcgtaggtcgggttccngggtacaggtaccttacnctacgtccacgtactccgtaacggccggacccgtacgacgaccggttagaacgttaccgtttacggtaccgtttacgtttaactttcggttacgtacgtacgtaccgtacgtaaccgtccgtaaacggttccggccgtacccgtcgttaccgggttccgggacgggaacgggtaccgaagggtcgggaactacgttaacggaacgtaaccgttaggtacggccggttacgacgtaccgacgttacgttacggtaccgttacgtaccgttccccgg

SEQ ID NO: 188372 - DNA, 698 bp, Homo sapiens
  misc_feature: GYAE6OF02IRDFS.40.23.C01.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagtctagcgactcacgaccggtgctcgatttagtacacgtgattagggattgggggagggaactgctcagttaggacccagagggaaccatggaagccccagctcagcttctcttcctcctgctactctggctcccagatacccaccggagaaattgtgtttacacagtctccagcccaccctgtctttgtctccgaggggaaancgccaccctctcctgcagggccagtcagngtcttagcaacttacttgtctggtaccaatagaacctggaccaggcctcccgaggcctccncatctangatgcactccgagcacggccctagtggacactccgagcctaggttcaggttcgacgtgggttcggggtcgtaggggacaacggtacctttccgaacgtttcctacccgacctatccggacggtacccgggtacctacggacggtccgtacggtaaacgttactttacggaccgttagttttaacttcgtacggttacctacgttcgaacggtaccgtaaccgtaacggtccggcccggtacctccgttacggtttaccgggaccgggtaacggtaacccgaagggtacgggacgtaaccgtaaccgaaacgggtaccgtcgggtacggtacgttaccggaccgtaaccgtcgttacgttaccggttactttacccgtactttcccgttaccccg

SEQ ID NO: 188373 - DNA, 623 bp, Homo sapiens
  misc_feature: GYAE6OF02G9BZ2.40.23.C01.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtcttagctaaactacttagtctaggtaccaacaagaaacctggaccaaggcctcccaggcctcctcatctangatgcatccagccacgggccacgtcggcactcccgagcctaaggttcgaagtcggacgtaggtgggtctagggacaggtacttcgactccgtacacctancgtacgccgcgtagacgacctagtaaacgtcgttagacttaacgtttagttacgttacgtacgtacgacgtacgtaccgttaaccaacgtcgacccgtcttacggtaccgtttacgggcgggtaacgggaaccgtaagggtacggaataacgtacgaaaacgtaacggtacggtaggtactagaccgtacctagtctttctacgttactccgttacccg

SEQ ID NO: 188374 - DNA, 717 bp, Homo sapiens
  misc_feature: GYAE6OF02GHG88.40.23.C01.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccgagggaaagngccaccctctcctgcagggccagtcagagtcttagcaaactacttagtctggtaccaanacgaacctggccaggcctccaggcctcctcatctatgatgacactcccgagccgagggccacgtggaccactcccgagtcccgtaagggtttccaagggttggacgtacggggttcggggttacgtacgggggaactacggtaaccttttccgaaccgttcctaccaccctaagttcccggaacggtccggtacccgtacggaaccggtacccgtaaggtaacggttaccttttggtaccgttaacggtttttaacttaccgttgttaaccgtagtacctacggtaacccgtaaccgtacggtaccgcccgtaccttaccgttccggtttaccgggacgggtaacgggtaaccgaaggggtgaacgtacgaacgtaacggtacgtcgggttcgaccgttccggacctaccgtacgttccgttacgttccgttacttccgttacccttacccccg

SEQ ID NO: 188375 - DNA, 858 bp, Homo sapiens
  misc_feature: GYAE6OF02H4BYF.40.23.C01.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagtctagcgactcacgaccggtgctcgatttagtacacgtgattagggagttgggggaggaactgctcagttaggacccagagggaaccatggaagccccagctcagcttctcttcctcctgctactctggcctccagataccacgganaattgtgttacacagtctcagccacctgtactttgctccgaggggaacncgccaccctntccgtgccgagggccagtcaggtacgttcttagaccaacttacgttagtcttacgggtaaccaacgacggtaaacctgggaccctaagggtcctccccgagggtccttcccgtacacttaccgttagtagtacttacgacttaactccgaaggtccgaacggggaccctaagttcgggacctaacttccccgaagtcccgtaaggtttccgaaggttcggacgtaaggggttcgggtttaccgtacgggggaaccttaacgggtacctttaccgaaccgtttccgaacccgaaaccggtaatacccgggtaacgggcccgggttaacgtaaccggtccgtaacccgtttaaggtaaacgtttaccggttttacggtaaccgtttaacggttttaacttaacccgttggtaccgtaacggtacccgtaaggttaaccccgtaaccgaaaccggttcgggtacccgttaccgtaaccggtttacccgggtttaccgggggaacccgggttaaacgggtaaacccggtaaggggttaaccgtaagttaacccgtaaccggtaaacggttacggtcgggttaccgcgtaaccgttaccgaaaccgtcgttaccgttacgtacccgtttacctaccggtttccctaaccccgg

SEQ ID NO: 188376 - DNA, 665 bp, Homo sapiens
  misc_feature: GYAE6OF02H7PJD.40.23.C01.1.454.CMB.1.raw
  modified_base (209)..(209): a, c, t, g, unknown or other
  misc_feature (209)..(209): n is a, c, g, or t
  modified_base (552)..(552): a, c, t, g, unknown or other
  misc_feature (552)..(552): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctcccagataccaccggagaaattgtgttgacacagtcctccagcccaccctgtctttgtcctaccgaggggaagngccctaccctctcctcgcgacgggccagtcagacgtcttagactaactacgttagtcgtaggtaaccaaacgaacgtaaccgtcggaccgacggcctaccgacggtccctccgtactactcctagtgtatcgctacgtccgagaccgcggtccacgtcgcctacacccgtacggccgtaggtacgacggtacggtcgtaacgggtcggtgttacggaagtacgcttccacgttcctaccgtcctaagtccgtacgccggtactaggaccgtacgtacgacgttagttcgtacgttagtttacctagtcgtagactcgacgtacctacgtaccgtcggcccgtntacccgtacggtaccgggaccggtaggtaccgtaggacggacgtaacgacgtaacgtaacggtcgtacgaccgtcgacgtacctacgtcgttaccgtcgttactccttacccg

SEQ ID NO: 188377 - DNA, 616 bp, Homo sapiens
  misc_feature: GYAE6OF02FXRTF.40.23.C01.1.454.CMB.1.raw
  modified_base (204)..(204): a, c, t, g, unknown or other
  misc_feature (204)..(204): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (543)..(543): a, c, t, g, unknown or other
  misc_feature (543)..(543): n is a, c, g, or t
  modified_base (583)..(583): a, c, t, g, unknown or other
  misc_feature (583)..(583): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgtctccaggggaaagngccaccctctcctgcagggccaagtccaggacgttacttagctaaactacttagtctgggtaacccaaacgacgaaaacccttggaccaacggctaccccgaggcctccctcacttctatgaatgcatccagcgacgggccacgtggacactcccagcctaggttcaggtggcaggtgggtctgggacagtactcactcncacntcagcgacctagactacagaactcgtttgacttagtttaatacgtgtcagcgtaagccgtaacctaacggttccggaccgtcgttacctaccggtttcgggacgggtaacgggtaaccgtaaggtaggaacgtanaccgaaaacgtacgtcgggtacgcctaggacccaaccgtnttaccgtacgttcttactaccgttccgtacccg

SEQ ID NO: 188378 - DNA, 750 bp, Homo sapiens
  misc_feature: GYAE6OF02JKMMA.40.23.C01.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagtctagcgactcacgaccggtgctcgatttagtacacgtgattagggattgggggaggaacgtgctcagttaggacccagagggaaccatggaagccccagctcagcttctcttcctcctgctactctggctcccagataccaccggagaaacttgtgttgacacagtctccagccaccctgtctttgtctccgaggggaanacgccaccctntcctgcagggccagtcagagtcttagctaactcgttacgtctggtaaccaacaacgaaccttacggtacccaggacctacccgaggcccgttacctctactcgtactcgtaactggtacctatccccaaggccgaacgggacccgtaccgtcgggacctaaccgtcccgacgtccccggtaaggttccgaacggtcggccgtaagggtttcggggtaccttagggggaacctaacgggccttttaccgaccgttcctaccgaaccctgttacccaggtacccggtaccttacggacgtacccgttaggaacgtaccgtttgtacgttactttacgttacgttcgttccgaaggtccgtagacccgttaacgaccggttcggacccgttctaccgttaaccggtttccgggaccgggttacggtaaaccgaaggggttacgaaccgacggttaaccgaacccgtaacggttcggtaacggtccgtacgtaccgaaccgttctacccggtttagttcccgtagtaccgtttccccg

SEQ ID NO: 188379 - DNA, 654 bp, Homo sapiens
  misc_feature: GYAE6OF02HMEI8.40.23.C01.1.454.CMB.1.raw
  modified_base (635)..(635): a, c, t, g, unknown or other
  misc_feature (635)..(635): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccagccaccctgtctttgtctccgaaggggaagacgccaccctctcctcgcgacggccagtcgagagtcttagctaacttacttagtctacggtaccaacgtacgaaacctcggaccaggcctacccgaacggcctacctacattcgtaatgactgacctatccgagccgagggtccacgtcggacacgtcccgacgaccgtacggttcgacgggtggaccgtagggttcgggtggtacgggacgtacgtaccttccgtaaccttccgtaccaacctactcccgagaccggacccttaggacgtaccgtagtaacgtacgtttcgagttacgtttacttacgttgtacgaggtaccgagtacctaaccgtacgtccgccgtactcgttaccgttcgggcgggtaacgacgaagggtcgacgagtaacgaacgtcgtagcggtacgtacgacgacgtacgtccgtntaccgttacacgttacccg

SEQ ID NO: 188380 - DNA, 817 bp, Homo sapiens
  misc_feature: GYAE6OF02IEQ9P.40.23.C01.1.454.CMB.1.raw
  modified_base (205)..(205): a, c, t, g, unknown or other
  misc_feature (205)..(205): n is a, c, g, or t
tcagtctagcgactcacgaccggtgctcgatttagtacacgtgattagggagttgggggaggaactgctcagttaggacccagagggaaccatggaagccccagctcagcttctcttctcctgctactctggcctccagataccaccggagaattgtgttgacacagtctccagccctaccctgtctttgtctccgaaggggaancgcccaccctctctgctagggccagtcagtatcttagcaacttacttagtcgtacggtaaccaaacgtacgaaacccttcgggaccaacgggtccctacccggtaggcccttacccttacaacttccgttaattcggattacggacctaacttaccccgaagggtaccgtaccggggacccctaacgggtttccgggaccttaccccgtaccccggtaacgggtccccttaagggtttccgaaccgggtttggggcccttaagggggttccccggggttacggtcggggtaaaacctacgggttacttcccgaaaccgttccttaaccgaaccgtagtacccgaacgggtcccggtaaccgttaaggtaccggtaaccgtagtaaacggtttaccgtttacgtacgtttaacggttttaacttcggttacgttaccggacgtaccgtaacgtccgaaaccgtcggttaccggactccgtaccgtcggttacgggaccggtacgggtaaccgtaagggtacgtacgtaacgttaaccgaaacggttccgtaaggtcggtactcggtaaccgtactacggttaccttcgtaccgttaccgtaaccgttccccgg

SEQ ID NO: 188381 - DNA, 650 bp, Homo sapiens
  misc_feature: GYAE6OF02JH3DJ.40.23.C01.1.454.CMB.1.raw
  modified_base (202)..(202): a, c, t, g, unknown or other
  misc_feature (202)..(202): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagccaccctgtctttgctccaggggaaangcccaccctctcctgcgacgggccagtcagagtcttagccaacttactagtctggtaaccaacagaacctggccaggcctcccgaggtcctccgtcatctatgactcgcactccgacgcgacgggcccagtcggcactcccgagccgtacggtcaggtcgacgtaggtgggtcgtagggaactgtacttcactcctaccgaacctacgtccgacggtccggtactaggacgtaccgtagtaacgtactttcgacgtttagtttacgttaccgtcgtacgtacgtacgccgtaaccgtaaccacggttccggccgtaccttccgtacggtttccggggacgggtaacgggtaccgtagggtaccgggagtaaccgtacgaaacggtagtcgggtacgcgtacgaccgttactacgttcggttaccgtacttccgtacttcccgtacccg

SEQ ID NO: 188382 - DNA, 791 bp, Homo sapiens
  misc_feature: GYAE6OF02I4W9O.40.23.C01.1.454.CMB.1.raw
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (766)..(766): a, c, t, g, unknown or other
  misc_feature (766)..(766): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccgganaaattgtgttagacacagtctaccagccaccctgtcttgtctccgaaggggaangcccaccctctcctgccgagggccagtccagtacgtcttaacgacgtaaccttacgttagtcgttacggtaaccctaaaacaacggtaaacccctggtacccgaacggtccctccccgtaaagggtcccttaccccttacgaacttaccgttacgtaggtaaccgttagtacccctaaccgtaccgaggacccggtacggggacctaaaccggtcggaaccctaacgttccccgaaacgggtaccctacgggttccgtaagggtccggaccgtaaggggtttcgggttacggtacggggtaacgtaccggtactttcccgaaccgttccctaaccgaccctaatccgccggtccggtacctaacggcgttaccgtagtaaccggtttcgttacggtacgtttaagtttacgttaccgttacgtaccgacgttaacgtacgaaacccggtaccaacggtttacgggccctacttacggttaccggtacgggaccggtaacgggacggttagaccgggtaatacgaaccgtaacggtcgtaggcgtacgtacgactactacgtntacgtttacctcggtaaccttcccg

SEQ ID NO: 188383 - DNA, 695 bp, Homo sapiens
  misc_feature: GYAE6OF02G83UQ.40.23.C01.1.454.CMB.1.raw
  modified_base (686)..(686): a, c, t, g, unknown or other
  misc_feature (686)..(686): n is a, c, g, or t
tcagtctagcgactcacgaccggtgctcgatttagtacacgtgattagggattgggggaggaactgctcagttaggacccagagggaaccatggaagcccagctcagcttctcttcctcctgctactctggctccagataccaccggagaaattgtgttgacacagtctcagccaccctgtcttgtctaccgaggggaaagagccacctctcctgcgagggccagtcaggtagtcttagcaacttattagtctaggtaccaaacagaaacctggaccaggtcctaccgaggtcctactcactactatgactgctactccgaagccgaacgggtcccaacgcggacactacccgacgaccgtaggtcgaggtcggacgtagggtggtcggtgggaacgtagtacgttcaaccttcacgacctagtccgaggccggacgtacgacggtcctaggtaacgttacttggtaccgttaagtttacttacgttacgtacgtacgtaccgacgtaccggtaacccaaggtttcccggaacccttccgttacccgtaccggttttaccggggacggtaaacccggggtaacgtaacggggttacggaacggtaactaccggtaaacgggtaaacgtgggttacggtacccggacgtaaccgtaaccctaatccggttaacttcccgttaccgtnttacccccg

SEQ ID NO: 188384 - DNA, 584 bp, Homo sapiens
  misc_feature: GYAE6OF02GIUMH.40.23.C01.1.454.CMB.1.raw
  modified_base (205)..(205): a, c, t, g, unknown or other
  misc_feature (205)..(205): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgtttacacagtctccagcccaccctgtctttgtctccgaggggaaancgccaccctctcctgcagggccagtcagagtcttagccaacttacttagtctaggtacccaagacgaaacctggaccaggcctcccaggcctcctcatctatgatgcatccgagcgagggccacgtggccactcccagcctaggttcaggtggctaggtcgggtctgggacagtacttcactctacaccntcagcgctagcncgagtaagtcttgacttagtttatacgtgtcagtcgacgtcgtaccaacgtcgccgtctcgtacgtttcgggacggtacggaacgtacggtaggactacgtacgaaaccggtagtcggtacggacgttacgacctacggtacttcgttcgttccttacctaccgttccgttaccccg

SEQ ID NO: 188385 - DNA, 644 bp, Homo sapiens
  misc_feature: GYAE6OF02FQ4YZ.40.23.C01.1.454.CMB.1.raw
  modified_base (207)..(207): a, c, t, g, unknown or other
  misc_feature (207)..(207): n is a, c, g, or t
tcagtctagcgactcacgaccggtgctcgatttagtacacgtgattagggattggggggaggaactgctcagttaggacccagagggaaccatggaagccccagctcagcttctcttcctcctgctactctggctcccagatacccaccggagaaattgtgtttacacagtctccagcccaccctgtcttgtcctccgaggggaaangccaccctctcctgcagggccagtcagagtcttagcaactacttagtctaggtacccaacagaaacctggccaggcctcccaggcctcctcatctatgatgactatccagcgacgggccagtcggcactcccgagccgtaggttcaggtcggcgtaggtcgggtcgtagggacaggtacgtttcactctacaccgactccgacgccgacctagacgcctaggaacttacgtttggacttagttttactagttcgttacgagccgtacgtaccgtaccgtaacgtcggtacccgtcgttaccgtacgtttccggggacggtaacggggacccgtaaagggcgtaacggtactaaccggaaacggtacgtagggtaccggtaccggtacgtacctaccgtacgttccgttcgttaccttccgtacttcccgttaccccg

SEQ ID NO: 188386 - DNA, 781 bp, Homo sapiens
  misc_feature: GYAE6OF02H6GJL.40.23.C01.1.454.CMB.1.raw
  modified_base (205)..(205): a, c, t, g, unknown or other
  misc_feature (205)..(205): n is a, c, g, or t
  modified_base (718)..(718): a, c, t, g, unknown or other
  misc_feature (718)..(718): n is a, c, g, or t
  modified_base (754)..(754): a, c, t, g, unknown or other
  misc_feature (754)..(754): n is a, c, g, or t
tcagtctagcgactcacgaccggtgctcgatttagtacacgtgattagggattgggggaggaactgctcagttaggacccagagggaccatggagccccagctcagcttctcttcctcctgctactctcggcctccagatacccgacggagaaacttgtgtttacacagtctccagcctaccgtgtctttgtctcgaaggggaanacgccaccctctcctgcacgggcctagtcgacgtcgttacttacgacctaacgttactttacggtaccttaacggtaaaccaacgtaacggtaaaacccgttcggaccgtaacggtacccgttaccccggaacggtccctaccgttacaaccttcttaaacgtcgtaacgtcgtaccctaacttaccggaacggtaccggaaccggggtccctaacggtacgggaccctaaccgtaccccgtacggtaccgttacggggtactacggggtcggtaccggtacggggttcgggtaccggtaggggtacctaaggttaccttccgtaaccttacccgtacgacccgtaacttaccgggaccgtaccggtaccgttaacggaccgttaccggttaagtaacgtttacggttaccgtagtttaacgttttagtaccgtgttaccgaaggttacgaccgttccgtaaccacggttccgcgttcctcgttacgtcgggacggacgtaacggacggtagngtaacgactaacggcgttaggcggtactcacgtacngttcttcggtactacttcgtcctacgg

SEQ ID NO: 188387 - DNA, 787 bp, Homo sapiens
  misc_feature: GYAE6OF02G6HVP.40.23.C01.1.454.CMB.1.raw
  modified_base (205)..(205): a, c, t, g, unknown or other
  misc_feature (205)..(205): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggcctcccagataccaccggagaaattgtgttgacacagtctccagccaccctgtctttgtctccgaggggaaangcccaccctctcctgccagggccagtcagatcttagcaactacttagtctggtaaccaacgacgtaaacccgtgggacccaagggccctaccccgaagggtcccttacccgtactaattaccgttaactcggtaattcggacctacgttaccccgaagggaccgtaaccgggggccccaacgtttcgggaccctaccttaccccgacggtaccccgtaagggtttccgaggttcgggaccgtaggggttcgggttaccgtagggggaacctacgggtaacctttccgaacccttccgtacccaaaccctagtcccgacgggtacccggtacccgtaacgacggtacccgttaagggaacgttacgtttcgaacgtttaacgtttaacttacggttcgtaacgcggtaccacggtaccgtaacctacggtccggtacctacgtaccgtacggtttaccgggacggtaaccgggaacgtagggtaccggtaagacttaaccgggaaacgtacggttcggtacggtacccgtcgaaccgtacctacgttaccggtttacgtaccgtttccgtaaccgtttccccg

SEQ ID NO: 188388 - DNA, 874 bp, Homo sapiens
  misc_feature: GYAE6OF02FJ1G0.40.23.C01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaaacttgtgttgacacagtctccagccaccctgtctttgtctccaaggggaaangccaccctntccngcagggccagtcagagtcttagacaacttacttagtctaggtaccaacagaaacctggaccaggcctcccaaggcctccgtactatccgtatcgatcgactagtccaagtcgaacgggcccgtacgtcggaccacgttacccgaagtccccgtaagggttaccgaaggtcgggtacctaacggggttcgggtcgttacggggaacgtacggtacccgttacgaaccttacccgttaccacccgtatacccggaacgggtacccgggtaccgttaacgggtaacgtacccggttaacggtaaacggttaccgttttacgggtaccgtttaaacggttttaaccgttttaaccgttacggttaccgtaaggttaacccggtaacgggtaaccccgttaaacccgtaaaccggttaccggggaccccgttaccgtttaacccgttaccgggttttaacccgggggtaccgggggtaaaccggggtaaacccggttaacgggggtttaacgggaaccgggtaaaccggttaacccgtaaaaacccggttaaccggttacggggttaacccggttccggtaaccggttaccccggaacgttaacccgtttacccggttaccggttttacccgtttaaccggttaccgtttttaccccccgg

SEQ ID NO: 188389 - DNA, 682 bp, Homo sapiens
  misc_feature: GYAE6OF02JZL7E.40.23.C01.1.454.CMB.1.raw
  modified_base (209)..(209): a, c, t, g, unknown or other
  misc_feature (209)..(209): n is a, c, g, or t
  modified_base (404)..(404): a, c, t, g, unknown or other
  misc_feature (404)..(404): n is a, c, g, or t
  modified_base (643)..(643): a, c, t, g, unknown or other
  misc_feature (643)..(643): n is a, c, g, or t
tcagtctagcgactcacgaccggtgctcgatttagtacacgtgattagggagttggggggaggaactgctcagttaggacccagagggaaccatggaagccccagctcagcttctcttcctcctgctactctggcctccagactaccaccggagaattgtgttgacacagtctaccagccctacctgtcctttgtcctcgaaggggaancgccgtaccctctccgtgcagggccagtcagtacgtacttacggacctaacttacttaggtactacggtaaccaacgtaacggaaaccttcgggacccgaggtccctacccgaggtccttaccctcgtactaccgtagtacgtaacgtcgtaccactacccgagacccggacgggtccctacgtcgaccgtaccnccgtacgccgtacgttcgacggcggtacgtagggtcggtacggtacggaactcgtaccgtctacccgtctaccgactacgtcgacggtccgacctagcgtacgttaacgaagttaccttggtaaccgttaattcgttaccgttgtaccgcgtaccacgtccctaacgcgtacccggcctacggtccgtagttccgggacgaacggtcggtagtagacgtacgtaaccgacggtgtcggntccgagtaccacgtcgtccttagtccctatacgttcccc

SEQ ID NO: 188390 - DNA, 735 bp, Homo sapiens
  misc_feature: GYAE6OF02FP8VQ.40.23.C01.1.454.CMB.1.raw
  modified_base (200)..(200): a, c, t, g, unknown or other
  misc_feature (200)..(200): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgtttacacagtctccagccacctgtcttgtctcgaggggaaangccaccctctcctgcagggccagtcagagtcttagcaactacttagtctggtaaccaacgacgaacctggccaggctcccgaggtcctcctcatctagtgatgcactccgagccgacggcctacgtcgcactcccgagccgtaggttcaggtcggacgtagggtcgggtcgtaggggactacggtaccttacgaccgtacctaccaacctacgtaccggaggtaccggtaccgtaagtccggtaccgttagaacggttaccgtttacggacgttaacgttttacgttacgtacggttaacgacgtaccgtaacggtccctaaaccgtaccgtccgggtccctaccgttacccgtaccggttttcccggggaaccgggtaaccgggtaacccggtaaagggtacgggtaaccgtaacggttaaccgaaaacggttaccggtacgggtacccggtaacgtacccgtacccgtaacccgttacgtttcccggtttaccggttacccgtttaccgtacccgtttacccccggttccccg

SEQ ID NO: 188391 - DNA, 631 bp, Homo sapiens
  misc_feature: GYAE6OF02IRYTP.40.23.C01.1.454.CMB.1.raw
  modified_base (201)..(201): a, c, t, g, unknown or other
  misc_feature (201)..(201): n is a, c, g, or t
  modified_base (353)..(353): a, c, t, g, unknown or other
  misc_feature (353)..(353): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccagccaccctgtctttgtctccaggggaanagccaccctctcctgcagggccagtcagagtcgttagccaacttacttagtctacggtaaccaacgacgtaaaacctggacccaggtccctcccgaggccttcccgtcgtacttctatgtatcgcactccagacgcggccacgtggcctacncccacgtccgtaggtcgaggtgcgaggtggtccgaggctaggcttacncgttcncacctagcacgccgaccgtacgaccgacgtagtacgttacgttcgacgtttagtttacgttacgtgtacgcgactacgtacctaaccgagccggtccttctaccggttcgttaccgggacgggtaaccggaacggtaaggtacggacgtacgtaaccgtaacggtaccttgggacgtcgtcgaccgtaaccgtcttaccgtactttcgttacctccgttccccg

SEQ ID NO: 188392 - DNA, 666 bp, Homo sapiens
  misc_feature: GYAE6OF02JMGQP.40.23.C01.1.454.CMB.1.raw
  modified_base (205)..(205): a, c, t, g, unknown or other
  misc_feature (205)..(205): n is a, c, g, or t
  modified_base (554)..(554): a, c, t, g, unknown or other
  misc_feature (554)..(554): n is a, c, g, or t
  modified_base (569)..(569): a, c, t, g, unknown or other
  misc_feature (569)..(569): n is a, c, g, or t
  modified_base (580)..(580): a, c, t, g, unknown or other
  misc_feature (580)..(580): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagactaccaccggagaaattggtgttgaacacagtctaccagcctacctgtcttgtctcgaggggaanacgccaccctctacctgcgtagggacctagtccgagtagttccttaggacctaactacttacgtcgtacgtaccaacgtacgaaaccgttggaccaggcctacccgtaggcctaccgtctacttactactgacttacggctactccgacggtacgcgggtacccctaggtacggacaccgttaccccgaaggtaccccggttaggttaaccgcggggttacggacgtaacgggggtttccgggtacggtagggactaaccggtacttaccacgtttccgaaccacctactacgggacgtccccgtattacggactcccggtaatacgttacgttgacttattactcgtntcagtcacggtcacncgttcgactcncgttcgcggacgacggtatagggtggtaactacaaggtaaccggtgagtcgagtcgacctagtcgtcttagtccctatccgtcccg

SEQ ID NO: 188393 - DNA, 797 bp, Homo sapiens
  misc_feature: GYAE6OF02JQ7LI.40.23.C01.1.454.CMB.1.raw
  modified_base (206)..(206): a, c, t, g, unknown or other
  misc_feature (206)..(206): n is a, c, g, or t
  modified_base (390)..(390): a, c, t, g, unknown or other
  misc_feature (390)..(390): n is a, c, g, or t
  modified_base (701)..(701): a, c, t, g, unknown or other
  misc_feature (701)..(701): n is a, c, g, or t
  modified_base (748)..(748): a, c, t, g, unknown or other
  misc_feature (748)..(748): n is a, c, g, or t
tcagtctagcgactcacgaccggtgctcgatttagtacacgtgattagggattgggggaggaactgctcagttaggacccagagggaaccatggaagccccagctcagcttctcttcctcctgctactctggctcccagataccaccggagaattgtgttgacacagtcctcacgccacctgtctttagtctaccgaggggaaacncgacccacccttctcctggaccgaggccagtacagtagttacttagacaaacgttaccttgtaccgtacggaaccaaacgtaacggaaaccctcggaccgaacggtcccctacccgtaaggccccttcctacgacttacgtagacggtacgtcggacactaccgaggtccggacgtacccgacncggacctacgtcccgaagccgtaacggttccgtaaggcggtacggtagggtttccggacggttacgggaacgttaaggttaccttacccgtacgtttaccacccggtaaatccggtaaccggtaccggggacgttaacccgaggttacccggtactaaccgggtaacgttacgttccgtacggttaatttacgttccgttagtaccgacgtaacttcggacccgttaacgcggttaccggccgtaccgttacgggtttacccgttcggggaaaccgggtaaccgggtacgggttaaacggacggggttaanacctaaacccggggttaactacgggtttcgccgggttacccgtaacncccgggtaactcgtttaaccgtaccgttttaccgctaacccgtttcccg

SEQ ID NO: 188394 - DNA, 748 bp, Homo sapiens
  misc_feature: GYAE6OF02J02XC.40.23.C01.1.454.CMB.1.raw
  modified_base (206)..(206): a, c, t, g, unknown or other
  misc_feature (206)..(206): n is a, c, g, or t
  modified_base (335)..(335): a, c, t, g, unknown or other
  misc_feature (335)..(335): n is a, c, g, or t
tcagtctagcgactcacgaccggtgctcgatttagtacacgtgattagggattgggggaggaactgctcagttaggacccagagggaaccatggaagccccagctcagcttctcttcctctgctactctggctccagactaccaccggagtaattgtgttgacacagtctccagccaccttgtctttgtctccgaaggggtaaacncgtcccaccctctccgtcggcacggggcctagtcaggtacgttcgttacgctaacttacttacggttcgtaggtaaccaacgtaacggtaaacctcggaccgaggcctaccgtagggtccctacctacncgttacttacgtcgtatacggccaccgtaccgagacgtaccgggcctaccgtcgggtaccaccgtaccgacgtcgtaacgtccgtaacgggtcggtcgtacgggttcgggtccggtacggggtactaacgggttaccttaccgttaccgtacgttaccacccgtaagtcccgtacggggtaccggtaccgtaacggtaccggtcccgttaaaggtacgttacccgttttaacggtacctttacgggtttacttacgttacggtacccgagtaccgtacgtaccgtaactacgtcgtacctccgttagtaccgttacggacggtaacgggtacgaacgggttagaaccgtagtaacgaaccgtaggttcgtacggcttacgacacgttacgtacctcgtacttcgtactccccg

SEQ ID NO: 188395 - DNA, 741 bp, Homo sapiens
  misc_feature: GYAE6OF02IQUIV.40.23.C01.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (578)..(578): a, c, t, g, unknown or other
  misc_feature (578)..(578): n is a, c, g, or t
tcagtctagcgactcacgaccggtgctcgatttagtacacgtgattagggattgggggaggaactgctcagttaggacccagagggaaccatggaacgccccagctcagcttctcttcctcctgctactctggctaccagactaccaccggagaattgtgtttacacacgtctccagcccaccttgtctttagtctaccgaaggggaancgcccacctcgtccgtagacgacgggcctagtaccgagtacgtcttagcctaaacttactttagcgttacgtaccaanacgaaactcgacgagcctccaggtcctccgctacgtcctaagtgactcgcacgtccgagccgtacggccacgtcggaccactacccgagccgttcggtaagcggttcgcggttaaggtcgggtacgttacggggtaacacgttacgtttaccctaccgttactacccgaaccgttacgacggtaccggaccggttaacctcgggtacttaaccggtagtacgtacgttacgttacgttaagttttacgtactcggttaccgtacggactaccggtacccgtaatccccggntacccgggttactcggtttacccggttaccgggacgggttaaccgggaccgttaaagggtcgtaacggaacctttaagaacccggttggtaaccggttcggaccgtaacgtaccgtacggttacttacggttacgttccttaccggtactttcccgtaaccgg

SEQ ID NO: 188396 - DNA, 782 bp, Homo sapiens
  misc_feature: GYAE6OF02IURZ2.40.23.C01.1.454.CMB.1.raw
  modified_base (164)..(164): a, c, t, g, unknown or other
  misc_feature (164)..(164): n is a, c, g, or t
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (486)..(486): a, c, t, g, unknown or other
  misc_feature (486)..(486): n is a, c, g, or t
tcagtctagcgactcacgaccggtgctcgatttagtacacgtgattagggattgggggaggaactgctcagttaggacccagagggaaccatggaagccccagcctcagcttctcttcctcctgctacgtctggcctccagactaccgacggagaattgtgttnacgacagtctccagccctacctgtcttagtcctcgaagggaanacgcccacccgtctccgtgcgacggccngtcaggtacgttactacgaccaacttcgtagtcgtaggtaaccaacgagtaaccgtcggaccacggtaccctcccggaacggtcctccgtactagtccgtacgtagtactagaccttacgtaccgaggtccggaaccggtccaacgtcgggacctaccccgacgtaaccggccgttaagttaccgacgttcggtcgtaagggtttcggcggtaacgggacttacggaccttacgtaccgtccgtaaacccnccttaagtccgaggtacccggtactaaaggtcctaacgtacggttaacgtcgtttcgtaacgttaagtttacgttacgttacctagtaccgtaacctacggtaaccctaccgtaccgtaccggttccccgttagtacccggtttaaccgggtacgggacccgggtaacgtaaaccggtacgggtaataaccgggttacaaacggttacccggtaagtcccgggtaacgttccgacgttaaccgttacccttagttcccggttaacccggtccttaaccggttcccttaacccccgg

SEQ ID NO: 188397 - DNA, 823 bp, Homo sapiens
  misc_feature: GYAE6OF02IAI6J.40.23.C01.1.454.CMB.1.raw
tcagtctagcgactcacgaccggtgctcgatttagtacacgtgattagggattgggggaggaactgctcagtttaggaccagagggaacatggaagccccagctcagcttctcttcctcctgctactctcggcctcccagactaccgaaccggagaaattgtggttgacgacagtctccacgcccacccttgtcttttcgtcctaccgaaggggaacgacgccctaccctctcctcgacgacgggaccagtacgagtacgttcgttacgacaacttaacgttacgtcgttacggtaaccaaacaaccggtaacctacggaccgaacggtcctaccgacggcctaccgtactacttcgtactagactacgactaccgtacgacgaccggacggacctaccggcgtacctacgacccgacggaccgtacggttacgacggtcgacggtagggtcgggtacggtacgggtacgtaacgtaaccttcgtaacttctacctacgtactacggacgtacccgtacggacgtacgtacgtaacgtaacggttacgttacgtaacgtttagttaacgtttcgaccgtactaacgggtaccaacgggttacccactaacccggggtttccgaaccgggttttacctacccggtttaacccgggttacgggggaacccggttaaacccgggaacgggtaaacgggtaacgggtaaccgtaacccggtaaaacccgtaaaccggttaggttaaccgggtacgggtaaccttaaccgaacgggttaaccctcgggttaactttaccggtacgtttacccttccggttaacccccg

SEQ ID NO: 188398 - DNA, 118 bp, Homo sapiens
  misc_feature: GYAE6OF01DEHE9.51.80.H03.1.454.CMB.1.raw
  modified_base (118)..(118): a, c, t, g, unknown or other
  misc_feature (118)..(118): n is a, c, g, or t
tcagcgatcgtatacacgaccggtgctcgatttagctgtgcgtcgaagggaagggcagcgtcactctgttcccaccctcctctcgtagcactctgagcgggctggcaaggcgcatagn

SEQ ID NO: 188399 - DNA, 118 bp, Homo sapiens
  misc_feature: GYAE6OF01AMW1I.51.80.H03.1.454.CMB.1.raw
tcagcgatcgtatacacgaccggtgctcgatttagctgtgcgtcgaagggaaagggcagcgtcactctgttcccaccctcctctcgtagcactctgagcgggctggcaaggcgcatag

SEQ ID NO: 188400 - DNA, 119 bp, Homo sapiens
  misc_feature: GYAE6OF01EPFK9.51.80.H03.1.454.CMB.1.raw
  modified_base (119)..(119): a, c, t, g, unknown or other
  misc_feature (119)..(119): n is a, c, g, or t
tcagcgatcgtatacacgaccggtgctcgatttagctgtgcgtcgaagggaaagggcagcgtcactctgttcccaccctcctctcgtagcactctgagcgggctggcaaggcgcatagn

SEQ ID NO: 188401 - DNA, 117 bp, Homo sapiens
  misc_feature: GYAE6OF01BPA3F.51.80.H03.1.454.CMB.1.raw
  modified_base (116)..(117): a, c, t, g, unknown or other
  misc_feature (116)..(117): n is a, c, g, or t
tcagcgatcgtatacacgaccggtgctcgatttagctgtgcgtcgaagggaaggcagcgtcactctgttcccgcctcctctcgtagcactctgagcgggctggcaaggcgcatagnn

SEQ ID NO: 188402 - DNA, 122 bp, Homo sapiens
  misc_feature: GYAE6OF01A1JZN.51.80.H03.1.454.CMB.1.raw
  modified_base (117)..(122): a, c, t, g, unknown or other
  misc_feature (117)..(122): n is a, c, g, or t
tcagcgatcgtatacacgaccggtgctcgatttagctgtgcgtcgaagggaaggcagcgtcactctgttcccgccctcctctcgtagcactctgagcgggctggcaaggcgcatagnnnnnn

SEQ ID NO: 188403 - DNA, 118 bp, Homo sapiens; identical to SEQ ID NO: 188399
  misc_feature: GYAE6OF01EHI09.51.80.H03.1.454.CMB.1.raw

SEQ ID NO: 188404 - DNA, 123 bp, Homo sapiens
  misc_feature: GYAE6OF01BC3PL.51.80.H03.1.454.CMB.1.raw
  modified_base (117)..(123): a, c, t, g, unknown or other
  misc_feature (117)..(123): n is a, c, g, or t
tcagcgatcgtatacacgaccggtgctcgatttagctgtgcgtcgaagggaaggcagcgtcactctgttcccgccctcctctcgtagcactctgagcgggctggcaaggcgcatagnnnnnnn

SEQ ID NO: 188405 - DNA, 117 bp, Homo sapiens
  misc_feature: GYAE6OF01AMY8N.51.80.H03.1.454.CMB.1.raw
tcagcgatcgtatacacgaccggtgctcgatttagctgtgcgtcgaagggaagggcagcgtcactctgttcccgccctcctctcgtagcactctgagcgggctggcaaggcgcatag

SEQ ID NO: 188406 - DNA, 158 bp, Homo sapiens
  misc_feature: GYAE6OF01AQ91U.51.80.H03.1.454.CMB.1.raw
  modified_base (158)..(158): a, c, t, g, unknown or other
  misc_feature (158)..(158): n is a, c, g, or t
tcagcgatcgtatacacgaccggtgctcgatttagctgtgcgtcgaagggaaagggcacgaccggtgctcgatttagagtgctacgaagggaaaggcagcgtcactctgttcccacctcctctcgtagcactctgagcgggctggcaaggcgcatagn

SEQ ID NO: 188407 - DNA, 118 bp, Homo sapiens; identical to SEQ ID NO: 188399
  misc_feature: GYAE6OF01C9PKH.51.80.H03.1.454.CMB.1.raw

SEQ ID NO: 188408 - DNA, 119 bp, Homo sapiens; identical to SEQ ID NO: 188400
  misc_feature: GYAE6OF01A7JJM.51.80.H03.1.454.CMB.1.raw
  modified_base (119)..(119): a, c, t, g, unknown or other
  misc_feature (119)..(119): n is a, c, g, or t

SEQ ID NO: 188409 - DNA, 122 bp, Homo sapiens
  misc_feature: GYAE6OF01B0NPG.51.80.H03.1.454.CMB.1.raw
  modified_base (119)..(122): a, c, t, g, unknown or other
  misc_feature (119)..(122): n is a, c, g, or t
tcagcgatcgtatacacgaccggtgctcgatttagctgtgcgtcgaagggaaagggcagcgtcactctgttcccaccctcctctcgtagcactctgagcgggctggcaaggcgcatagnnnn

SEQ ID NO: 188410 - DNA, 119 bp, Homo sapiens
  misc_feature: GYAE6OF01BCUOA.51.80.H03.1.454.CMB.1.raw
  modified_base (119)..(119): a, c, t, g, unknown or other
  misc_feature (119)..(119): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagn

SEQ ID NO: 188411 - DNA, 119 bp, Homo sapiens; identical to SEQ ID NO: 188400
  misc_feature: GYAE6OF01DCX8F.51.80.H03.1.454.CMB.1.raw
  modified_base (119)..(119): a, c, t, g, unknown or other
  misc_feature (119)..(119): n is a, c, g, or t

SEQ ID NO: 188412 - DNA, 117 bp, Homo sapiens
  misc_feature: GYAE6OF01C6417.51.80.H03.1.454.CMB.1.raw
  modified_base (117)..(117): a, c, t, g, unknown or other
  misc_feature (117)..(117): n is a, c, g, or t
tcagcgatcgtatacacgaccggtgctcgatttagctgtgcgtcgaagggaaggcagcgtcactctgttcccaccctcctctcgtagcactctgagcgggctggcaaggcgcatagn

SEQ ID NO: 188413 - DNA, 119 bp, Homo sapiens; identical to SEQ ID NO: 188400
  misc_feature: GYAE6OF01BR0W9.51.80.H03.1.454.CMB.1.raw
  modified_base (119)..(119): a, c, t, g, unknown or other
  misc_feature (119)..(119): n is a, c, g, or t

SEQ ID NO: 188414 - DNA, 118 bp, Homo sapiens; identical to SEQ ID NO: 188399
  misc_feature: GYAE6OF01CEQBM.51.80.H03.1.454.CMB.1.raw

SEQ ID NO: 188415 - DNA, 121 bp, Homo sapiens
  misc_feature: GYAE6OF01A39YZ.51.80.H03.1.454.CMB.1.raw
  modified_base (118)..(121): a, c, t, g, unknown or other
  misc_feature (118)..(121): n is a, c, g, or t
tcagcgatcgtatacacgaccggtgctcgatttagctgtgcgtcgaagggaagggcagcgtcactctgttcccacctcctctcgtagcactctgagcgggctggcaaggcgcataggnnnn

SEQ ID NO: 188416 - DNA, 120 bp, Homo sapiens
  misc_feature: GYAE6OF01BK945.51.80.H03.1.454.CMB.1.raw
  modified_base (119)..(120): a, c, t, g, unknown or other
  misc_feature (119)..(120): n is a, c, g, or t
tcagcgatcgtatacacgaccggtgctcgatttagctgtgcgtcgaagggaaagggcagcgtcactctgttcccaccctcctctcgtagcactctgagcgggctggcaaggcgcatagnn

SEQ ID NO: 188417 - DNA, 119 bp, Homo sapiens; identical to SEQ ID NO: 188410
  misc_feature: GYAE6OF01BNDYJ.51.80.H03.1.454.CMB.1.raw
  modified_base (119)..(119): a, c, t, g, unknown or other
  misc_feature (119)..(119): n is a, c, g, or t

SEQ ID NO: 188418 - DNA, 119 bp, Homo sapiens; identical to SEQ ID NO: 188400
  misc_feature: GYAE6OF01BJO2H.51.80.H03.1.454.CMB.1.raw
  modified_base (119)..(119): a, c, t, g, unknown or other
  misc_feature (119)..(119): n is a, c, g, or t

SEQ ID NO: 188419 - DNA, 118 bp, Homo sapiens
  misc_feature: GYAE6OF01DH5S4.51.80.H03.1.454.CMB.1.raw
tcagcgatcgtatacacgaccggtgctcgatttagctgtgcgtcgaagggaaagggcagcgtcactctgttcccgccctcctctcgtagcactctgagcgggctggcaaggcgcatag

SEQ ID NO: 188420 - DNA, 119 bp, Homo sapiens; identical to SEQ ID NO: 188410
  misc_feature: GYAE6OF01BRS82.51.80.H03.1.454.CMB.1.raw
  modified_base (119)..(119): a, c, t, g, unknown or other
  misc_feature (119)..(119): n is a, c, g, or t

SEQ ID NO: 188421 - DNA, 119 bp, Homo sapiens; identical to SEQ ID NO: 188400
  misc_feature: GYAE6OF01EKBNS.51.80.H03.1.454.CMB.1.raw
  modified_base (119)..(119): a, c, t, g, unknown or other
  misc_feature (119)..(119): n is a, c, g, or t

SEQ ID NO: 188422 - DNA, 134 bp, Homo sapiens
  misc_feature: GYAE6OF01A9QE9.51.80.H03.1.454.CMB.1.raw
  modified_base (121)..(134): a, c, t, g, unknown or other
  misc_feature (121)..(134): n is a, c, g, or t
tcagcgatcgtatacacgaccggtgctcgatttagctgtgcgtcgaagggaaagggcagcgtcactctgttcccaccctcctctcgtagcactctgagccgggctggcaaggccgcatagnnnnnnnnnnnnnn

SEQ ID NO: 188423 - DNA, 119 bp, Homo sapiens; identical to SEQ ID NO: 188400
  misc_feature: GYAE6OF01AWQWE.51.80.H03.1.454.CMB.1.raw
  modified_base (119)..(119): a, c, t, g, unknown or other
  misc_feature (119)..(119): n is a, c, g, or t

SEQ ID NO: 188424 - DNA, 119 bp, Homo sapiens; identical to SEQ ID NO: 188400
  misc_feature: GYAE6OF01CYA8J.51.80.H03.1.454.CMB.1.raw
  modified_base (119)..(119): a, c, t, g, unknown or other
  misc_feature (119)..(119): n is a, c, g, or t

SEQ ID NO: 188425 - DNA, 120 bp, Homo sapiens
  misc_feature: GYAE6OF01CVPN8.51.80.H03.1.454.CMB.1.raw
  modified_base (112)..(112): a, c, t, g, unknown or other
  misc_feature (112)..(112): n is a, c, g, or t
  modified_base (118)..(120): a, c, t, g, unknown or other
  misc_feature (118)..(120): n is a, c, g, or t
tcagcgatcgtatacacgaccggtgctcgatttagctgtgcgtcgaagggaaaggcagcgtcactctgttcccgccctcctctcgtagcactctgagcgggctggcaaggcncatagnnn

SEQ ID NO: 188426 - DNA, 119 bp, Homo sapiens; identical to SEQ ID NO: 188400
  misc_feature: GYAE6OF01ERO2T.51.80.H03.1.454.CMB.1.raw
  modified_base (119)..(119): a, c, t, g, unknown or other
  misc_feature (119)..(119): n is a, c, g, or t

SEQ ID NO: 188427 - DNA, 120 bp, Homo sapiens
  misc_feature: GYAE6OF01ANN3M.51.80.H03.1.454.CMB.1.raw
  modified_base (116)..(120): a, c, t, g, unknown or other
  misc_feature (116)..(120): n is a, c, g, or t
tcagcgatcgtatacacgaccggtgctcgatttagctgtgcgtcgaagggaaggcagcgtcactctgttcccgccctcctctcgtagcactctgagcggctggcaaggcgcatagnnnnn

SEQ ID NO: 188428 - DNA, 119 bp, Homo sapiens; identical to SEQ ID NO: 188400
  misc_feature: GYAE6OF01B3Z5G.51.80.H03.1.454.CMB.1.raw
  modified_base (119)..(119): a, c, t, g, unknown or other
  misc_feature (119)..(119): n is a, c, g, or t

SEQ ID NO: 188429 - DNA, 119 bp, Homo sapiens; identical to SEQ ID NO: 188410
  misc_feature: GYAE6OF01CUDI7.51.80.H03.1.454.CMB.1.raw
  modified_base (119)..(119): a, c, t, g, unknown or other
  misc_feature (119)..(119): n is a, c, g, or t

SEQ ID NO: 188430 - DNA, 185 bp, Homo sapiens
  misc_feature: GYAE6OF01A3808.51.80.H03.1.454.CMB.1.raw
  modified_base (118)..(118): a, c, t, g, unknown or other
  misc_feature (118)..(118): n is a, c, g, or t
  modified_base (125)..(185): a, c, t, g, unknown or other
  misc_feature (125)..(185): n is a, c, g, or t
tcagcgatcgtatacacgaccggtgctcgatttagctgtgcgtcgaaggggaaagggacagccgtcacgtctgttcccaccctcctctcgtagcactctgagcgggctgggcaaggcncatacgnnnnnnnnnnnnnnnnnnnnnnnnnnnnnnnnnnnnnnnnnnnnnnnnnnnnnnnnnnnnn

SEQ ID NO: 188431 - DNA, 123 bp, Homo sapiens
  misc_feature: GYAE6OF01AW7TT.51.80.H03.1.454.CMB.1.raw
  modified_base (119)..(123): a, c, t, g, unknown or other
  misc_feature (119)..(123): n is a, c, g, or t
tcagcgatcgtatacacgaccggtgctcgatttagctgtgcgtcgaagggaaagggcagcgtcactctgttcccaccctcctctcgtagcactctgagcgggctggcaaggcgcatagnnnnn

SEQ ID NO: 188432 - DNA, 119 bp, Homo sapiens; identical to SEQ ID NO: 188400
  misc_feature: GYAE6OF01DRG9G.51.80.H03.1.454.CMB.1.raw
  modified_base (119)..(119): a, c, t, g, unknown or other
  misc_feature (119)..(119): n is a, c, g, or t

SEQ ID NO: 188433 - DNA, 119 bp, Homo sapiens
  misc_feature: GYAE6OF01C05B1.51.80.H03.1.454.CMB.1.raw
  modified_base (118)..(119): a, c, t, g, unknown or other
  misc_feature (118)..(119): n is a, c, g, or t
tcagcgatcgtatacacgaccggtgctcgatttagctgtgcgtcgaagggaagggcagcgtcactctgttcccgccctcctctcgtagcactctgagcgggctggcaaggcgcatagnn

SEQ ID NO: 188434 - DNA, 119 bp, Homo sapiens; identical to SEQ ID NO: 188400
  misc_feature: GYAE6OF01DTJU3.51.80.H03.1.454.CMB.1.raw
  modified_base (119)..(119): a, c, t, g, unknown or other
  misc_feature (119)..(119): n is a, c, g, or t

SEQ ID NO: 188435 - DNA, 122 bp, Homo sapiens; identical to SEQ ID NO: 188409
  misc_feature: GYAE6OF01AMQIE.51.80.H03.1.454.CMB.1.raw
  modified_base (119)..(122): a, c, t, g, unknown or other
  misc_feature (119)..(122): n is a, c, g, or t

SEQ ID NO: 188436 - DNA, 128 bp, Homo sapiens
  misc_feature: GYAE6OF01DRRI4.51.80.H03.1.454.CMB.1.raw
  modified_base (98)..(98): a, c, t, g, unknown or other
  misc_feature (98)..(98): n is a, c, g, or t
  modified_base (113)..(113): a, c, t, g, unknown or other
  misc_feature (113)..(113): n is a, c, g, or t
  modified_base (119)..(128): a, c, t, g, unknown or other
  misc_feature (119)..(128): n is a, c, g, or t
tcagcgatcgtatacacgaccggtgctcgatttagctgtgcgtcgaagggaaagggcagcgtcactctgttcccgccctcctctcgtagcactctgancgggctggcaaggcncatagnnnnnnnnnn

SEQ ID NO: 188437 - DNA, 125 bp, Homo sapiens
  misc_feature: GYAE6OF01BLTPW.51.80.H03.1.454.CMB.1.raw
  modified_base (113)..(113): a, c, t, g, unknown or other
  misc_feature (113)..(113): n is a, c, g, or t
  modified_base (119)..(125): a, c, t, g, unknown or other
  misc_feature (119)..(125): n is a, c, g, or t
tcagcgatcgtatacacgaccggtgctcgatttagctgtgcgtcgaagggaaagggcagcgtcactctgttcccaccctcctctcgtagcactctgagcgggctggcaaggcncatagnnnnnnn

SEQ ID NO: 188438 - DNA, 118 bp, Homo sapiens; identical to SEQ ID NO: 188399
  misc_feature: GYAE6OF01DUUB5.51.80.H03.1.454.CMB.1.raw

SEQ ID NO: 188439 - DNA, 131 bp, Homo sapiens
  misc_feature: GYAE6OF01CMJUJ.51.80.H03.1.454.CMB.1.raw
  modified_base (114)..(114): a, c, t, g, unknown or other
  misc_feature (114)..(114): n is a, c, g, or t
  modified_base (120)..(131): a, c, t, g, unknown or other
  misc_feature (120)..(131): n is a, c, g, or t
tcagcgatcgtatacacgaccggtgctcgatttagctgtgcgtcggaaagggaaagggcagcgtcactctgttcccgccctcctctcgtagcactctgagcggctggcaaggcncatagnnnnnnnnnnnn

SEQ ID NO: 188440 - DNA, 130 bp, Homo sapiens
  misc_feature: GYAE6OF01CUEOE.51.80.H03.1.454.CMB.1.raw
  modified_base (119)..(130): a, c, t, g, unknown or other
  misc_feature (119)..(130): n is a, c, g, or t
tcagcgatcgtatacacgaccggtgctcgatttagctgtgcgtcggaagggaagggcagcgtcactctgttcccgccctcctctcgtagcactctgagcgggctggcaaggcgcatagnnnnnnnnnnnn

SEQ ID NO: 188441 - DNA, 121 bp, Homo sapiens
  misc_feature: GYAE6OF01DLL8U.51.80.H03.1.454.CMB.1.raw
  modified_base (117)..(121): a, c, t, g, unknown or other
  misc_feature (117)..(121): n is a, c, g, or t
tcagcgatcgtatacacgaccggtgctcgatttagctgtgcgtcgaagggaagggcagcgtcactctgttcccgccctctctcgtagcactctgagcgggctggcaaggcgcatagnnnnn

SEQ ID NO: 188442 - DNA, 122 bp, Homo sapiens; identical to SEQ ID NO: 188409
  misc_feature: GYAE6OF01ANUSY.51.80.H03.1.454.CMB.1.raw
  modified_base (119)..(122): a, c, t, g, unknown or other
  misc_feature (119)..(122): n is a, c, g, or t

SEQ ID NO: 188443 - DNA, 587 bp, Homo sapiens
  misc_feature: GYAE6OF01AM865.51.80.H03.1.454.CMB.1.raw
  modified_base (124)..(124): a, c, t, g, unknown or other
  misc_feature (124)..(124): n is a, c, g, or t
  modified_base (135)..(135): a, c, t, g, unknown or other
  misc_feature (135)..(135): n is a, c, g, or t
  modified_base (139)..(140): a, c, t, g, unknown or other
  misc_feature (139)..(140): n is a, c, g, or t
  modified_base (142)..(142): a, c, t, g, unknown or other
  misc_feature (142)..(142): n is a, c, g, or t
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (160)..(160): a, c, t, g, unknown or other
  misc_feature (160)..(160): n is a, c, g, or t
  modified_base (162)..(163): a, c, t, g, unknown or other
  misc_feature (162)..(163): n is a, c, g, or t
  modified_base (166)..(167): a, c, t, g, unknown or other
  misc_feature (166)..(167): n is a, c, g, or t
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (179)..(180): a, c, t, g, unknown or other
  misc_feature (179)..(180): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (208)..(209): a, c, t, g, unknown or other
  misc_feature (208)..(209): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
tcagcgatcgtatacacgaccggtgctcgattttagctgtgcgtcgaaagggaaaggggcgagcgtcaactctggttcccgccctcctctccgtagctactcttgagcggggctggcaagggcncataggactgnatcnncngcctgcagncctgcngtncnnganngcantnactgcnncancngtatcgtcngcananatanagtnntactcacganacanacgtnacncttactgtancnctaactagggtgagacctcggtacccggacgggtccttcggactacgaccgttncggaacgcggcctttaaacggtgtccgaaanacgtttagattcctccgggtaaacnctactacactacacgctacgtcgacgacgacgtagtacgtacgtacgtacgtacgtacgttacgtacgtacgtagtacgtacgtacgttacgttagttacgtactacgtacgtacccccgtacgttacggttaccggtacggtacgtacgtaccggacgtactacgtacgtacgtacgtacgtacgtacgtaccgtaccgtaccgtacgtacttaccgtacgtccgtcgtaccg

SEQ ID NO: 188444 - DNA, 607 bp, Homo sapiens
  misc_feature: GYAE6OF01B8T83.51.80.H03.1.454.CMB.1.raw
  modified_base (125)..(126): a, c, t, g, unknown or other
  misc_feature (125)..(126): n is a, c, g, or t
  modified_base (128)..(128): a, c, t, g, unknown or other
  misc_feature (128)..(128): n is a, c, g, or t
  modified_base (132)..(132): a, c, t, g, unknown or other
  misc_feature (132)..(132): n is a, c, g, or t
  modified_base (134)..(134): a, c, t, g, unknown or other
  misc_feature (134)..(134): n is a, c, g, or t
  modified_base (137)..(137): a, c, t, g, unknown or other
  misc_feature (137)..(137): n is a, c, g, or t
  modified_base (140)..(140): a, c, t, g, unknown or other
  misc_feature (140)..(140): n is a, c, g, or t
  modified_base (148)..(148): a, c, t, g, unknown or other
  misc_feature (148)..(148): n is a, c, g, or t
  modified_base (150)..(150): a, c, t, g, unknown or other
  misc_feature (150)..(150): n is a, c, g, or t
  modified_base (153)..(153): a, c, t, g, unknown or other
  misc_feature (153)..(153): n is a, c, g, or t
  modified_base (157)..(157): a, c, t, g, unknown or other
  misc_feature (157)..(157): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (345)..(345): a, c, t, g, unknown or other
  misc_feature (345)..(345): n is a, c, g, or t
tcagcgatcgtatacacgaccggtgctcgatttagctgtgcgtcgaaaggggaaaggggcagcgtcactctgttcccgccctcctctcgtagcactcgtggacgcgggctggcaaggcgcatagnncngcangncgntangatctganancgngtanctcgcttcgctgntnacagttngcaagttgnancnacnctgcgagntncngtcagcntactcagtcagtacgcngactacgacgcgagcncgttaacgngacttgtcgtaanagcgagtatcgcgttaaacgctaaggaacgttcgtacgtaccggactaacggtacgtacggtaacacgggtaacgngtacgtaaagggtccttacggttaaaacggaccttaagtaacccgtaccgttacgtaaccggggtacctaaccgtagttacccgtacggtacgtacgtacgtaacgtacgtaacgtacgtacgtacgtacgttacgtaacgtacgtaacgtaacgtacgtacgtacgtacgtacgtaacgtacgtacgtacgtacgtacgtacgtacgtacgtagtacggtacgtaacgtacgtacgtacgtacgtagtacgtcgtcgtacg

SEQ ID NO: 188445 - DNA, 118 bp, Homo sapiens
  misc_feature: GYAE6OF01CTN24.51.80.H03.1.454.CMB.1.raw
  modified_base (113)..(113): a, c, t, g, unknown or other
  misc_feature (113)..(113): n is a, c, g, or t
tcagcgatcgtatacacgaccggtgctcgatttagctgtgcgtcgaagggaaagggcagcgtcactctgttcccgccctcctctcgtagcactctgagcgggctggcaaggcncatag

SEQ ID NO: 188446 - DNA, 117 bp, Homo sapiens
  misc_feature: GYAE6OF02G12TG.51.80.H03.1.454.CMB.1.raw
  modified_base (117)..(117): a, c, t, g, unknown or other
  misc_feature (117)..(117): n is a, c, g, or t
tcagcgatcgtatacacgaccggtgctcgatttagctgtgcgtcgaagggaagggcagcgtcactctgttcccacctcctctcgtagcactctgagcgggctggcaaggcgcatagn

SEQ ID NO: 188447 - DNA, 130 bp, Homo sapiens
  misc_feature: GYAE6OF02ISS28.51.80.H03.1.454.CMB.1.raw
  modified_base (117)..(130): a, c, t, g, unknown or other
  misc_feature (117)..(130): n is a, c, g, or t
tcagcgatcgtatacacgaccggtgctcgatttagctgtgcgtcgaagggaagggcagcgtcactctgttccgcctcctctcgtagccactctgagcgggctggcaaggcgcatagnnnnnnnnnnnnnn

SEQ ID NO: 188448 - DNA, 123 bp, Homo sapiens
  misc_feature: GYAE6OF02FO45C.51.80.H03.1.454.CMB.1.raw
  modified_base (116)..(123): a, c, t, g, unknown or other
  misc_feature (116)..(123): n is a, c, g, or t
tcagcgatcgtatacacgaccggtgctcgatttagctgtgcgtcgaaggaagggcagcgtcactctgttcccgcctcctctcgtagcactctgagcgggctggcaaggcgcatagnnnnnnnn

SEQ ID NO: 188449 - DNA, 117 bp, Homo sapiens; identical to SEQ ID NO: 188405
  misc_feature: GYAE6OF02F6IME.51.80.H03.1.454.CMB.1.raw

SEQ ID NO: 188450 - DNA, 119 bp, Homo sapiens; identical to SEQ ID NO: 188410
  misc_feature: GYAE6OF02I8MW7.51.80.H03.1.454.CMB.1.raw
  modified_base (119)..(119): a, c, t, g, unknown or other
  misc_feature (119)..(119): n is a, c, g, or t

SEQ ID NO: 188451 - DNA, 122 bp, Homo sapiens; identical to SEQ ID NO: 188409
  misc_feature: GYAE6OF02F0R9N.51.80.H03.1.454.CMB.1.raw
  modified_base (119)..(122): a, c, t, g, unknown or other
  misc_feature (119)..(122): n is a, c, g, or t

SEQ ID NO: 188452 - DNA, 119 bp, Homo sapiens; identical to SEQ ID NO: 188433
  misc_feature: GYAE6OF02IBFRO.51.80.H03.1.454.CMB.1.raw
  modified_base (118)..(119): a, c, t, g, unknown or other
  misc_feature (118)..(119): n is a, c, g, or t

SEQ ID NO: 188453 - DNA, 119 bp, Homo sapiens
  misc_feature: GYAE6OF02GYZDH.51.80.H03.1.454.CMB.1.raw
  modified_base (119)..(119): a, c, t, g, unknown or other
  misc_feature (119)..(119): n is a, c, g, or t
tcagcgatcgtatacacgaccggtgctcgatttagctgtgcgtcgaagggaaaggacagcgtcactctgttcccaccctcctctcgtagcactctgagcgggctggcaaggcgcatagn

SEQ ID NO: 188454 - DNA, 117 bp, Homo sapiens
  misc_feature: GYAE6OF02HD4HG.51.80.H03.1.454.CMB.1.raw
  modified_base (117)..(117): a, c, t, g, unknown or other
  misc_feature (117)..(117): n is a, c, g, or t
tcagcgatcgtatacacgaccggtgctcgatttagctgtgcgtcgaagggaaaggcagcgtcactctgttcccgcctcctctcgtagcactctgagcgggctggcaaggcgcatagn

SEQ ID NO: 188455 - DNA, 119 bp, Homo sapiens; identical to SEQ ID NO: 188410
  misc_feature: GYAE6OF02HND11.51.80.H03.1.454.CMB.1.raw
  modified_base (119)..(119): a, c, t, g, unknown or other
  misc_feature (119)..(119): n is a, c, g, or t

SEQ ID NO: 188456 - DNA, 119 bp, Homo sapiens; identical to SEQ ID NO: 188400
  misc_feature: GYAE6OF02H424S.51.80.H03.1.454.CMB.1.raw
  modified_base (119)..(119): a, c, t, g, unknown or other
  misc_feature (119)..(119): n is a, c, g, or t

SEQ ID NO: 188457 - DNA, 118 bp, Homo sapiens; identical to SEQ ID NO: 188399
  misc_feature: GYAE6OF02IESIU.51.80.H03.1.454.CMB.1.raw

SEQ ID NO: 188458 - DNA, 118 bp, Homo sapiens
  misc_feature: GYAE6OF02HGJLZ.51.80.H03.1.454.CMB.1.raw
  modified_base (118)..(118): a, c, t, g, unknown or other
  misc_feature (118)..(118): n is a, c, g, or t
tcagcgatcgtatacacgaccggtgctcgatttagctgtgcgtcgaagggaaagggcagcgtcactctgttcccacctcctctcgtagcactctgagcgggctggcaaggcgcatagn

SEQ ID NO: 188459 - DNA, 117 bp, Homo sapiens
  misc_feature: GYAE6OF02JCM8V.51.80.H03.1.454.CMB.1.raw
  modified_base (117)..(117): a, c, t, g, unknown or other
  misc_feature (117)..(117): n is a, c, g, or t
tcagcgatcgtatacacgaccggtgctcgatttagctgtgcgtcgaagggaaggcagcgtcactctgttcccgccctcctctcgtagcactctgagcgggctggcaaggcgcatagn

SEQ ID NO: 188460 - DNA, 136 bp, Homo sapiens
  misc_feature: GYAE6OF02I47IM.51.80.H03.1.454.CMB.1.raw
  modified_base (118)..(136): a, c, t, g, unknown or other
  misc_feature (118)..(136): n is a, c, g, or t
tcagcgatcgtatacacgaccggtgctcgatttagctgtgcgtcgaagggaagggcagcgtcactctgttcccaccctcctctcgtagcactctgagcgggctggcaaggcgcatagnnnnnnnnnnnnnnnnnnn

SEQ ID NO: 188461 - DNA, 137 bp, Homo sapiens
  misc_feature: GYAE6OF02GMC3W.51.80.H03.1.454.CMB.1.raw
  modified_base (118)..(137): a, c, t, g, unknown or other
  misc_feature (118)..(137): n is a, c, g, or t
tcagcgatcgtatacacgaccggtgctcgatttagctgtgcgtcgaagggaaagggcagcgtcactctgttcccaccctcctctcgtagactctgagcgggctggcaaggcgcatagnnnnnnnnnnnnnnnnnnnn

SEQ ID NO: 188462 - DNA, 119 bp, Homo sapiens; identical to SEQ ID NO: 188400
  misc_feature: GYAE6OF02IWQXX.51.80.H03.1.454.CMB.1.raw
  modified_base (119)..(119): a, c, t, g, unknown or other
  misc_feature (119)..(119): n is a, c, g, or t

SEQ ID NO: 188463 - DNA, 119 bp, Homo sapiens; identical to SEQ ID NO: 188400
  misc_feature: GYAE6OF02IBA49.51.80.H03.1.454.CMB.1.raw
  modified_base (119)..(119): a, c, t, g, unknown or other
  misc_feature (119)..(119): n is a, c, g, or t

SEQ ID NO: 188464 - DNA, 118 bp, Homo sapiens
  misc_feature: GYAE6OF02G85VE.51.80.H03.1.454.CMB.1.raw
  modified_base (118)..(118): a, c, t, g, unknown or other
  misc_feature (118)..(118): n is a, c, g, or t
tcagcgatcgtatacacgaccggtgctcgatttagctgtgcgtcgaagggaaagggcagcgtcactctgttcccgcctcctctcgtagcactctgagcgggctggcaaggcgcatagn

SEQ ID NO: 188465 - DNA, 118 bp, Homo sapiens; identical to SEQ ID NO: 188399
  misc_feature: GYAE6OF02I85Q1.51.80.H03.1.454.CMB.1.raw

SEQ ID NO: 188466 - DNA, 115 bp, Homo sapiens
  misc_feature: GYAE6OF02GSQ6A.51.80.H03.1.454.CMB.1.raw
  modified_base (115)..(115): a, c, t, g, unknown or other
  misc_feature (115)..(115): n is a, c, g, or t
tcagcgatcgtatacacgaccggtgctcgatttagctgtgcgtcgaagggaaggcagcgtcactctgttccacctcctctcgtagcactctgagcgggctggcaaggcgcatagn

SEQ ID NO: 188467 - DNA, 119 bp, Homo sapiens; identical to SEQ ID NO: 188410
  misc_feature: GYAE6OF02G0D24.51.80.H03.1.454.CMB.1.raw
  modified_base (119)..(119): a, c, t, g, unknown or other
  misc_feature (119)..(119): n is a, c, g, or t

SEQ ID NO: 188468 - DNA, 117 bp, Homo sapiens
  misc_feature: GYAE6OF02FXIF3.51.80.H03.1.454.CMB.1.raw
  modified_base (117)..(117): a, c, t, g, unknown or other
  misc_feature (117)..(117): n is a, c, g, or t
tcagcgatcgtatacacgaccggtgctcgatttagctgtgcgtcgaagggaagggcagcgtcactctgttcccgcctcctctcgtagcactctgagcgggctggcaaggcgcatagn

SEQ ID NO: 188469 - DNA, 130 bp, Homo sapiens
  misc_feature: GYAE6OF02F6C17.51.80.H03.1.454.CMB.1.raw
  modified_base (119)..(130): a, c, t, g, unknown or other
  misc_feature (119)..(130): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagnnnnnnnnnnnn

SEQ ID NO: 188470 - DNA, 121 bp, Homo sapiens
  misc_feature: GYAE6OF02JC05G.51.80.H03.1.454.CMB.1.raw
  modified_base (118)..(121): a, c, t, g, unknown or other
  misc_feature (118)..(121): n is a, c, g, or t
tcagcgatcgtatacacgaccggtgctcgatttagctgtgcgtcgaagggaaagggcagcgtcactctgttccaccctcctctcgtagcactctgagcgggctggcaaggcgcatagnnnn

SEQ ID NO: 188471 - DNA, 124 bp, Homo sapiens
  misc_feature: GYAE6OF02JUMAC.51.80.H03.1.454.CMB.1.raw
  modified_base (116)..(124): a, c, t, g, unknown or other
  misc_feature (116)..(124): n is a, c, g, or t
tcagcgatcgtatacacgaccggtgctcgatttagctgtgcgtcgaagggaagggcagcgtcactctgttccacctcctctcgtagcactctgagcgggctggcaaggcgcatagnnnnnnnnn

SEQ ID NO: 188472 - DNA, 117 bp, Homo sapiens; identical to SEQ ID NO: 188454
  misc_feature: GYAE6OF02FEUG2.51.80.H03.1.454.CMB.1.raw
  modified_base (117)..(117): a, c, t, g, unknown or other
  misc_feature (117)..(117): n is a, c, g, or t

SEQ ID NO: 188473 - DNA, 119 bp, Homo sapiens; identical to SEQ ID NO: 188410
  misc_feature: GYAE6OF02IO6OI.51.80.H03.1.454.CMB.1.raw
  modified_base (119)..(119): a, c, t, g, unknown or other
  misc_feature (119)..(119): n is a, c, g, or t

SEQ ID NO: 188474 - DNA, 118 bp, Homo sapiens; identical to SEQ ID NO: 188419
  misc_feature: GYAE6OF02FI9DY.51.80.H03.1.454.CMB.1.raw

SEQ ID NO: 188475 - DNA, 120 bp, Homo sapiens
  misc_feature: GYAE6OF02HW7H5.51.80.H03.1.454.CMB.1.raw
  modified_base (119)..(120): a, c, t, g, unknown or other
  misc_feature (119)..(120): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagnn

SEQ ID NO: 188476 - DNA, 129 bp, Homo sapiens
  misc_feature: GYAE6OF02GATT6.51.80.H03.1.454.CMB.1.raw
  modified_base (119)..(129): a, c, t, g, unknown or other
  misc_feature (119)..(129): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagnnnnnnnnnnn

SEQ ID NO: 188477 - DNA, 119 bp, Homo sapiens; identical to SEQ ID NO: 188400
  misc_feature: GYAE6OF02F3YJT.51.80.H03.1.454.CMB.1.raw
  modified_base (119)..(119): a, c, t, g, unknown or other
  misc_feature (119)..(119): n is a, c, g, or t

SEQ ID NO: 188478 - DNA, 119 bp, Homo sapiens; identical to SEQ ID NO: 188410
  misc_feature: GYAE6OF02F4F97.51.80.H03.1.454.CMB.1.raw
  modified_base (119)..(119): a, c, t, g, unknown or other
  misc_feature (119)..(119): n is a, c, g, or t

SEQ ID NO: 188479 - DNA, 129 bp, Homo sapiens
  misc_feature: GYAE6OF02HDGKZ.51.80.H03.1.454.CMB.1.raw
  modified_base (120)..(129): a, c, t, g, unknown or other
  misc_feature (120)..(129): n is a, c, g, or t
tcagcgatcgtatacacgaccggtgctcgatttagctgtgcgtcgaaggggaaagggcagcgtcactctgttcccaccctcctctcgtagcactctgagcgggctggcaaggcgcatagnnnnnnnnnn

SEQ ID NO: 188480 - DNA, 120 bp, Homo sapiens; identical to SEQ ID NO: 188475
  misc_feature: GYAE6OF02F5D1V.51.80.H03.1.454.CMB.1.raw
  modified_base (119)..(120): a, c, t, g, unknown or other
  misc_feature (119)..(120): n is a, c, g, or t

SEQ ID NO: 188481 - DNA, 152 bp, Homo sapiens
  misc_feature: GYAE6OF02HV42P.51.80.H03.1.454.CMB.1.raw
  modified_base (119)..(152): a, c, t, g, unknown or other
  misc_feature (119)..(152): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagnnnnnnnnnnnnnnnnnnnnnnnnnnnnnnnnnn

SEQ ID NO: 188482 - DNA, 118 bp, Homo sapiens; identical to SEQ ID NO: 188399
  misc_feature: GYAE6OF02IUJ0H.51.80.H03.1.454.CMB.1.raw

SEQ ID NO: 188483 - DNA, 118 bp, Homo sapiens; identical to SEQ ID NO: 188419
  misc_feature: GYAE6OF02HFH6J.51.80.H03.1.454.CMB.1.raw

SEQ ID NO: 188484 - DNA, 125 bp, Homo sapiens
  misc_feature: GYAE6OF02F05X9.51.80.H03.1.454.CMB.1.raw
  modified_base (119)..(125): a, c, t, g, unknown or other
  misc_feature (119)..(125): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagnnnnnnn

SEQ ID NO: 188485 - DNA, 124 bp, Homo sapiens
  misc_feature: GYAE6OF02FYIG6.51.80.H03.1.454.CMB.1.raw
  modified_base (119)..(124): a, c, t, g, unknown or other
  misc_feature (119)..(124): n is a, c, g, or t
tcagcgatcgtatacacgaccggtgctcgatttagctgtgcgtcgaagggaaagggcagcgtcactctgttcccgccctcctctcgtagcactctgagcgggctggcaaggcgcatagnnnnnn

SEQ ID NO: 188486 - DNA, 124 bp, Homo sapiens
  misc_feature: GYAE6OF02GUCKW.51.80.H03.1.454.CMB.1.raw
  modified_base (113)..(113): a, c, t, g, unknown or other
  misc_feature (113)..(113): n is a, c, g, or t
  modified_base (119)..(124): a, c, t, g, unknown or other
  misc_feature (119)..(124): n is a, c, g, or t
tcagcgatcgtatacacgaccggtgctcgatttagctgtgcgtcgaagggaaagggcagcgtcactctgttcccgccctcctctcgtagcactctgagcgggctggcaaggcncatagnnnnnn

SEQ ID NO: 188487 - DNA, 130 bp, Homo sapiens
  misc_feature: GYAE6OF02FSPNS.51.80.H03.1.454.CMB.1.raw
  modified_base (120)..(130): a, c, t, g, unknown or other
  misc_feature (120)..(130): n is a, c, g, or t
tcagcgatcgtatacacgaccggtgctcgatttagctgtgcgtcgaagggaaaggggcagcgtcactctgttcccgccctcctctcgtagcactctgagcgggctggcaaggcgcatagnnnnnnnnnnn

SEQ ID NO: 188488 - DNA, 119 bp, Homo sapiens; identical to SEQ ID NO: 188400
  misc_feature: GYAE6OF02HFWSE.51.80.H03.1.454.CMB.1.raw
  modified_base (119)..(119): a, c, t, g, unknown or other
  misc_feature (119)..(119): n is a, c, g, or t

SEQ ID NO: 188489 - DNA, 124 bp, Homo sapiens
  misc_feature: GYAE6OF02HT341.51.80.H03.1.454.CMB.1.raw
  modified_base (119)..(124): a, c, t, g, unknown or other
  misc_feature (119)..(124): n is a, c, g, or t
tcagcgatcgtatacacgaccggtgctcgatttagctgtgcgtcgaagggaaagggcagcgtcactctgttcccaccctcctctcgtagcactctgagcgggctggcaaggcgcatagnnnnnn

SEQ ID NO: 188490 - DNA, 527 bp, Homo sapiens
  misc_feature: GYAE6OF01C98AM.37.2.A02.1.454.CMB.1.raw
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaaagaaccagttctccctgaagctgagttctgtgaccgccgcagacacggccgtctattactgtgcgagagttggccccatagtaccagctgtcttcgccatgcttttgatatctggggccaaggggacaaatggtcaccgtctcttcagcctccaccaagggcccatcggtcttcccctcggcaccctcctccaacgacgcacctcgtgggggcacgagcggcccgtgggctcgcctggtcaaggactacttccatctacactacngagcgggntggcaggcg

SEQ ID NO: 188491 - DNA, 566 bp, Homo sapiens
  misc_feature: GYAE6OF01B8VY6.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtccttcgccatgtcttttgatatctggggccaagggacaagtggtcaccgtctcttcagcctccaccgacggccccagtccggtccttccccgtcggcctaccctcctacccaagacgcaccctcgtcggggccacgacggccggccctgggcctcgcccgtgggtccgaaacgggtaccttaccgttccatccttacaccttacgtgtacggcgggctcggcgagggccg

SEQ ID NO: 188492 - DNA, 515 bp, Homo sapiens
  misc_feature: GYAE6OF01BYSWH.37.2.A02.1.454.CMB.1.raw
  modified_base (506)..(506): a, c, t, g, unknown or other
  misc_feature (506)..(506): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctgggccaagggacaatggtcaccgtctcttcagcctccaccaagggcccatcggtcttcccctcggcaccctcctccaagacgcacctctggggcacgagcgccctggctgcctggtcaggactacttccatctcactactgagcggntggcaggcg

SEQ ID NO: 188493 - DNA, 521 bp, Homo sapiens
  misc_feature: GYAE6OF01BSXUZ.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctcctgaagctgagttctgtgaccgccgcagacacggccgtctatactgtgcgagagttggccccagtacgtaccagctgtcttccgctatgtcttttgattatcgtggggccaagggtacaagttgggtcaccgtcttaccg

SEQ ID NO: 188494 - DNA, 596 bp, Homo sapiens
  misc_feature: GYAE6OF01CK9GW.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggcgtctattactgtgcgagagttcggcccatacgtaccagctgtcttcgccatgtctttgatatcgtggggaccaagggacaagtggtcaccgtctctcacgcctccaccaacgggcccagtcggtccttcccctggccaccctccctccaacgacgctaccctcgtcggggaccacgacggccggtcccgtgggcctcggcccttgggtaccaacgggtaccttaaccgtttcccacttacccgttaaccacccgttaaccgttcggacggtaccggggcgttcgggccgtaaacgggcccgg

SEQ ID NO: 188495 - DNA, 686 bp, Homo sapiens
  misc_feature: GYAE6OF01BMNYJ.37.2.A02.1.454.CMB.1.raw
  modified_base (223)..(223): a, c, t, g, unknown or other
  misc_feature (223)..(223): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcnccatatcagtagacacgtccaagaaccagttctcctgaagctgagttctgtgaccgccgcagacacggccgtctattactgtgcgagagttcgcccatacgtacagctgtctcgcatgtctttgatatcgtgggaccaagggacaagtcggtcaccgtctcttcacgtcctccaaccgtaacgggcccctaacgttccggttccctttaccccccgtcgggtacccctaccccgttccctacccgaaacggtacgacccgtaaccccgttccggtacgggggaccctaaccggaccgggtcccgggtcccccgttcgggggtcccttccgggtcccgttacggggtacccgtaaaacggggttacccttaacccgtttaccccgaacttacccgtaaccctaaccgttaaccggttacggaaccgggccggggtaccgtacggggaccgtaacggggtacccg

SEQ ID NO: 188496 - DNA, 589 bp, Homo sapiens
  misc_feature: GYAE6OF01BXWWJ.37.2.A02.1.454.CMB.1.raw
  modified_base (397)..(397): a, c, t, g, unknown or other
  misc_feature (397)..(397): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgcaatatcagtagacacgtccaaagaaccagttctccctgaagctgagttctgtgaccgccgcagacacggccgtctattactgtgcgagagttcggcccatagtaccagctgtccttcgccatgtcttttgatatcgtggggccaaggggacaagtcggtcaccgtctcttcncgtcctccaccgacggcccatcggtccttccccgtcgccaccctcctccaagcgcaccgtcgtcggggacacgacgtccggcccgtcgggcctcgcccgttgggtaccgtaaacggtaccttaccgttcctaacttaccctacctacctaacgtcggtacggccggggaccgtcgggccggaaaggtcccgg

SEQ ID NO: 188497 - DNA, 515 bp, Homo sapiens
  misc_feature: GYAE6OF01DVJZ0.37.2.A02.1.454.CMB.1.raw
  modified_base (441)..(441): a, c, t, g, unknown or other
  misc_feature (441)..(441): n is a, c, g, or t
  modified_base (502)..(502): a, c, t, g, unknown or other
  misc_feature (502)..(502): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctgggccaagggcaatggtcaccgtctcttcacgcctccaccaagggcccatccggtcttccccgtgccgtccctgctccaggnccacctcgagcgcacacgcggccctgggctgcctggcaaggctacttccatctacactacngagcggctggacg

SEQ ID NO: 188498 - DNA, 595 bp, Homo sapiens
  misc_feature: GYAE6OF01EA6VO.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgtcttttgatatctggggccaagggacaagtggtcaccgtctcttcacgcctccaccaacgggccccactccggtccttccccctcggcccacccctccctcccaacgacgccaccctcgtcgggggccaccgacggcccggcccgtcggggcctcggcccgttcgggtccgaaacgggaccttaccgttccctaattcctaaccacctaaccgtggacggacccggggcgtcgggcgaacgggtccgg

SEQ ID NO: 188499 - DNA, 607 bp, Homo sapiens
  misc_feature: GYAE6OF01D8CMQ.37.2.A02.1.454.CMB.1.raw
  modified_base (239)..(239): a, c, t, g, unknown or other
  misc_feature (239)..(239): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaaggggctggagtggattgggactatctctcatagtgggagcacctactactaacccgtccctcaagagtcgaggcgccatatcagtanacacgtccaaagaaccagttcctccctgaagctgtagttctgtcgaccgccgcagacacgaccgtctattactgtgcgagtacgttcggccccatacgtaccagtctgtccttccgcctatcgtcctttgattatcgtggggaccgaagggacaagttcggtacctaccgtcttcttcgacgccctacccaaccgaacgggcccctacgttcccggttcccttccccccgtcggtccctaccccctccctacccaacgcgccaccgtcggtcggggccacgacggcccggccgtcgggctcgccgtcggtacgacggtacctaccgttcctatcctacaccttacgcgtacggcggcgtggcgaggcg

SEQ ID NO: 188500 - DNA, 501 bp, Homo sapiens
  misc_feature: GYAE6OF01AXYZ2.37.2.A02.1.454.CMB.1.raw
  modified_base (274)..(274): a, c, t, g, unknown or other
  misc_feature (274)..(274): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcccacaagagtcgaggcgccatatcagtagacacgtccaagaaccagttctccctgaagctgagttcngtgaccgccgcagacacggccgtctattacctgtgcgagagttggccccatagtaccagctgtcttccgccatcgcttttgatatctggggccaagggcaatggtcacgtctcttcagctcacaggcccatcgctcccngcacctcncagagcaccngtgggcacngccgcctggctgcctaggtcaaaggctactccancctcactactgngcggtcgngngnggc

SEQ ID NO: 188501 - DNA, 533 bp, Homo sapiens
  misc_feature: GYAE6OF01DYJHI.37.2.A02.1.454.CMB.1.raw
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatcgtgggccaagggacaatggtcaccgtctctcagcctccaccaacggcccatcggtccttccccctcggccaccctcctcccaacgacgccacctcgcggggcacgacgcggcccgtgggctcgcctggtcaacggctacgttccatctacactacncgacgcggntggcaaggcg

SEQ ID NO: 188502 - DNA, 685 bp, Homo sapiens
  misc_feature: GYAE6OF01CS9QL.37.2.A02.1.454.CMB.1.raw
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactcatcagcagtggttactacgtggggctggactccggcacggcccccgaggggaagggctggagtggagttgggactagtctctcagtagtgggagcacctactactaacccgtcctanaagngtcgaggcgccatactcaagtacgacaacgtaccaaagaacctagttcctacccgtgaaacgtcgtaggtacgtttcgtacggtacgtaacccgccgtaccacggaaccgtaccgggtacccgttactaacgtttaccgtggttacggacggtacggtaacgggtttaccgggaccccctaagttaccgttaacccggaacgtccgtttacgttcccgtttaccccggaccgttagttcggttacgttttttaggaactttacggttaccggttaccgggggtaacccaaacggggtacctaaggttaccgggtaaccctacccggttcctttacccgg

SEQ ID NO: 188503 - DNA, 535 bp, Homo sapiens
  misc_feature: GYAE6OF01A49KA.37.2.A02.1.454.CMB.1.raw
  modified_base (258)..(258): a, c, t, g, unknown or other
  misc_feature (258)..(258): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataaccccgtccctcaagagtcgaggcgccatatcagtagacacgtccaagaaccagttcnccctgaagctgagttctgtgaccgccgcagacacggccgtctattactgtgcgagagttggccccatagtaccagctgtcttccgccatgcttttgatatcgtggggccaaggggacaaatggtcaccggtctcttcagcctccaccaagggcccatccggtcttcccccgtgccaccctcctccagacgcacctcgtggggcacgacgccggccctgggcctggcctggtccaaggacctacgttccatctacactactgagcggctggcgaggcg

SEQ ID NO: 188504 - DNA, 556 bp, Homo sapiens
  misc_feature: GYAE6OF01BQYHS.37.2.A02.1.454.CMB.1.raw
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggcccatagtaccagctgtctccgcatgcttttgntatctggggccaaggggacaatggtcaccgtctcttcngcctccaccgaacgggcccactccggtccttcccccgtcggccacccctccctcccaacgacgcaccctcgtcgggggcaccgagccggcccgtcgggctcgccgtggtcaacggacctacgttccattcctacacctactcggacgcgggcgtcggcgaagggccg

SEQ ID NO: 188505 - DNA, 513 bp, Homo sapiens
  misc_feature: GYAE6OF01DV0G3.37.2.A02.1.454.CMB.1.raw
  modified_base (382)..(382): a, c, t, g, unknown or other
  misc_feature (382)..(382): n is a, c, g, or t
  modified_base (505)..(505): a, c, t, g, unknown or other
  misc_feature (505)..(505): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtggttactactggggctggatccggcagcccccagggaagggctggagtggattgggactagtctctcatagtgggagcacctactactaacccgtccctacaagacgtcgaggcgccatatcagtagacacgtcaagaaccagttcncctgaagctgagttctgtgaccgccgcagacacggccgtctattactgtgcgagagttcggccccagtacgtaccagctgtctccgccatgcttttgatagtcgtgggccaagggcaatggcnccgtctcc

SEQ ID NO: 188506 - DNA, 528 bp, Homo sapiens
  misc_feature: GYAE6OF01BT38Y.37.2.A02.1.454.CMB.1.raw
  modified_base (510)..(510): a, c, t, g, unknown or other
  misc_feature (510)..(510): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaatggtcaccgtctcttcagcctccaccaacgggcccagtccggtcttccccctggccaccctcctccagacgcacctcgcggggcacgagcggccctgggctcgcctggtcaggactaccgttccatctacactacngcgcggctggcgaggccg

SEQ ID NO: 188507 - DNA, 531 bp, Homo sapiens
  misc_feature: GYAE6OF01DQWXI.37.2.A02.1.454.CMB.1.raw
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctatactgtgcgagagttcggcccatagtaccagctgtcttcgccatgcttttgatatctggggccaaggggacaatggtcaccgtctcttcagcctccaccaacgggcccagtccggtcttcccccgtggccacccctccctccaacgacgccacctcgtgggggccacgacggccggcccgtgggctcgcctggtcaagctactccatctacactctgcgcggncggnagcg

SEQ ID NO: 188508 - DNA, 575 bp, Homo sapiens
  misc_feature: GYAE6OF01C259S.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctccagatgggtcctgtcccaggtgcaactgcaagagtcgggccaggaatggtgaagccttcggagaccctgtccctcacctgcactgtctctgttactcatcagcagtggttactacgtggggctggatccggcacggccccgaggggaacgggctggagtggattgggactatctctcagtaggtggacgcaacctactactaacccgtcctagaacgacgtcgaggcgccatactcaagtacgacaacgtaccaaagaacctagttcctaccgtagaactcgtagtacgttcgtgtacgaccgcgacagaccgaccggtcctactattacgtgtgacgtagtacgtcggccctagtacgtaccagtctcgtccttccggtcctagttcgttcttttggattacgtcgtacggggaccaagggacctagtcggtcaccggttctaaaaccg

SEQ ID NO: 188509 - DNA, 578 bp, Homo sapiens
  misc_feature: GYAE6OF01EKUK9.37.2.A02.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttcnccctgaagctgagtttcngtgaccgccgcagacacggccgtctattactgtgcgagagttggccccatagtaccagctgtcttccgccatgcttttgatatctggggccaagggacaagtggtcaccgtctcttcacgcctccaccaacgggcccatccggtcttccccctggccctaccctcctccaacgacgcaccgtcgtcggggccaccgacggccggcccgtgggcctcggccgtgggtaccgaaacgggaccttaccgttccgattccgtaaccaccgtactacggacgtccggggacttcgggccgaagggccg

SEQ ID NO: 188510 - DNA, 630 bp, Homo sapiens
  misc_feature: GYAE6OF01E49YI.37.2.A02.1.454.CMB.1.raw
  modified_base (315)..(315): a, c, t, g, unknown or other
  misc_feature (315)..(315): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtcgacccgccgcagaccacggcctctattactgtgcgagngttcggccccagtagtaccagtctgtccttccgccatcgtctttgattatcgtggggccaagggacaagtcggtcaccggtctcttcacgtccctccaccgaacgggcccctagtccggttaccttcccccgtcgtaccctacccctcccgtaccaacgacgaccaccgtcgtcggggaccaccgacggtcccggacccgtcgggtcctacggcccgtaggtaccgtaaacggtacccttaccgttacccgtaattacccgtaacctaccgttacgtacggtacgggccgggtacgtcgggccgaagggtacccg

SEQ ID NO: 188511 - DNA, 680 bp, Homo sapiens
  misc_feature: GYAE6OF01A6WVH.37.2.A02.1.454.CMB.1.raw
  modified_base (217)..(217): a, c, t, g, unknown or other
  misc_feature (217)..(217): n is a, c, g, or t
tcagtagtgtagatcacgaccggtgctcgatttagactcatctacagggtctccgaagccttcggagaccctgtccctcacctagcacctggtctctggttactccatcagcagtggttactactggggctggatccggtcaggcccccgagggaaggggctggagtggattgggactatctcgtcatagtgggagcacctactataacccgtcctnaagagtcgaggcgccgatatcagtagacacgtccaagacctagttcctccgtgaagctgagttctgtcgaccgtccgcacgaccgacggccgtctacgttaccgtggtcggacggaggtaggttcggcccctaagttaacggtaacccaggtccttcgttcccgtttcccgacctaagttcgtactttttggaacttacgtcggtacggggaccaaaggggactaaagtcggtacctacccgttctacctcgacgtccctaccgaaccgaaccgggccctacgtccggttacccttccccgtcggccctaccctcccgtaccgaacgacgcctaccgtcggtcggggaccacgacgtcccggtaccgtcgggtacgtcgccgtcggtacgtaacggtacctacgttcctacttacctaccgtacgtacgtacggtacggccgggacgtcggacgtacggtccg

SEQ ID NO: 188512 - DNA, 561 bp, Homo sapiens
  misc_feature: GYAE6OF01CS4F7.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaaagaaccagttctccctgaagctgagttctgtgaccgccgcagacacggccgtctattactgtgcgagagttcggccccatagtaccagctgtcttccgccatgcttttgatatcgtggggccaaagggacaaatcggtcaccgtctcttcacgcctccaccaacgggccccacgtccggttccttcccccgtcggccctaccccgtccctaccaacgacgccaccgtcgtcggggcacgacgcggcccgtgggcctgccgtgtcgtaacgctactcctatacctactacctactgacggcggctcgggcaaggcg

SEQ ID NO: 188513 - DNA, 567 bp, Homo sapiens
  misc_feature: GYAE6OF01C65ST.37.2.A02.1.454.CMB.1.raw
  modified_base (545)..(545): a, c, t, g, unknown or other
  misc_feature (545)..(545): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttcggcccatagtaccagctgtcttccgccatgtcttttgatatcgtggggccaagggacaagtggtcaccgtctcttcacgcctccaccaacgggccccagtcggttccttcccccgtggccctacccctccctaccgaacgacgccaccgtcgtcggggccacgacgccggcccgtgggcctcggcccgtggtacaacggtacctaccgttccattcctaccacttacnggacgcgggactggcgaaggcg

SEQ ID NO: 188514 - DNA, 755 bp, Homo sapiens
  misc_feature: GYAE6OF01DJOFD.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccgaggtgcaactgcaataggtccgggcccaaggaagtggtagaacgccgttcggacgacccctcgtcccctcgacctgcactcgtctcgttggttactccatcagctagttcggttactacgtcgggctggacgtccggcgaccggccccggaaggggacggggcgtagggaggtcggagttgggactagtcctctacgagtaggtagggacgactaccttaactaccgtaaccccgtccctacgaacggacgtccggaacggtcgacctatactacgtacggtaacgaaccgtacccgtaaccgaaacggtaaacccgtacgtttcccgtacccgttagaaaccggtcgtacggtacgttccgtacggtacccggtacccggacccgtacgaaccggacccgtaccgggttacccgttactttaccgttacgtcggttacggaccggtaacggttcggttacccggacccctaagttaccggtaaccgtacggtaccttccggttaccctttcccggccttaacgttcgttacgttttagacgtttacgttccgggtacggggaaccgtaagggtaacctaacggttcgggtacccttccggtccttacccg

SEQ ID NO: 188515 - DNA, 557 bp, Homo sapiens
  misc_feature: GYAE6OF01ELGJD.37.2.A02.1.454.CMB.1.raw
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaagaccagttcctccctgaagctgagttctgtgaccgccgcagacacggccgtctattactgtgcgagagttggccccatacgtaccagctgtcttccgccatgcttttgattatctggggccaagggaccaaatggtcaccgtctcttcagccctccaccaaggacccatccggtccttccccctggcctaccccgtcctcctaagacgccaccgtcgtcggggccacgacgccgcccgtgggcctcgccgtggtacaacggaccttacgttcccatctacaccttacnggacggcgggntcggcgaaggccg

SEQ ID NO: 188516 - DNA, 627 bp, Homo sapiens
  misc_feature: GYAE6OF01BXB2A.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatcgtggggccaagggacaagtcggtcaccgtctcttcacgtccctccaccaacgggccccacgtcccggttccttccccccgtcggtccctacccctccctacccaacggacgcctacccgttcgtcgggggccaccgacggtcccgggccccgttggggcctcggcccgttcgggtaccaacgggtaccttaaccgttccctaacttcccgtaacctaacccttaaccgtcggaacggtccggggtaccgttcgggaccgaacggggccg

SEQ ID NO: 188517 - DNA, 812 bp, Homo sapiens
  misc_feature: GYAE6OF01EPHGA.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggacgaccctgtcccctcacctgcactgtctctgttactccatcagcagtggttactacgtggggctggactccggcacggcccccgaggggaacggggcgtaggagtggagttgggactagtcctctactagtaagtgggacgtacctaaccttaacctaaccgtaaccccgtccctaacgaacggtacgtccggacggaccgacaatactacgaagtaacgaaccgaaccgtaccgaaacgtaacctacgttaccgtacccgtaggaacgtccgttaggtaacgtttcgtacggttaccggaccccgtccggaccgtaacggacccgtacccgggtacccgttacgttaacgtttaccgtacgggtacggtaccgggtaacggtacggtttaccgggaccccctaaggttaacccgtaacccgtacggttacccgtttaccgggtttacccttaccccggtacccgtttaacgtttacccggtttttacgtttttaaccgggtaaacgtttaccggttaccgggggttaacccggggggtaaccccggtaaaacgggggtaaacccttaaacgggtttacccggggttaacccccgttaccccggtttcccgttttaaccccgg

SEQ ID NO: 188518 - DNA, 639 bp, Homo sapiens
  misc_feature: GYAE6OF01EA9GI.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccgagggaaggggctggagtggattgggactatctctcataggtgggagcacctactactaacccgtccctcaagagtcgaggcgccatatcagtagacacgtccaagaacctagttcctccctgaagcgtgtagttctgtcgacccgccgcagacaccgaccgtctacttactgtgcgagagttcggccccatacgtaccagcctgtccttccgcctagtcgtcttttgattatcggtggggaccgaaagggactaagtcggtctaccgtctctcacgtccctaccgaccgaacgggtcccctacgtccgttcccttccccgtcgccctaccctcccgtaccaacgccgtacctaccgtcggtcggggacaccgacggcccggtcccgtcggccgtcggtccgtcggtaccgtaacggtaccttaccgtacctacgttactaaccgtaccgttacgtacggtacggcccgggtacgtcgggtcggaacggtaccgg

SEQ ID NO: 188519 - DNA, 664 bp, Homo sapiens
  misc_feature: GYAE6OF01EF3HK.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgcatatcagtagacacgtccaagaaccagttctccctgaagctggtagttctagtcgaccgccgcagaccgacggccgttctattactgtgcgagtacggttcggcccctatacgtaccagtctcgtccttccgcattgtcttttgatatcgtggggaccaaggggacaagtcggtcctaccgttctcttcacgccctaccaccgaacgggcccctacgtccggttcccttccccccgtcggcccctaccccgttccccttaccgaacgtacgaccctacccgtccggtcgggggtaccacggacgggacccgggtcccgttggggcctcggcccgtacgggtacctaaacgggtaccttacccgttaccgtacttacccttaaccctaaccgttacggtacgtaccgggtcggggtaccgtgggtaccgaacgggtaccgg

SEQ ID NO: 188520 - DNA, 718 bp, Homo sapiens
  misc_feature: GYAE6OF01BA869.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaataggtcgggcccaggatggtgaagccttcggagaccctgtccctcacctgcactgtctctgttactccatcagctagtggttactacgtggggctggtacgtccggcaccggccccggaaggggaacgggcgtgggaggtggagttgggtactatccgtctacgagtaggtgggactccacctaactactaaccccgtcctagaacggacgtacgacggccgaccatactacgagtaacgacctaacgtaccaaacgtaaaccgtacgttcctacccgtagaacgtcttaggtacgtttccgtcggtacggaacccgtcgaccgacggaaccgaccggtacccgttccttaagtttaccgcggttggaccgtaagggtaccggttaccgggtacccctaagttaaccgtaaccgtacggtccttaccggttccgttacccgcccgttagttaccggtttaccgtttttcggaacgtttaccggtaccgggttaccgggggaacccgaaaggggttaaccctaggtttccggggtacccttacccgggttcctttaccccgg

SEQ ID NO: 188521 - DNA, 652 bp, Homo sapiens
  misc_feature: GYAE6OF01ADKS0.37.2.A02.1.454.CMB.1.raw
  modified_base (322)..(322): a, c, t, g, unknown or other
  misc_feature (322)..(322): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtcccctcacctgcactgtctctggttactccatcagctagttggttactacgtggggctggatccggcacgcccccgaggggaaggggcgtggagtggattgggactagtctctcataggtggganctacctactactaaccccgtccctacaacgagtcgacggcgcatactcagtagacacgtaccaaacggaacctacgttcctcccgtagacgtctgacgttctcggtcgacccgtccgacacgaccgacggtccgtcttattcctggtcgcgacggtgttaccggcccctaagttacgtaccgtacgtccgttacgttccgttcccgaccttacgttcgttaccgtttttaggaacgtttacggttccgggttacgggggtaacccggtaaacgggggtacccttaaacggttaccgggttaacccgtacccggtttccgtttaaccccgg

SEQ ID NO: 188522 - DNA, 649 bp, Homo sapiens
  misc_feature: GYAE6OF01EWVOA.37.2.A02.1.454.CMB.1.raw
  modified_base (322)..(322): a, c, t, g, unknown or other
  misc_feature (322)..(322): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagctagtggttactacgtggggctggactccggcacgccccgaggggaagggctggagtggagttgggactatctctacgagtaggtgggacncctaacctactactaaccccgtccctacgaagacgtcggacggcgacctatactcgagtacgacaccgtaccaagaacctagttcctaccctagaacgtctagtagttctggtacgacccgccgacgaacgaccgaccgggtccgtactacttacgtcgtcggcggtaacggtacggttaccggaccccctaagttaccggtacctacggtccgttcggttcccttacccgtcctacgttcggttactttttaggaattacggttccgggtacggggaacctaaacggggtaactaacggttacggtaccgtacccgttcttacccg

SEQ ID NO: 188523 - DNA, 568 bp, Homo sapiens
  misc_feature: GYAE6OF01B5IGX.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatcgtggggccaagggacaatggtcaccgtctcttcacgcctccaccaacgggccccactccggtccttcccccgtcggccacccctcctcccaagacgccaccctcgtcgggggcacgacggccggcccgtgggctcggcccgtggtaccgaacggtacctaccgttcccatcctaccacctacgtgacggcgggctcgggcgaacgggccg

SEQ ID NO: 188524 - DNA, 644 bp, Homo sapiens
  misc_feature: GYAE6OF01EAXJ9.37.2.A02.1.454.CMB.1.raw
  modified_base (525)..(525): a, c, t, g, unknown or other
  misc_feature (525)..(525): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgagggcgccatatcgagtagacacgtccaagaaccagttctccctgaagctgacgtttctgtgaccgccgcagacacggccgtctatactgtgcgagagttggccccatacgtaccagctgtccttccgcctatcgtcttttgattatcgtcggggtaccaaggggacctaagtggtaccaccggttccttccgttcacgtccccttacccaacccgaaacgggtcccccacgttcccggttacccttcccccccgtggtccctaccccgtccctacccaacggaccgcgaccctcgcgggggaccncggacggccggccccgtgggcctcggtccgtggtaccgaacgggtaccttaccgttccgtattcccgtacgtacccttacgtacggtacggccgggtacgtcgggtaccgacgggaccg

SEQ ID NO: 188525 - DNA, 678 bp, Homo sapiens
  misc_feature: GYAE6OF01BOCHL.37.2.A02.1.454.CMB.1.raw
  modified_base (322)..(322): a, c, t, g, unknown or other
  misc_feature (322)..(322): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagctagtggttactacgtgggctggacgtccggcacggccccgaggggaagggcgtggagtggagttgggactatctctcagtaggtgggacncgacctactaacctaacccgtccctacgaagtcggtacgacggccgaccattacgtacaacgtaacgaccgtaacgtaccgaaacgtaaccctacgttaccctaccgtagaacgtctaggtacgtttcgtagtacggtacccgaccgacaccggacgtaccggtcccgttacttacggttactcggtagaccggtagtaccggttaccgggacccctaagttaccgtaccctacgtcgttacgttacccttccgaccttagttaccgtttcgtttagtaactttacgtcgggtaccggggtaaccggaaacgggtacctaaaggtttccgggtaacccgtaccgttccttacccgg

SEQ ID NO: 188526 - DNA, 532 bp, Homo sapiens
  misc_feature: GYAE6OF01CS3YF.37.2.A02.1.454.CMB.1.raw
  modified_base (388)..(388): a, c, t, g, unknown or other
  misc_feature (388)..(388): n is a, c, g, or t
  modified_base (521)..(521): a, c, t, g, unknown or other
  misc_feature (521)..(521): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaaagaaccagttctccctgaagctgagttctgtgaccgccgcagacacggccgtctattactgtgcgagagtggcccatagtaccagctgcttcgccatgcttttgattatctggggccaagggacaatggtcaccgtctcttcngcctccaccaacgggcccacgtcgtccttcccctcgccaccctcctccaacgcgccacctcgcggggcacgagccggcccgtcgggctcgcctggtcaacggactaccgtccatcctacactcacgagcgggntcggcgaggcg

SEQ ID NO: 188527 - DNA, 657 bp, Homo sapiens
  misc_feature: GYAE6OF01BE7R2.37.2.A02.1.454.CMB.1.raw
  modified_base (358)..(358): a, c, t, g, unknown or other
  misc_feature (358)..(358): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtggttactacgtggggctggatccggcacgccccgagggaagggctggagtggagttgggactagtctctcataggtggagcacctactactaacccgtcctacaagagtcgaggcgcagtacncgagtagacacgtaccaaagacctagttcctacccgtagaacgtctagtacgtttcgtgtcgacccggtccgacgaacgaccgaccgggtcccgttacgttacgttaacgtggttacggcggaacggtacggtttccggaccccctaagttaccgtaaccgtaggtcctttacggtccctttcccggacccttaagttccgtttacgtttttacggaattaacggttccgggtacgggggaaccctaaacgggggtactaaacggttccgggttaacctaacccggttcctttaacccg

SEQ ID NO: 188528 - DNA, 558 bp, Homo sapiens
  misc_feature: GYAE6OF01EAKMK.37.2.A02.1.454.CMB.1.raw
  modified_base (456)..(456): a, c, t, g, unknown or other
  misc_feature (456)..(456): n is a, c, g, or t
  modified_base (535)..(535): a, c, t, g, unknown or other
  misc_feature (535)..(535): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaccagttctccctgaagctgagttctgtgaccgccgcagacacggccgtctattactgtgcgaggtagttcggcccatagtaccagtctgtccttccgccatgtctttgatatcgtcggggccaagggacaagtggtaccaccgtctctcacgtccctccacgacggcccagtccgtcctccccgtcggccctaccctcctaccacgcncgtaccgtcgtcggggacacgacggccggcccgtgggctcgccgtggtccgacgtactacctccatcctacacgtacgngtacggcgggatcggcgacggcg

SEQ ID NO: 188529 - DNA, 667 bp, Homo sapiens
  misc_feature: GYAE6OF01BJUQQ.37.2.A02.1.454.CMB.1.raw
  modified_base (304)..(304): a, c, t, g, unknown or other
  misc_feature (304)..(304): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctccagatgggtcctgtcccaggtgcaactgacaagtacgtcgggcccaggaatggtgaagccttcggacgaccctgtccctcacctgcactgtctctggtactcatcagcagtgttactacgtgggctggactccggcacgccccgagggacgggcgtggagtggagtgggactatctctnacgtagtggagcaccgtactacgtaacccgtcctacgagacgtcgacggcgactatactacgagtacgacgacgtaccaaacgaacctacgttccgtacctagaacgtcgtacgtaacgtttccgtacggtacgacccgccgacgtaacgaccgtaccgggtccgttacgtaacgtttaccgtcggtacggaccggtaaggtacggttcccggacccctaagtaccgtaaccgtacgttccgttacgttccctccggacctacgttcgttaccgttttgaacgtttcggtaccgggtacggggtaacccgtaaagggttaaccgtaggttaccgggttaccctacccggtttcccttacccgg

SEQ ID NO: 188530 - DNA, 729 bp, Homo sapiens
  misc_feature: GYAE6OF01CGT1K.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagctagtggttactacgtggggctggactccggcacggcccccggaaggggaacggggcgtgggagtggagttgggactatctctcagtaggtgggacgccaacctactaacctaaccccgtccctacgaaggacgtacggacggccgacatactcgaagtacgaactacgtaccaaacgaacctacgttcctacctagaacgtctaggtacgttcgtcgtacgacccgacccaacgacggaccgtaccgggtcccgttacttaacgttaccgttggtacggtaccggtaaggtaccggtttaccgggaccccctaaagttacccggttaacccgtacggttcccgttacgtttaccccgttaccccggtaccgttacgtttcgtttaccgtttttaggtaactttaacggttccgggttacggggggtaacccgtaaaacggggggtaaccctaaacgggttccgggttaaccccgttacccgtttcccgtttaccccg

SEQ ID NO: 188531 - DNA, 665 bp, Homo sapiens
  misc_feature: GYAE6OF01BLLQ6.37.2.A02.1.454.CMB.1.raw
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtggttactacgtggggctggactccggcacgccccgagggaaggggctggagtggagttgggactatctctcagtaggtgggancacctactactaacccgtcctnaagngtcgagcgccatatcagtacgacacgtaccaaagaacctagttcctccctaggaacgctagtagttctcggtcgaacccggtccgacgaacgaccgtaccgggtccgttacgttaacgtttaccgtggttacggaccgggtaaggtaccggtttaccggaccccctaaagttaccgtaacccgtaggttcccttacggtccctttacccgcccttaacgttccggttacgttttttacggaatttaccgttccgggtacgggggtaaccccaaaggggtaacctaacggttacgggtaccctaacccggttccgttacccg

SEQ ID NO: 188532 - DNA, 567 bp, Homo sapiens
  misc_feature: GYAE6OF01BIEYI.37.2.A02.1.454.CMB.1.raw
  modified_base (256)..(256): a, c, t, g, unknown or other
  misc_feature (256)..(256): n is a, c, g, or t
  modified_base (544)..(544): a, c, t, g, unknown or other
  misc_feature (544)..(544): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaccagttcnccctgaagctgagttctgtgaccgccgcagacacggccgtctattactgtgcgagagttggccccatacgtaccagctgtcttccgccatgtcttttgattatcgtggggccaaggggacaagtggtcaccgtctcttcacgcctccaccgacgggcccctactccggtccttcccccgtcggccacccctccctccaacgacgccacctcgtcgggggccacgacgccggcccgtcgggtcctcggccgtcggtacgaacggacctaccgttccatcctacactacncgtacgcgggctcggcgaggccg

SEQ ID NO: 188533 - DNA, 669 bp, Homo sapiens
  misc_feature: GYAE6OF01CSNHL.37.2.A02.1.454.CMB.1.raw
  modified_base (330)..(330): a, c, t, g, unknown or other
  misc_feature (330)..(330): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagcctcccagatgggtcctgtcccaggtgcaactgcaataggtcggccaggaatggtgaagccgttcggacgaccctcgtccctcacctgcactgtctcgtgtactcatcagctagttcgtactacgtgggctgacgtccggcgaccggaccccggaggggaaggcgtaggagtcggtagttggaaccttagtcctcgtacgagttaggnggacgacctaaccgtaccgtaacgtaaccccgtccctagaacgtcgtacgacggccgacctaattacgtacaaggtaacaactaacccggtaccaaaacgtaaccttacgttcccgtacctaggaacgtccgtagtaccgttcgtacggtacgacccgtacgacgaccgtaaccgccggtccttacgtaacgtttacgtggtacgcgtaagggtacgtccggacccctaagtaccgacctacggtccttcgtccgttccacgtcgttcgttacgttttagaacgttcgtacggcgggtaacccgaaggtacctaaggtccgtaccgtccgttctacccg

SEQ ID NO: 188534 - DNA, 574 bp, Homo sapiens
  misc_feature: GYAE6OF01AJROE.37.2.A02.1.454.CMB.1.raw
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaagaaccagttctcctgaagctgagttctgtgaccgccgcacgacacggccgtctattactgtgcgagagttcggcccatagtaccagctgtcttccgctatgtcttttgatatcgtgggaccaagggacagtcggtcaccgtctctcncncctaccaccgacggcccacgttccggtccttccccgtcgccctaccctcctaccaacgcgcaccgtcgtcggggacaccgacgccggccgtcgggcgtcgccgtcggtacgaacggtacctaccgttccgtattacctactaccgtacgtacgacgggccgggcgtcggcgtacgggccg

SEQ ID NO: 188535 - DNA, 559 bp, Homo sapiens
  misc_feature: GYAE6OF01CCLPI.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttacacgtggggctggactccggcacgccccgaggggaagggctggagtggagttgggactatctctcagtaggtgggagcacctactactaaccccgtcctacaagagtcgaggccgccatatcagtacgacacgtaccaaacgaacctacgttcctccgtagaacgtctaggtacgttctggtcgaccgccgacacgaccgaccggtcctactattacgtggtgacgagtacgttcggcccagtacgtaccagtctcgtctccgctagtgtctttgattacgtcggcgggtacgaaggtacagttggtctccgttctccg

SEQ ID NO: 188536 - DNA, 726 bp, Homo sapiens
  misc_feature: GYAE6OF01BCNMO.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctctgctggtggcagctccagatgggtcctgtcccaggtgcaactgacaataggtccgggcccaggaatgggtagaacgtccttcggacgaccctcgtccctcacctgcactgtctcttagtactccatcagctagtgttactacggtggggctggactccggcgaccggccccggtaaggggacgggcgtagggtaggtggtagttagggacttacgtctctacgagtacggtgggacacctaaccttaacgtaacctaaccccgtacctaacgaacgacggtcggaacggccgtaccgtataacgtacgaaggtaacgtaaccgtaaccgtaaccaaacggtaacctacgtacctacccgtagacgtcgttagtacgtttcctaggtaccgacccggaccgaaccgtaggaaccccgtacgggtacccttacgtaacttacggtcggtacgtacggtaacggtacggttacccggaccctaagtaacctaccgacgtccgttacgtcccgttcccacgttacttcgtttacgttttacgacgtttacggtccgggttaccggggaacctaaacggggtaccttaggttacccggttacccgtaccgttccgttaaccg

SEQ ID NO: 188537 - DNA, 898 bp, Homo sapiens
  misc_feature: GYAE6OF01ANM9L.37.2.A02.1.454.CMB.1.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
tcagtagtgtagatcacgaccggtgctcgatttagactcatctacagggtctcgaagccttcggagaccctgtccctcacctgcactgtctctggttactccactcagcacgtgttactacgtgggctggagtccggcagcccccagggaacgggcgtggaggtggagttggacgtatctctcatagtggngcacctactagtaacccgtcctacaagacgttcgacggcggccaacgttanccgtagtacgactaccggtccaaaagtaaccacggtttccnccgttacgaagtactcgaacgtttcgtggttcgacccgaccgcgacgaccgaaccgggtcccctacgtacgttttaaccgtcggttcggaccggtaggtaccggtttaccggggacccctaagttaccggtaacccgtacgtccgttacgggtttccttcccggccccgtaagttcggttcctttttcgggtaacttacgtttccgtacggggtaccgtaaacgggggtacctaaacggtttcggtaccgacccgtttacgtttcccgttaccgtacgtaccccgttaccgtaacccgaaccggggtaccccttaacccgtccggtttcccgtttacccccgcccgggttaccctacccccgttccgtttaccccgaacggaaacccgttccgaaacccttttccgggtacccggggtaccgttaacccggaccgggtccccgggtacccccggttgggcccgggttccgtaaccccggttgggtaccccgtaaaacgggttccccgtaaaccccggtttcctaccggttaccccgaaaccctttaccgttaacccggtaccggttaacgggaccccgggtacggttacccgggtaaccggtaacgggtcccggg

SEQ ID NO: 188538 - DNA, 575 bp, Homo sapiens
  misc_feature: GYAE6OF01EBMB8.37.2.A02.1.454.CMB.1.raw
  modified_base (399)..(399): a, c, t, g, unknown or other
  misc_feature (399)..(399): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttcctccctgaagctgagttctgtgaccgccgcagacacggccgtctattactgtgcgagagttcggccccatacgtaccagctgtcttccgccatcgtcttttgattatcgtggggccaagggacaagtggtcaccgtctcttcncgcctccaccgaacgggcccagtccggttccttcccccgtcggccctacccctcctccaagcgcaccgtcggcggggcacgacggccggcccgtgggcctcgcccgtggtccgaacggtaccttaccgttccattcctaccactacgtcggacggcgggactcgggcgagggtccg

SEQ ID NO: 188539 - DNA, 620 bp, Homo sapiens
  misc_feature: GYAE6OF01CMYVZ.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggccaggaatggtagaagccttcggacgaccctgtccctcacctgcactgtctctgttactccatcagctagtggttactacgtgggctggactccggcacgccccgagggaagggctggagtggatgggactatctcgtcgagtaggtggacgctaaccttactaacgtaaacccccggttccctacgaaaggtacgttacggacggccgacccaagttaactcgtaagtaacgaccaacgtacccaaaagaaccctagtttccctacccgtagaacgtcctggtagttaccgtggtaccgaccgccgtacgacgaccaaccggtcgtacgtacttactgtcgagagtacgtcggccctaagtacgtacgacgtcgtcgtccttccgctacgttgtacgttttgattcgtacggcgggtaccaagggtactaagtcggtacctaccgtcttacccg

SEQ ID NO: 188540 - DNA, 702 bp, Homo sapiens
  misc_feature: GYAE6OF01DFJMT.37.2.A02.1.454.CMB.1.raw
  modified_base (234)..(234): a, c, t, g, unknown or other
  misc_feature (234)..(234): n is a, c, g, or t
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
  modified_base (557)..(557): a, c, t, g, unknown or other
  misc_feature (557)..(557): n is a, c, g, or t
  modified_base (685)..(685): a, c, t, g, unknown or other
  misc_feature (685)..(685): n is a, c, g, or t
tcagtagtgtagatcacgaccggtgctcgatttagactcatctacagggtctccgaagccttcggagaccctgtccctcacctgcactgtctctggttactccatcagcagttggttactacgtggggctggatccggcacgccccgaggggaaggggctggagtggagttgggactatctctcagtaggtgggagcaacctactactaaccccgtcctacaagagtcgaggcncatactcagtagaacacgtaccaaagaaccgtagttcctcccgtagaacgcttaggtacgttctggtaccggacccggcccggcaacggaccgaccgggtcccgttacttaatttacgnggttcggacgaggtacgttccggacccctaagtacgtacccngtccttgtcccgtttcgcctagttcgtcttttagattacgtcgcggggacaagggtactaagtcggtccaccgttctcctcgacctcccgtaccaccgaccggtccctaccggttcccgtccccgttaccccgcggacccctaccctcccgtacaacgaccncctacccgtcggtcgggaccacggaccggcccggtcccgtcggaccgtccggaccgttcgggacctaaccgggtaccttacccgttaccgaccttacctaccgtaaccgttagcgggacggtcccggngtacgggccgaaggtcg

SEQ ID NO: 188541 - DNA, 614 bp, Homo sapiens
  misc_feature: GYAE6OF01EYC5U.37.2.A02.1.454.CMB.1.raw
tcagtagtgtagatcacgaccggtgctcgatttagactcatctacagggtctccgaagccttcggagacccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttcctccctgaagctgagttctgtcgaccgccgcagaccacggccgtctattactgtgcgagagttcggccccagtacgtaccagcttcgtccttccgctatcgtcttttgatatcgtggggaccaagggacagtcggtcaccgtctcttcacgtccctccgaccgaacgggccctacgtcccggtccttcccccgtcggccctaccccgtcccaccgaacgacgaccaccgtcgtcgggggaccacgacggcccggtcccgtcgggtcctcgtcccgtggtaccgaaacggtaccttaccttccgtactacctaccaccttacgtacggacggtaccgggcgtcgggcgacgggtaccg

SEQ ID NO: 188542 - DNA, 669 bp, Homo sapiens
  misc_feature: GYAE6OF01BTYX3.37.2.A02.1.454.CMB.1.raw
  modified_base (433)..(433): a, c, t, g, unknown or other
  misc_feature (433)..(433): n is a, c, g, or t
tcagtagtgtagatcacgaccggtgctcgatttagactcatctacagggtctccgaagccttcggagaccctgtccctcacctgcactgtctctggttactccatcagcagtggttactacgtggggctggatccggcacgccccagggaggggctggagtggattgggactatctctcatagtgggagcacctactactaacccgtcctcaagagtcgaggcgccatatcagtacgacaccgtccaaagaaccagttcctcctagaagctgacgttctgtcgaccgcgcagacacggccgtctattaccgtgtcgcggagtacggttccggaccccagtacgtaaccgagtcctacgttcctccgcctagttcggtcttttggacttagtcggtcgggaccgtaagggactaagtcggtcaccgtctctacncgcctacaccgacggccctagtccggtcctccccgtcgcctaccctcctaccgaacgccgacctacccgtcgggtccggggaccgtaccggacggtcccggtaccgtcgggtacctccggtacccgttcgggtaaccgaaccggttaacccttaccgttacccgtacttaacccttaccgtaaccttcggtacgggtaccgggtccgggtaacggtccgggaccgaaggtacccgg

SEQ ID NO: 188543 - DNA, 688 bp, Homo sapiens
  misc_feature: GYAE6OF01EY3BS.37.2.A02.1.454.CMB.1.raw
tcagtagtgtagatcacgaccggtgctcgatttagactcatctacagggtctccgaagccttcggagacccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtaccaagaaccagttcctccctgaagctgagttctgtgaccgccgcagacacgaccgtctattactgtgcgagagttcggccccatacgtaccagctcgtccttccgcctatgtctttgatatcgtcggggaccaagggacaagtcggtcaccgtctcttcacgtccctccaaccgacgggccccacgttcccggttccctttccccccgtcggtacccctacccccgttccctaccccgaaacgtaccgtaccccgtacccgttccgggtcgggggaccctaaccggaccggtccccggggtaccccgttcggggacccgtcggtcccgttacgggtaccgtaaacgggtaccctttaaccgttaccctaagttacccttaaccgtaccgttaaccgtcgggtaaccgggtccggggtacgtccgggaaccgtaacggggtcccg

SEQ ID NO: 188544 - DNA, 677 bp, Homo sapiens
  misc_feature: GYAE6OF01EE833.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccgttcggagaccctgtccctcacctgcactgtctctggttactccatcagcagtggttactacgtggggctggactccggcacggccccgaggggagggctggagtggagttgggactatctctacgagtaggtggacgccaaccttactaacgtaaccccgtcccgtacaagtacgtcgacggcgacatactcaagtacgacctacgtaccaaacgtaacctacgtttccctacccgtaggaacgtcgtaggtacgtttcgtacggtaccgacccggccgacgacgaccgtaccggtccgttacttacttacgtggtcgcggtagtacgttccggacccctaagttaccgtaaccctagtccgttacgttcccgttcccgaccgttagttcggtttacttttaggtaactttacggttccgggtaacgggggtaacccgtaaaacggggtaccttaacggttccgggttacccgtaacccggtttcgttacccg

SEQ ID NO: 188545 - DNA, 618 bp, Homo sapiens
  misc_feature: GYAE6OF01BK4L2.37.2.A02.1.454.CMB.1.raw
  modified_base (320)..(320): a, c, t, g, unknown or other
  misc_feature (320)..(320): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactacgtggggctggactccggcacgcccccgaggggaagggctggagtggagttgggactatctctcgagtaggtgggancctacctactactaaccccgtccctacaacgacgtcgacggcgaccatactacagtacgaccacgtaccaaacgaacctacttcctccctagaacgtctgtagttctagtcgaccgccgacgacgaccgacggtccgttactacgttactggtacgcgtagtacggttccggacccagttacgacctagtctcgtaccgttccgaccgtcttcgttcgttttacgagttacttcgggtaccggggtacccgaaagggtactaaacggttggtccccgtaacccggttccgttaccccg

SEQ ID NO: 188546 - DNA, 632 bp, Homo sapiens
  misc_feature: GYAE6OF01BQNQ6.37.2.A02.1.454.CMB.1.raw
  modified_base (262)..(262): a, c, t, g, unknown or other
  misc_feature (262)..(262): n is a, c, g, or t
  modified_base (615)..(615): a, c, t, g, unknown or other
  misc_feature (615)..(615): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaagaccagttctcctgaanctgagttctggtcgaccgccgcagacacggccgtactatttacgtggtcgacggaggtagttcggacccctagtacgtaccagtcctgtccttccgcctagtcgtcttttgattactcggtacggggacctaaaggggactaagttcggtaccacccgttcttaccttcacgtccctccgaaccgaacgggacccctagtccggttcccttacccccgtggtaccctacccctcctaccgaacgtcgacctaccgtcggtcggggaccacgacggtccggtccgtcgggtctcggccgtcgggtactaacggtaccttacgtcccatcctaactacgtacgtgacggtacggngtacgggcgaagggtcc

SEQ ID NO: 188547 - DNA, 688 bp, Homo sapiens
  misc_feature: GYAE6OF01AT3EY.37.2.A02.1.454.CMB.1.raw
tcagtagtgtagatcacgaccggtgctcgatttagactcatctacagggggctttctgagagtcatggacctcctggtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatccagctagttggttactacgtggggctggtactccggcacggcccccgaaggggaacggggccgtgggagtggagttgggactacgtctctcagtaggtggacgcacctacgtactaacccgtccctacacggacgtcgaggcgacatactacacgtaacgacgacgtaccaaacgaaccacgttacctaccctagtaacgcgtagtaagttccgtcggtacgaaccggtccgacgacgtacccgaccggacccgttctacttaccgtggttcggaccggtacgtacggtttaccggccccgtaaagtacgttacccgacggtccgttccgttaccgttcccggtacctaacgttacggttccgttttttacgaacctttacggttccggttacgggggtaacccgtaaacggggaacttaacggtacgggttaccctaccccgggttctttaccccgg

SEQ ID NO: 188548 - DNA, 663 bp, Homo sapiens
  misc_feature: GYAE6OF01AEA94.37.2.A02.1.454.CMB.1.raw
  modified_base (463)..(463): a, c, t, g, unknown or other
  misc_feature (463)..(463): n is a, c, g, or t
  modified_base (536)..(536): a, c, t, g, unknown or other
  misc_feature (536)..(536): n is a, c, g, or t
  modified_base (641)..(641): a, c, t, g, unknown or other
  misc_feature (641)..(641): n is a, c, g, or t
  modified_base (651)..(651): a, c, t, g, unknown or other
  misc_feature (651)..(651): n is a, c, g, or t
tcagtagtgtagatcacgaccggtgctcgatttagactcatctacagggtctccgaagccttcggagaccctgtccctcacctgcactgtctctggttactccatcagcagtggttactacgtgggctggatccggcacgccccgagggaagggctggagtggattgggactatctctcatagtggagcacctactactaacccgtccctacaagagtcgaggccgccatatcagtacgacaccgtaccaaacgaacctagtttcctccctagaagtctggtacgttctggtcgacccgccgacacgaccgaccggtccgttcttaatttaccgtgtcgcgtaggtacggttccggacccctagttacgtacccacgtccttcgttcccttccgcctagttcgttcttttagacttacgtcggtacgggaccgaacgggactagtcgtcctaccgttctctcnccgtccctacccgaaccgaccggccctacgttcccgttcccttccccgcgtcccctaccctcctaccgacgcncccgtaccgtcgggcgggaccacggccgggtcccggtccgtcgggtcctcgtccggtacgtaccgtaaccgtaccttacctcctaacttcctacgtaccgtacgnggacggcggngcggacgcggac

SEQ ID NO: 188549 - DNA, 692 bp, Homo sapiens
  misc_feature: GYAE6OF01EIAEC.37.2.A02.1.454.CMB.1.raw
  modified_base (338)..(338): a, c, t, g, unknown or other
  misc_feature (338)..(338): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtagaacgtccgttcgggacgaccctcgtcccctcacctgccactgtctctcggttactccatcagctaggttggttactacgtggggctggactccggccaccgccccggaggggagggcgtaggaggtggagttgggactatctctcgagtaggtgggacncctacctaactaccgtaaccccgtccctacgaaggtacgtcggacggaccgtaccatacgacagtaacgacctacgtacccaaacgtaaccctacgttcccttacccgagtaacgtcgttagtacgttcgtacgtacgaccgccgacgacgaccgaccggtaccttacgttacgtaccgtggtacgtcggtaacgtccggtaccggaccctaagtaccgtacctcggtccttaccgttccgtacccgtcgttacgttccgtttacgttttagacgtttacgttccgggtacggggtacccgtaaaacggggtaccttaacggttaccgggttaccctaccgttcgttaccccgg

SEQ ID NO: 188550 - DNA, 759 bp, Homo sapiens
  misc_feature: GYAE6OF01D95NF.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatcgggtcctgtcccgaggtgacaactgacaatagtccgggcccaggaatgggtagaacgccgttcggacgacccctcgtcccctcacctgccacttgtctcgttcggttacctccatcagctaggttcggttactacgtggggctggctccggccaccggccccggaggggacgggcgtggaggtggtagtgggtactatctctacgagtggtcgggacgacctacctaactaacctaaccccgtcctacgagacgtacgaggccgacctaagtactcgaagtacgaccgtaacgtaccaaacgtaaccgtaccgttcctaccgtagaacgtcgtagtacgttcgtcggtacggacccgtccgacgacggtacccgaccgggtccgttactttaagttacgtggtacggacggtaacggtaccggtaccggtacccgtaagttaccgtaaccgtccgttaccgttccggttacccgttcccggactttaccggttacggttttacgtttttacgtaaagtttccggttaccggggtaaccgggggtaaacccggtaaaccggggttaaccgtttaaacccgggttcccggggtttaaccccgttccccgtttcccggtttaacccccgg

SEQ ID NO: 188551 - DNA, 618 bp, Homo sapiens
  misc_feature: GYAE6OF01CTJQP.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactactaacccgtcctcaagagtcgaggcgccatatcagtagacacgtccaagaaccagttcctccctgaagctgagttctgtcgaccgccgcgagacacggccgtctattactgtgcgagagttcggcccatacgtaccagtctgtcttccgccatcgtcttttgattatcgtgggaccaagggcaagtcggtcacccgtcttcttcacgtcctaccaccgaacgggtacccctacgtccggttcccttcccccgttcgccctaccccgttccctacccaacgtacgcccaccgtcggtcggggccacgacggccggtcccgtgggccgttcggccgttcgggtaccgtaaacggtaccttaccgttacctagttaccctacctactaccgttggacgggcgggtcgtcgggcgaacgggccg

SEQ ID NO: 188552 - DNA, 860 bp, Homo sapiens
  misc_feature: GYAE6OF01EK0DQ.37.2.A02.1.454.CMB.1.raw
tcagtagtgtagatcacgaccggtgctcgatttagactcatctacagggggctttctgagagtcatggacctcctgtgcaagaacatgaagcacctgtggttttcctcctgctggtggcagcctcccagatgggtcctgtcccaggtgcaactgcaataggtcgggacccaggaatggtgaacgtccttcggacgtaccctcgtccctcacctgcctactgtctcgtcggttactccatcagtcaggttcggttactacggtggggtccgtaggacgtccgggaccgaccggaccccccggaaggggaacggggtccgtagggtaggtacgggtaacgttacggggtaaccttaacgttccgttaccgtaccgtaggttaacggggtacggggaccgtacccgtaacccttaaccgttaaccccgttaaaccccgttccccgtaacgaaacggtaccggtaccggaacggccgtacctaacgtacgtaccgaacgtaaccgtaccgtaaccgtaacccgaaacgtaacccgtacgtttacccgtacccgtagaacgtccgtaggtacgttcgtacggtaccgacccggccgacgaaccggaccgtaacccggttccgttaacttacgttaccgtggttaccggacggtaacggttaccggttacccggtacccttaaggttaaccgtaacccgtacggttaccttaccgggttacccgttacccggtaccgttacgttaccgggtttacgttttaacgggtaccttacgggttcccggggaacccggggtaaccgaaaccggggttaaccggttacggttacccgggttacccgttaaccccggttccgtttaaccccgg

SEQ ID NO: 188553 - DNA, 721 bp, Homo sapiens
  misc_feature: GYAE6OF01D1136.37.2.A02.1.454.CMB.1.raw
  modified_base (189)..(189): a, c, t, g, unknown or other
  misc_feature (189)..(189): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccagggaagggctggagtggattgggactatctctcatagtgggancacctactataacccgtccctcaagagtcgaggcgccatatcagtagacacgtccaagaaccagttctccctgaagctgagtttcctgtcgaccgccgcagacacggccgttctattactgtgcggacgaggttcggccccattacgtaccagcttgtccttccgcctatcgtcttttgattatccgtggggaccaaaggggctaaagtcggtacctacccggttcttaccttcgtaccgtacccgttacccgaaccgtaaaccggggtaccccctaaccgttcccgggttacccgtttccccccgtccgggtacccctacccccgttaccccgtacccctaaacggaccgtcccgtaacccgtcggtccgggggtaccaaccggaccgtcccgggtacccggttccggggtcctccgggtacccggttcgggtaccgaaaccgggtaaccttaaccgtttcccgtaacttaccgttaaccaaccgttaacgtacggtacgggtcccggagttccgggacgacgggtaaccg

SEQ ID NO: 188554 - DNA, 980 bp, Homo sapiens
  misc_feature: GYAE6OF01CVVY0.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctccagatgggtcctgtcccaggtgcaactgacgaagagtccgggacccaggtaaagtgggtagaacgcccgttcgggaacgtacccgtcgtccccttacaacctcggactactgtcttcgttaggttaccttacccataccgagtaccgtaaggttacgggttaacctacggttgggggaccgttacgggtaacgtcccgggtaccgaaccgggtaaccccccggaaagggggaaacggggggtccgtaggggtaacggtagggtaacggtttacggggaaccttaacgttacctcgttacctaaggttagggttaggggacgtacccgtaaacccttaaaccgtttaaaccgtaaaccccccgttacccgtaacgtaaaacggtacggttaccgggaacgggttacccggaaccgttaaacttaacgttaaccgtaaacggttaaaccggaaacccgtaaccggtaaaccctaaaacgggaaaacccttacggtttaccccgtacccgttaaacggaacgtacgtttaacggtaacggtttccgtaaggtcccggaacccggtacccgaaacggtaacgaacccggtaaccgggtcccttaacgttaactttccggttaggcggaacggtaagttaccgggttacccggtaaccccttaaggttaacccgtaaccgacggttaccctttacgggtacccctttacccgggaccgttaaacggtttcggttaccccgtttttaagaacggttttaccggtaaccccggggttaaggggggaaaaccccttaaaagggggtacccttaaaacggggttcccggttaaacccggtcccgttttaccgttaaaccccccg

SEQ ID NO: 188555 - DNA, 982 bp, Homo sapiens
  misc_feature: GYAE6OF01CBFEQ.37.2.A02.1.454.CMB.1.raw
tcagtagtgtagatcacgaccggtgctcgatttagactcatctacagggtctccgaagccttcggagaccctgtcccctcacctgcactgtctctggttacctccatcagcagtggttactacgtggggctgggatcccggcacgcccccgaggggaagggctggagtggagttgggactatctctacagtagtgggagccaacctactaacgtaaccccgtccctacaaagtacggtcgaggccgaccatatcagtacgaacaccgtaccaaacgaccgtagttcctacccgtaggaaacgtctaggtacgtttctcggtcggaccccggaccgcgaaacggtaccccggaccgggttcccgtttaccgttaaagtttaccggtggttcggaaccgggtaagtaaccgggtttcccggacccccttaaagtaaaaccgtacccgtacgtccgtttccggttacccctttaccccggaccttaagtttcggtttaacccttttttagggaaacgtttacccggttcggggttaaacccgggggggaaaccctaaaacgggggggtaaccttaaacggggttccgggtttaacccctaaccccccgttttcggtttaacccctttacccggaaccccggtcccccttaaacccccggaaccccgggtaaaaccccgggtccccgttaaacccggttcccccgggttttaccccccctttacccccggtcccggttaacccccgtacccccgttacccccgtaacccgtaaccgtaccgtaccccggttacccggtcccggggtacgggggaaccctaccgggaaccccggtcccgggcccggttccggggtaccgtcccgggttacccggtacggtaccggtaaaccggttacccttacccgttacctacctacccggttaaaccctaccggttacgacgggtccgggtccggtaaccgggtcggtaaccggacggtaaccgg

SEQ ID NO: 188556 - DNA, 617 bp, Homo sapiens
  misc_feature: GYAE6OF01D4CFF.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcgaactgcaatagtcgggcccaggaatggtgaagccttcggagaccctgtccctcacctgcactgtctctcggttactccatcagcagtggttactacgtggggctggatccggcacgccccgagggaaggggctggagtggagttgggactatctctcagtaggtgggagcacctactaactaacccgtcctacgaagagtcgaggcgaccatatcagtagacacgtaccaaagaacctagttcctacccgtagaacgcgttaggtagtttcgtggtacgacccgccgacgacggaccgtaccgggtccgttactactttacgtggttcgacgtacggtacggttccggacccctaagttaaccgtaccgagtccttcggttccttcccgcctagttcgttcgtttttggacttacgtcggtacggggaccgaaagggtacaagttcgggtacctccgttcttacccg

SEQ ID NO: 188557 - DNA, 719 bp, Homo sapiens
  misc_feature: GYAE6OF01BFR4K.37.2.A02.1.454.CMB.1.raw
  modified_base (367)..(367): a, c, t, g, unknown or other
  misc_feature (367)..(367): n is a, c, g, or t
tcagtagtgtagatcacgaccggtgctcgatttagactcatctacaggggctttctgagagtcatggacctcctgtgcaagaacatgaagcacctgtggttttcctcctgctggtggcagctccagatgggtcctgtcccaggtgcaactgcaatagtcggccaggaatggtgaagccttggagaccctgtccctcacctgcactgtctctggtactcatcagcagtgttactacgtgggcttggatccggcacgccccgagggtaacggggctggacgtggaattgggactatacgttctccagtaggtagggacgtcgtaacctactactaacccgtctaccgaagtacgtcgaaggcacatacncgagtagacacgtccaaagaccagttccacccgtagaacgtctaggtacgttacgtacgttacgaaccgtcgacgaacgtccgtaaccgggtccttacgtaactttaacccgtggttacggacgtaagggtacgtttaccgggtacccccgaaggttaccggttaaccctaaggtcccgtttgttaaccccgtttccccgggacctttaaacccggttcggtttaccgtttttaaacggtccgtttaaaacgggtttccccggtaacggggggtacccccttaaaaaaggggggacccttaaaaccgggttgggttttaaccccgaaacccgggtttccctttaaacccggg

SEQ ID NO: 188558 - DNA, 758 bp, Homo sapiens
  misc_feature: GYAE6OF01CI2GO.37.2.A02.1.454.CMB.1.raw
  modified_base (350)..(350): a, c, t, g, unknown or other
  misc_feature (350)..(350): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctccagatgggtcctgtcccaggtgcaactgcaatagtcgggcccaggaatggtgaagccttcggagaccctgtccctcacctgcactgtctctggttactcatcagcagtgttactagtgggctggactccggcacgccccgaggggaacggggctggagtggtagttgggactatctctcagtaggtgggagcctaacctactaactaaccccgtccctacaacgngtcgacggcgactatactacgaagtaacgaccaacgtaccaaacgtaacctacgttacctaccctagaacgtcgttaggtacgttcgtacggtaccggaccggacccgtacgaacgacccgtaccgggtacccgttacgttaacgtttaaccgtcggtcggaaccggtaacgggttaaccggtttcccggggacccccttaaaggttaacccggttaacccgtaacgggtcccgttttacggttaccccgtttacccggtaccccttaacggtttccgttaccggtttttttacggaaattttaccgggttacccgggtttaccggggggaaacccgttaaacgggggtaaccgtttaaacgggtcccgggtttaaacccgtaccccggtttccctttaacccccggg

SEQ ID NO: 188559 - DNA, 714 bp, Homo sapiens
  misc_feature: GYAE6OF01DR5BK.37.2.A02.1.454.CMB.1.raw
  modified_base (314)..(314): a, c, t, g, unknown or other
  misc_feature (314)..(314): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgagccttcggagaccctgtccctcacctgcactgtctctgttactccatcagcagtggttactacgtggggctggactccggcacgccccgaggggaagggcgtggagtggagttgggactagtctctctagtaggnggagcacctactaactaaccccgtccctacgaagtacgtcggacggccgacctaatacgttacaagtacgacctaaccggtaccaaacgtaaccctagtttccctacccgtagaaacgtcttcggtaacgtttcgtacgtacccggtacccggaccgacgacggtaacccgaccggggttacccttacgttaacgtttcggtcggttcggaccggtaacggtaccggtttcccggaaccccctaagttaacccggtaccgtaacgttccgttacggtttcccgtcccgtacctacgtttgttacccgttttaggtaacttacggttccgggtaccgggggtaaccctaaaacgggggtcctaaacggttccgggttaacccaccggtttccttaacccgg

SEQ ID NO: 188560 - DNA, 670 bp, Homo sapiens
  misc_feature: GYAE6OF01B6WIS.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaaagaaccagttcctcctgaagctgagttctgtcgacccgccgcacgacaccggccgtactatttacgtgttcgcgaggtacggttcggacccctaagtacgtaaccgagtccgtcgtcctttcccgcctattcgtctttttgattagtccgtaggggaccaaggggactaagtcggtaccaccgttctcttcacgtccctaccgacccgaacggcccctacgttcccgtcccttcccccgtcgccctacccctccctaccgaacgaccgcctacccgtcggtcggggaccaccgacgggcccggtcccggtcgggccgtccggtccgtcggtaccgtaaacggtaccttaacccgttcctacttaccttacctacccgttacgtacggtacggtccggggtaccgtcgggaccggtaacgggaccg

SEQ ID NO: 188561 - DNA, 919 bp, Homo sapiens
  misc_feature: GYAE6OF01AIDWQ.37.2.A02.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaaggggctggaggtggattggggactatcgtactcagtagtggggancaccgttactactaacccgtccctacaagacgtcggacggcgaccatacgtcagtagaccgacgttaccaacgaacctacgtttaccncccgttagaacgcttacggtacgttcgtacggtcggtaacccgccggtacaacgaccgtaccggtacccggttctaacggtttactggttcgaccggtaggtacggttcggaccccctagttaacccggtacaacgggtccttacggtacccttacccggcccttaagtcgttacccgtttttgactttaacggttccggtcggggaacctaaacggggtacctaacggttaccggtacccgtacccggtttaccgtaccctttacccgtaacggtcccccgttaaccccgtaaaccggtacccgggttaccccctaaaccgggttttccccggtttaccccctttacccccgggcccggtacccccgttaaccccctttccccggtaccggttaaacccgacccggtaccccgtaaaccccgggttttcccgggaacggggtaacccccgacggaacccccggggtttccccggtacccgggtacggggttcccgtccccggttaacggttaccgggcccgtaaaacccgggttaccgtttaccccgtaccggttacttacccgtaaaaccgtccccggtttaagaccggttaccgggaccggtaccggtacgggtccggtaacggtaccccg

SEQ ID NO: 188562 - DNA, 646 bp, Homo sapiens
  misc_feature: GYAE6OF01EQDOP.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggaagaccctgtccctcacctgcactgtctctggttactccatcagcagtggttactacgtggggctggactccggcacggcccccgaggggaacggggctaggaggtggtagttagggtactatctctacgtagtaggtgggacgccaacctactaccgtaaccccgtcctacgaaggtacgtcggacggccgactatacgtacagtaacgaccgtacgtaccaaacggaaccgtacgtttcctacccgtagtaacgtcgttacggtacgttcgtacggtacgacccgtccgacgaacgtaccgaccggtccgtacttacgttctggtacgacggtagtacggttccggaccctagtaaccgtcgagtccgtcgtcctccgctagttcgttgtttacgagttacgtcggtacgggtaaccctaacgggtacctaggtaccgtacccgtccgttctaccg

SEQ ID NO: 188563 - DNA, 736 bp, Homo sapiens
  misc_feature: GYAE6OF01C5Q3R.37.2.A02.1.454.CMB.1.raw
  modified_base (151)..(151): a, c, t, g, unknown or other
  misc_feature (151)..(151): n is a, c, g, or t
tcagtagtgtagatcacgaccggtgctcgatttagactcatctacgagggggctttctgagagtcatggacctcctgtgcaagaacatgaagcacctgttggtttttcctcctgctggtggcagctccagagtcgggtcctgtcccaggtnacaactgacaagacggtcgggaccaggaatggtcgaacgccgttacggacgtaccctcgtccctacacctgcactgtctcgtgtactcatcagctagttgtactgtgggactgacgtcggacgacgccccgaggggacggtcgtaggagtggtacgttcgggacttacgtctcctataggttaggacgggactcctaaccttaacctaacccttaaccccggtacccacgaaacggtagtaccgaacggcctacctaatatacaacgtaacgtaccgtaaccggtacctaaaacgtaaccctacgtttacccaccgtagaacgtccggtaggttaacgttcgtacggaccgaacccggccgacgaccgtacgtaccggtaccgttactagtttacgtggtacgaacggtacgtacgttaccgaacccgttagtaccgtaccgcttccggttacgttcccgttacccggaccttagttcgttacgttttacggaacgtttacggttacggggtacccggggtaaaccgtaagggtaaaacccttaacgggttccccggttaacctaacccggtttccttaacccgg

SEQ ID NO: 188564 - DNA, 681 bp, Homo sapiens
  misc_feature: GYAE6OF01CDR2O.37.2.A02.1.454.CMB.1.raw
  modified_base (108)..(108): a, c, t, g, unknown or other
  misc_feature (108)..(108): n is a, c, g, or t
  modified_base (206)..(206): a, c, t, g, unknown or other
  misc_feature (206)..(206): n is a, c, g, or t
tcagtagtgtagatcacgaccggtgctcgatttagactcatctacagggggctttctgagagtcatggacctcctgtgcaagaacatgaagcacctgtggtttttccncctgctggtggcagctccagatgggtcctgtcccaggtgcaactgcaagagtcgggcccaggaatggtgaacgtccgttcggacgaccctgtcccctnacctgcacgtgtctctggtactcatcagctaggttcggttactacgtgggtctggactccggcacgccccgagggacggcgtagggagtggagttcggactacgtctcgtacgagtaggtgggacgcgtacctactaacgtaccccgtcctacgaagtacggtacggacggaccgcctaagtactcgtaacggtaacgaaccgtaacccgtaccgaaaaccggtaacccgtacggtttcccttacccgtaggaacgtccgttacggtacgtttcgtacggtcgacccggcccgacgacggaacccgtaccggtcccgttactaacgttcgtggtacgtacgacgtacggttccggacccgtagttacggtaacccgtggtacccgttgtacccgttccgtacctagttccgttacgtttagacgttacgtcggtacggaccgtaacggtactacggtcggtcctccgttctccgg

SEQ ID NO: 188565 - DNA, 697 bp, Homo sapiens
  misc_feature: GYAE6OF01BPH2B.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctccagatgggtcctgtcccaggtgcaactgcaagacgtcggccaggaatggtgaagtccttcggacgaccctgtccctcaccgtgccactgtctcgtgttacctccatcgagcgtagttcggttactacgtggggctggacgtccggcaccgccccggaggggacggtcgtaggacggtggtacgttgggactagtcgtcgtacgtagtaggtgggactccgtaaccttacgtacctaaccccgtcctacgaacgtacgtacggacggaccgacctaatacgtacgaacggtaacaaccgtaaccgtaccaaacgtaaccgtacgttacctaccgtagaacgtcgtcgtacgttcgtgtaccgtacccgccgtacggaccgtacgtacccgggtccttaccgttagtaccgtcggttacggaccggttaagtccggttacccggaccctaagttaccgtaccgtacgtccgttacgtcccgttacccgtcttacgttacgtttactttcggaacgtttaccggtcgggtacgggaaccgtaagggacctaggttcgtaccctcgttaccttacg

SEQ ID NO: 188566 - DNA, 694 bp, Homo sapiens
  misc_feature: GYAE6OF01BBE4G.37.2.A02.1.454.CMB.1.raw
  modified_base (664)..(664): a, c, t, g, unknown or other
  misc_feature (664)..(664): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaaggggctgggagtggattgggactatctctcatagtggggagcacctactataacccgtcccgtcaacgagtccgaggcgccatatcagttagaccacgtccaagaaccgagttctaccctgaaagtctgtagttctagtgaaccgccgcagacaccggccgtctatttacctggtgcgagtagttggccccagtacgttacccgagtctcgtcgttcccgtccattgtctttttgacttagtcgtgggccaagggggacaagttcggtcgtaacccgtcttaccgttcacgtccctacctaacccgaaacggggcccctaacgtcccgggttccctttccccccggtggccccgtaccccttcccgtacccaaacggtcgtacctacccgcgttcgggggacctaaccggacggtcccgggtccccgtggggacccttcggaccgttcggtaccggtaaacggtacctacccgtttcccgaacttcccggtaacctaccgtacgttacgggngttacccgggaccgttcggacacgggtacg

SEQ ID NO: 188567 - DNA, 816 bp, Homo sapiens
  misc_feature: GYAE6OF01B2XLT.37.2.A02.1.454.CMB.1.raw
  modified_base (403)..(403): a, c, t, g, unknown or other
  misc_feature (403)..(403): n is a, c, g, or t
tcagtagtgtagatcacgaccggtgctcgatttagactcatctacagggggctttctgagagtcatggacctcctgtgcaagaacatgaagcacctgttggtttttcctcctgctggtggcagcctccagagtcgggtcctggtcccaggtcgccaactgacgaaggacggtccggaccaggaagtcggtagaacgtccgttcgggacgtacccctcgtcccctacgaccgtcgcctacttcgtccttcgttacggttacctaccgatccgacgtacgtaggttacggttaccgtacggtggggtcgtaggaccgtcccggaccgacccggaccccggaaggggacgggtcgtagggtaggtcggtagttcggaacttcgttcctacgtacgtaggttacggnggaaccgtactaacctaaccgttaacccgtaaccccgtcccgtaacgtaacggtacgtccggacggccgtactaacgtacgacgtaacgtaacgaacccgtaaccgtaccgtaaacgtaacccgtacgtttccctacccgtaaggtaacgttccgtaacggttcgttccgtacggtaccccgacccgaccgacctaaccgggacccgtacccggttccggttaacctttacggtacgttcggacggtaaccgtaacggtccgttacccggaaccgtacgttaaccggttaccgtcgttacccgttccggttaccccgtacccgttacgtacgttacgttcctttaggtaacctcggtcccgggacgggaaccgtaacggtaacgttacgtccgtaacctccgttccttacccg

SEQ ID NO: 188568 - DNA, 574 bp, Homo sapiens
  misc_feature: GYAE6OF01AOAJF.37.2.A02.1.454.CMB.1.raw
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagtagtgtagatcacgaccggtgctcgatttagactcatctacagggtctccgaagccttcggagaccctgtccctcacctgcactgtctctggttactcatcagcagtggttactactggggctggatccggcagcccccagggaaggggctggagtggattgggactatctctcatagtgggagcacctactataacccgtccctcaagagtcgaggcgccatatcagtagacacgtccaagaaccagttcctccctgaagctgagttctgtcgaccgccgcacgacgacggccgttactatttacgtgtgcgagtaggttcggcccatacgtaccagtctcgtcttccgccatcgtcttttgattacgtcgttcgggaccgtaagggactaagtcggtccaccgttctacttcacgcctaccaccgacggccctacgtccgtccttccccncgcccnccctcctaccaacgcgccaccgtcggtcgggacacgcgccgccgtggcctcgccgtgtcaacggtctaccgtccatcctacactacgtcgacggtcggactggccgaggccg

SEQ ID NO: 188569 - DNA, 615 bp, Homo sapiens
  misc_feature: GYAE6OF01AO9RA.37.2.A02.1.454.CMB.1.raw
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
  modified_base (574)..(574): a, c, t, g, unknown or other
  misc_feature (574)..(574): n is a, c, g, or t
tcagtagtgtagatcacgaccggtgctcgatttagactcatctacagggggctttctgagagtcatggacctcctgtgcaagaacatgaagcacctgtggttttcctcctgctggtggcagctccagatgggtcctgtcccaggtgcaactgacaatagtcgggcccaggaatggtgaagccttcggagaccctgtccctcactgcactgtctctggttactccatcagctagtggttactacgtggggctggactccggcacgccccgaggggaagggctgggagtcggagttcgggacttagtctacgtcagttaggtgggacacctacctactaccttaaccccgtcctacgaagtacgtcggacgccgactaatacgtactaagtacgtactaccgtaaccaaacgtaaccgtagttacctaccgtagaacgtccttaggtacgtttcgtcggtcgtacccggctccgaacgacccgacggtcccgttactaacgtttacctggtcgacgtaggtacgtcggtacccagttaccgtacgacncgttctccgttcncctattcgttctttnacttagccggtagggacagggtacagtcgactcgtctaccg

SEQ ID NO: 188570 - DNA, 725 bp, Homo sapiens
  misc_feature: GYAE6OF01C3WB8.37.2.A02.1.454.CMB.1.raw
  modified_base (359)..(359): a, c, t, g, unknown or other
  misc_feature (359)..(359): n is a, c, g, or t
  modified_base (621)..(621): a, c, t, g, unknown or other
  misc_feature (621)..(621): n is a, c, g, or t
tcagtagtgtagatcacgaccggtgctcgatttagactcatctacagggggctttctgagagtcatggaccctcctgtgcaagaacatgaagcacctgtggtttttcctcctgctggtggcagcctcccagagtcgggtcctgtcccaggtgcaactgcaataggtccgggcccaaggaatcgggtgaacgcccgttacgggacgaccctcgtcccctcacctgccactcgtctcttggttacctccatcagcgtaggttcggttacgtagtggggctggactccggcgaccggccccggaaggggacggggcgtgggacgtggagttgggacttatctctacgtagtaggtcgggacncctaaccgtaccttaaccgtaaccccgtccctaacggaacggtcggtaaccggacggccgtacctaattacgtacgtaaagtaccgaccgtaaccgaacccgaaaacgtaccctaaggtttcccaaccgttacggaacgttccgtaggtaacgtttccgtacggaccggtacccgaccggaccgaacgaccgtaccgggtcctacgtacgtttcgtggtcgtacggaggttaccgtaccggccccttaagtaccggtaccgngttccggttctacccgttccctactcgttcgttcgtttacgagttcgtccggggtacgggtaaccgaacggtaactacggttcggtaaccctcgttccgtaccg

SEQ ID NO: 188571 - DNA, 864 bp, Homo sapiens
  misc_feature: GYAE6OF01B5G32.37.2.A02.1.454.CMB.1.raw
  modified_base (156)..(156): a, c, t, g, unknown or other
  misc_feature (156)..(156): n is a, c, g, or t
  modified_base (775)..(775): a, c, t, g, unknown or other
  misc_feature (775)..(775): n is a, c, g, or t
tcagtagtgtagatcacgaccggtgctcgatttagactcatctacagggggctttctgagagtcatggacctcctgtgcaagaacatgaagcacctgtcggtttttcctcctgcctggtcggcacgctcccgagatcgggtcctcgtcccagggtnaccgaatcgactaaagtcggtccggggaccctaagggtaatcgggtagaaccgtccgtttacggaaccgtcccgtcgtcccctcaccgtcggacctacgtgttcctacgttacggtacctcaacgtccgtagtccgtaaggttccggttaaccgttacggcgggggtctacggaccgtacccggccaacccgggtaccccgggtaagggggtaccggaccggtaggtaccgggtaggtaaacccggttgggacccttaacgttccgttaccgtataacgggttaacggtacggggtaacctccgtaaaccccgtacgtttaacccgtaaccccccggttacgaacgttaaaaccgggtcggttaccgggaccggtaccgtaccgttaacggttaacggtacgtaacgttaaaccggaacccgttaacccggttaaaccgtaaaccgtaaaccgttcccgttaacccgtacccggttaaggaaccgttccgtacgttaacgggtttccgaacgtaccgggaccccgtaccggaactaacccggtaaccgtcccgttaaccggttatacggtacgttcggacgtaccgtaaggttccggtacgaaccctagtcgaacttcncgttacgtcctacggcctagtggtttacctggcttaacggtccgaagggtaccgagtacgttacgaccgtacgtacccgttgtaacccg

SEQ ID NO: 188572 - DNA, 849 bp, Homo sapiens
  misc_feature: GYAE6OF01D1E05.37.2.A02.1.454.CMB.1.raw
  modified_base (716)..(716): a, c, t, g, unknown or other
  misc_feature (716)..(716): n is a, c, g, or t
tcagtagtgtagatcacgaccggtgctcgatttagactcatctacagggggctttctgagagtcatggacctcctgtgcaagaacatgaagcacctgttggtttttcctcctgctggtggcagcctccagagtcggtcctcgtcccgaggtcgacaactgactaagtacggtccgggacccgaaggtaagtgggtagtaacgtcccgtttacgggactacccgttcgtcccctacaccgtcgacctacgtcgttccgtcgttacggttacctccatacgacgtccgtaggttcgggttaaccgtagggtcggggtccggtacggtaccggtacccggaccgaccggacccccgggtaagggggaacggggtcggtagggtacggggtacggttacggttacgggtacttacgttccttacgtacgtaacggtagggtacgggaccgtacctaacccttaaccgtttaacccggtaaccccgttaccctaaccgggtaacggtaaccggtaccgggtaccggaacccgtaaccgtaacttaacgaacggttaaacgtaaaccgaccgtaaccgtaaacccgaaaaccgtaaaccgtaccggtttaccccgtaaccgtaacgttaacggtacgttacggttaccgtttccgttacggtacccggtacccggaccgtacgaaccggtaccgaccgggttacctcttaacgtacgtcggngtaccgtaggtccgttaccgccctaagttaccgaccgtcgtaccgtccgttccgaccgtcgtcgtttctacgtttcgagttccgtcgggaaccggtacgaacggtactaggtccgtacccttcgtccgtaccg

SEQ ID NO: 188573 - DNA, 691 bp, Homo sapiens
  misc_feature: GYAE6OF01ACH15.37.2.A02.1.454.CMB.1.raw
  modified_base (567)..(567): a, c, t, g, unknown or other
  misc_feature (567)..(567): n is a, c, g, or t
  modified_base (594)..(594): a, c, t, g, unknown or other
  misc_feature (594)..(594): n is a, c, g, or t
tcagtagtgtagatcacgaccggtgctcgatttagactcatctacagggtctccgaagccttcggagaccctgtccctcacctgcactgtctctggttactccatcagcagtggttactacgtgggctggatccggcacgcccccgagggacgggctggagtggattgggactatctctcatagtggagcacctactactaaccccgtcctacgaagacgtcggaaggccgaccatactcgagtacgaaccaccgtaccaaaggaaccctagttcctccctaggaacgcgtagtacgttcgtgtacgacccgtccgacgagaccaccgggtcctactagttacgtgtgaccgtagacggttccggacccctaagtacgtaccagtcttcgtaccttccgctagtgtcttttagaatacgttcggacggggtacaaaggggtacaagtcggtaccctccgttactcgtccacgtccctaccgaaccgacgggtacccctaagttcccggttacccttcccccgacggtacccctaccccgttccctaccgaagtacccgactacccgnggtccgggaccacgacgtccggtccgnggacgtcgccggtacgtcgtaaccgtacttaccgtacctaccgtactaacccacgtacgacggtaccggacgtccgggtaacgacgtaccgggtacg

SEQ ID NO: 188574 - DNA, 679 bp, Homo sapiens
  misc_feature: GYAE6OF01BXL91.37.2.A02.1.454.CMB.1.raw
  modified_base (297)..(297): a, c, t, g, unknown or other
  misc_feature (297)..(297): n is a, c, g, or t
tcagtagtgtagatcacgaccggtgctcgatttagactcatctacagggtctccgaagccttcggagaccctgtccctcacctgcactgtctctggttactcatcagcagttggttactacgtggggctggatccggcacgcccccgagggaaggggctggagtggattgggactatctctcagtagtgggagccacctactactaaccccgtccctacaagaggtcgacggccgccatatcagtacgaccaccgtaccaaacgacctacgttcctccctgaacgtctgtagtttcngtcgacccgccgcagaccgaccggccgttacttatttacgtggtcggacggtaggtacggttaccggacccctaagtacgtacccagtcttacgttcccttacccgctacgttcgtacttttgacttacgtcggtcggggtaccgaaagggactagttcggtacccaccgttctccttcacgtccctaccgaaccgacgggaccctacgttcccgttcctcccttccgcgtccctacccctccctaccgaacgtcgcctaccgtcggtacgggaccacgccggccgtccggtcggcctcggccgtaggtaccgaacgtacctaccttacctacgttcctaacgtacgtacgtcggtacgggccggtcgtcggacggtaacgg

SEQ ID NO: 188575 - DNA, 652 bp, Homo sapiens
  misc_feature: GYAE6OF01CYA21.37.2.A02.1.454.CMB.1.raw
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataaccccgtccctcaagagtcgaggcgccatatcagtagacagtccaaagaaccagttctccctgaagctgagttctgtgaccgccgcagacncggccgtctattactgtgcgagagttcggccccatagtaccagctgtcttccgcctacgtgcttttgattagtctcggggaccaagggactaaatggtacnccgtctcgttcacgccctaccgacccgtaacggggacccctacgtccggtcccttaccccgtcggccctacccctcccctaccgaacgacgcctaacccgtcgtaccggggacgacgtaacggcccggtaccggttcgggccgtccgtacccgtgggtacccgaaacgggtacccttaaccgttcccgtaacgttacccttaaccgaacccgttaccgtacggaacggtacccgggcggttccgggcgtaacggggaccc

SEQ ID NO: 188576 - DNA, 838 bp, Homo sapiens
  misc_feature: GYAE6OF01A5ILN.37.2.A02.1.454.CMB.1.raw
  modified_base (216)..(216): a, c, t, g, unknown or other
  misc_feature (216)..(216): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgaggggaaggggctggagtggattgggactatctctcatagtgggagcacctactactaaccccgtcctanaagagtcgaggccaccatatcagtagacacgtaccaaagaacctacgtttcctacccgtagaacgtctgtacgtttctaggtcgacccgccgacgagaccgaccggtcccgttacttaatttacgtggtggaccggtaggtacggtttccggacccctaagttaaccgtacccaggtccttacggttcccgttcccgcctaagttcgttctttttacggaattacgttccggtacggggaccgaaaggggtaactaaggttcggtaccctacccgttcttacgtttaccgacgtccccttacccgaacccggtaaaccgggcccctaacggtttcccggttacccctttccccccggttacggacccccttaccccctacccgttacccgaaccggtaccgaccccgtacccggttacgggtccgggggaccctaaccggacccggggtacccggttccccggttcgggtcccgttccggtcccggttaaccgggttaccgtaaaccggtacccgtttaacccgttacccgttaagtttaccccgtaacccgttaaccgttaacccggtcgggtaacccggggtaccgggtaccggtacgggaacccgggtaacggtaccgg

SEQ ID NO: 188577 - DNA, 767 bp, Homo sapiens
  misc_feature: GYAE6OF01D98Q3.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctccagagtgggtcctgtcccaggtgcaactgacaagtacggtccgggccaaggaagtggtagaacgtccgttcggacgaccctcgtcccacacctcgctacgtcgtcttacgtacgttacctaccatcagtacgtagtcgttacgtacggtgggtcgtaggcgtccggacgaccggacccggaaggggtacgggcgtagggtaggtcggagttacggtactatcgtctacgagtggacgggacaccgtactaactaaccgtaccgtaccgtagaagtcgacggacgtcgacgtatacgacgacgtaacactacgtacaacgtacgtacgttacctaccgtagacgtacgttacggtacgttcgtacggtaaccgcccgtaccggacgaaccggtccggtaaccggttcctttacgttacgttcgtaggtacggtacgtaacggtcggtacccggaacccgttaagtaacccggtaccgtaacggtcccctttacggtaccccgttacccggacctttacgttacggtttacccgtttttagtaacccgggtttacggttcccggggaaccggggtaaacgttaaacccggggtaacttaacggggttcccggtttaaaccccgtccggtttccccgtaacccgg

SEQ ID NO: 188578 - DNA, 651 bp, Homo sapiens
  misc_feature: GYAE6OF01CVVI9.37.2.A02.1.454.CMB.1.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (447)..(447): a, c, t, g, unknown or other
  misc_feature (447)..(447): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccagggaaggggctggagtggattgggactatctctcatagtgggagcacctactactaacccgtcctcaagngtcgaggcgccatatcagtagacacgtacaagaaccagttctcctgaagctgagttctgtgaccgccgcagacacggccgtctatacngtgcgagacgttcggcccctagtacgtaccagctgtccttcgccatgtctttgattntcgtggggaccaaagggacaagtggtacctaccgtctcttcacgtccctccaccgtaacgggcccctagtccggtaccttccccgnggtcccaccctccgtaccaacgcgcgacccttcggtcgggggtaccaccgtacgggcccgggtacccgtcggggtacccgtcggtacccgttcgggtaccgaaacgggtacccttaaaccgtttcccgaacttaccctaaccgtaccgttaacgtaccggtaacgggtccgggtaacccgtcgggtaaccgaacggggtcccgg

SEQ ID NO: 188579 - DNA, 653 bp, Homo sapiens
  misc_feature: GYAE6OF01CSKCV.37.2.A02.1.454.CMB.1.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgaggggaagggctgggagtggattgggactatctctcataggtgggagctacctactactaaccccgtcctacaagagcgaggcncatancagtagacacgtacaanacctagtctccgtagagctgtacgtctgtcgaccgccgcaacgaccgaccggtccgtacttagttacgtggtgaccggagtacggttccggacccagtaacgtacctagtccgttgtacccgttcgacctagtcgtcttttaggacttacgcgtcgggaacgaagggacagtcggtcacctcgtctacgtacgtcctccaaccgaaccggtcccgtacgtccgtacccgttccccgcgtacccgacccctacctacccgaacgaccgtcctacccgtcgggtccgggaccacggacgcccgggacgtcggaccgtcgtaccgtggtaacctaacggtaccttaccgttcctactcctaacgtactacgtacggcggtacgggacttacggacgtacggacg

SEQ ID NO: 188580 - DNA, 831 bp, Homo sapiens
  misc_feature: GYAE6OF01DBJV1.37.2.A02.1.454.CMB.1.raw
  modified_base (819)..(819): a, c, t, g, unknown or other
  misc_feature (819)..(819): n is a, c, g, or t
tcagtagtgtagatcacgaccggtgctcgatttagactcatctacgagggggctttctgagagtcatggacctcctgtgcaagaacatgaagcacctgtggtttttcctcctgctggtggcagctcccagatcgggtcctgtcccgaggtgacaactgacgaaggacggtccgggcccaaggaagtcgggtagaacgtcccgtttcgggaaccgaccccgtcgtcccctaccacctcgcctacgttcgtccttcgttcggttacctcctatccgaggtcgtaaggtttcggttaacgtacggtggggctacggtacgtcccggaccgaacccggaccccggaagggggaacgggtcggtagggtaaggttggtacggttacggtaacttacgttccttacgtacgtagtacgggtacgggacctaccgtaaccttaccgttaaacccgtaacccccgtacccgtaacgaacggtacggtaccggacggtaccgaacctaacgttacgtaccgtaaacggttaaccgaaccgtaaacccggtaacccgaaaaccgtaacccgttacgtttaccctacccggtacgtaacgttccggttacggttacgtttccggtacggtacccggacccggtaaccggtacgaaccggtacccgtaccgggttaccctttaacgttacgtttacggcgtcggacggtaacggtccgttaccggaaccctagtaccgtaccgtcgttcgtccgttaccgtccgactagttcgttacgttacgtacgttacggtcgggacggtaacgaacggtactacggttccgtacccncgtttctacccg

SEQ ID NO: 188581 - DNA, 822 bp, Homo sapiens
  misc_feature: GYAE6OF01AJMXC.37.2.A02.1.454.CMB.1.raw
  modified_base (198)..(198): a, c, t, g, unknown or other
  misc_feature (198)..(198): n is a, c, g, or t
  modified_base (488)..(488): a, c, t, g, unknown or other
  misc_feature (488)..(488): n is a, c, g, or t
tcagtagtgtagatcacgaccggtgctcgatttagactcatctacagggtctccgaagccttcggagaccctgtccctcacctgcactgtctctggttacctccatcagctagttggttactacgtggggctggactccggcacgaccccgaggggagggctggagtggagttgggactatctctcagtaggtggacncctacctactacctaccccgtcctacgaacgtacggtcgacggccgacctattagtcgtaaggtacgaaccaaccggtaaccgaaaacgtaacccgttaacgttccccttacccggtaaggaacgtaccgtaggttacgttccgtcggtaccggacccgccgacgaccggaccgaccgggttcccttacgttaacttaccgtgtccggacgtaacggtcggttaccgaccctaacgttaacgtaccgtacgtccttcgttcccgtccgtctagttcgtttacgtttacgngttacggtacggtcgggaaccgtaaggtaaaccgtagtacccggtaccgtccgtcgttcctaacgcccgtacccgtaacccgaccgggtaacccgtccccgttacggttccccgttcccctttacccggccggtaccccctacccgtccaacccgtaacgtcccggtacccgaccgggtccggggtccgggaacctacccggtaccggggtccccggccggttcgggacccgttccggtaccggttaaccgtaacgtacccgttaccttacccgtctacccgttactacccgttacgtacggcgggacggtccggtcgacgggtaccgaggtcc

SEQ ID NO: 188582 - DNA, 807 bp, Homo sapiens
  misc_feature: GYAE6OF01AHX4G.37.2.A02.1.454.CMB.1.raw
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtagtgtagatcacgaccggtgctcgatttagactcatctacagggtctccgaagccttcggagaccctgtccctcacctgcactgtctctgttactccatcagcagttggttactacgtggggctggagtccggcacgcccccgaggggaggggctgggagtggagttgggactatcttctctagtaggtgggacacctacccttagtaccttaacccccgttccctacaacggtacggtaccggacgggtcccgacctacttaactacgaaggtacgaaccgaacccggttaccaaaaccggtaacctacggtttccctaccccggtagaacggtaccttaggttacggtttcccgttggttaccggaccccgtccggtacgacgaccggaccgtcccggttacttaacgttacttggcgngacggtagttccggccctagtacgtcagtctgtccgtccnctagtntcgtttgacgttagtcgtagggaccgtaaacggacgtaacgttccgggtaacctccgttacttcgttacccggtaccgtccctaacccggtaccccgtaacggggtaccccttacggttaccccggttcccccttacccggtcccggtcccctacccccggtaccctacccgtaacggtacccgtacccgtacccgttaccgggcgggtcccgaacgtcccgggaccggccgttcgacgtcggaccgtacggtacgacgtacccggttacctaccgtcttacgtaccgtacgttacggccggtacgggtaccggagtaccggtcgacggtaacgg

SEQ ID NO: 188583 - DNA, 753 bp, Homo sapiens
  misc_feature: GYAE6OF01B7N2P.37.2.A02.1.454.CMB.1.raw
  modified_base (743)..(743): a, c, t, g, unknown or other
  misc_feature (743)..(743): n is a, c, g, or t
tcagtagtgtagatcacgaccggtgctcgatttagactcatctacagggtctccgaagccttcggagaccctgtccctcacctgcactgtctctggttactccatcagcagtgttactacgtgggctggatccggcacgccccgagggaagggctggagtggagttgggactatctctcataggtggacgccacctaacgtactaaccccgtcctacgaagcgtcgagccgccaatacgtacaagtacgacctaccgtaccaaaggaacctaggttcctcccgtagaacgtcctagtacgttctgtccgaccgccgtacgaacgaccgaccggtccgtacttaagttaccgtggtcggacgtaacggtacggtttccggacccctaaggttaccgtaccgtacggtccgttcgttcccgttccgacctagttcgtttacttttagattcggtcgtacgggaccgaagggtactaaggttcggtacctacgtcttcgttaccgacgtccctaccgacgaccggtccctacgttcccggttacccttccccgtcgccctacccgtccgaccgtaacgccgtaccgtacccggtcggtccggggacaccggtaccgggtcccggtaccggttgggacccgtcggtccggtacggtaccgtaaccggtaccttaaccgttccctaaccgttacctaaccgtacccgttacggacggtacccggtcgggtaccggttacgggaaccgngggtaacccg

SEQ ID NO: 188584 - DNA, 699 bp, Homo sapiens
  misc_feature: GYAE6OF01EERIO.37.2.A02.1.454.CMB.1.raw
  modified_base (261)..(261): a, c, t, g, unknown or other
  misc_feature (261)..(261): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgacaaagtacggtccggggccccaagggaaatggtgaagcccgttcggacgaccctcgtcccctcacctgcactgtctcgtgttactccatcagcagtgttactacgngggctggatccggcacggaccccgaggggaacgggcgtggagtggagttgggactatctactacgtagtaggtggacacacctactaacctaacccgtccctagaagcgtacgacggccactagtactacagtacgaactacgtaaccaaacgtaacctacgttaccgtcccgtagaacgtctacggtacgtttcgtacggtacgacccggaccgaccgaacggaccgtaccgggtcccttacgttacgtttacggtcggttacggacggtacgtacggttacccggacccctaaggttaaccgtaccacggtcttccggttcccttcccggaccttagttacgttacgttttacggtaacttcggttaccggttacgggggaacccgtaaacggggtacctaacggttacgggtaccttaccccggttcttaacccg

SEQ ID NO: 188585 - DNA, 917 bp, Homo sapiens
  misc_feature: GYAE6OF01BLZFU.37.2.A02.1.454.CMB.1.raw
  modified_base (549)..(549): a, c, t, g, unknown or other
  misc_feature (549)..(549): n is a, c, g, or t
  modified_base (889)..(889): a, c, t, g, unknown or other
  misc_feature (889)..(889): n is a, c, g, or t
tcagtagtgtagatcacgaccggtgctcgatttagactcatctacagggtctccgaagccttcggagaccctgtccctcacctgcactgtctctggttactccatcagcagttggttactacgtggggctggacgtccggacaccggcccccggaagggggagggcgtagggaggtggtagttagggacttacttcctactacgtaagttagggacggggtacgacctaacccttaaccgttaaccgttaaccccccggttaccctacgtaaaaggtacggtaccgggaacgggcccgtacctaaagttaaccgttaccgtaagggttaacgaacccgttaaccggttaacccgaaaacggtaaacccgttacggtttcccctaaccccgttaaggaaccgtccgtttaggttaacggttttcgtaccgggtaacccgacccggccgaaccggtaaccggacccggtaccccggtccgttttaacttaccgtttacggttcggcggtaacgtacgggtacgttacccgacccttaagtaccgtaacccncgttaccgtttccttaccgtacccggacttcgttaacgtttccgtttaaggtactcgttacgggacgggaacgtaacgtacgtagttcggtaccctccgttacgtccgtaccgtacccgtccctaacccggtaacccgaccggttacccccgtacggttcccccgttacccccgttaccccgaccggtaccccttaccccgtacccaaccggaagtaccccgttccgaacccgggttgggtacccgacccggtaccggccgggtccccgttcggccgttacggtacgtcgggtaaccgtacgtaacgtcccgtttactcgtacgttacctactagtccgngggtacgcggacgtacggccgtgtaccg

SEQ ID NO: 188586 - DNA, 795 bp, Homo sapiens
  misc_feature: GYAE6OF01DQG20.37.2.A02.1.454.CMB.1.raw
  modified_base (596)..(596): a, c, t, g, unknown or other
  misc_feature (596)..(596): n is a, c, g, or t
tcagtagtgtagatcacgaccggtgctcgatttagactcatctacaggggctttctgagagtcatggaccctcctgtgcaagaacatgaagcactgttggtttttcctcctgctggtggcagctccagagtcgggtcctgtcccgaggtgcaactgacaaggacgtccgggacccaaggaagtgggtagaacgtcccgtttacgggaccgtaccccgttcgtccccgtacctaccgttcgacctaccgttgttcccgttacgttaccggtttacctcccgtaattaccgacggtacgttaacggttcggtttaaccgtacggtcggggcgttacgggtaccgtcccgggacccgaccggacccccgggaacgggggtaacggggtcggtaggggaacggttgggtaacggttacggggtaacttacggttcctacgtacgtacggtagggtacgggacctaccgtaaccttaaccgttaacccgtttaaccccggtaccctaacgaaggtaccgtcggaaccggcctacgtaactctacgtaacgtacgaacgtacgaccgaacgtaccacgttcctacgagtacgtctagtcgtntacgcgtccgccgacgaccggacgtcgtcccttactactacggtcgagacgtacggccgttacccggaccttagaccgtactacgtccgttcgtccgttcccgagttaccgttcggttacgtttacgtacggttaccgttcgggaacggaaccggtaacggtaaccgtacgtacggttacccctcgttccgttaacccg

SEQ ID NO: 188587 - DNA, 738 bp, Homo sapiens
  misc_feature: GYAE6OF01BXXXD.37.2.A02.1.454.CMB.1.raw
  modified_base (717)..(717): a, c, t, g, unknown or other
  misc_feature (717)..(717): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagcctccagagtgggtcctcgtcccaggtgacaacgtgacaagtaggtccgggacccaggaatggtagaacgtccgttcggacgtacccgtcgtcccctcacctgctactgtcttcgtcgttacctccatcagctagttcggttaacgtacggtggggacgtggacgtcccgggaccgaacccggaccccggaagggggtaacggggtcgtagggtaggtgggtaaggttcggggaacttacgtactcgtacgtaaggttagggtacgggtaacgtaccgtaaccgtaaccttaacccgttaaccccgtacccgtaacgaaacggtacggtaccggacggaccgtacctaacgtaactacgtaacggtaacgaacgtaaccgtaaccaaacggtaacctacggttaccttaccggaagtaacgtcgtagtcgttcgtacggtcgacccgacgacgtacggacctacgggtcctacttaacgtacgtcggtcgtacgtagtccgtaccggtaccctagtaacgtccgtagtccgtacgttcccttacccggcttacggtattcgtttagagttacgtcggtaacgggactaagggtanacggtgtacctcggttctacg

SEQ ID NO: 188588 - DNA, 771 bp, Homo sapiens
  misc_feature: GYAE6OF01DACDY.37.2.A02.1.454.CMB.1.raw
tcagtagtgtagatcacgaccggtgctcgatttagactcatctacagggtctccgaagccttcggagaccctgtccctcacctgtactgtctctggttactccatcagcagtgttactacgtgggctggatccggcacgcccccgagggaagggctggagtggattgggactatctctcagtagtgggagcaccttactactaaccccgtccctacaaggacgtcggacggccgaccagtatcgaagtagacaacgtaccaaagaacctacgttcctccctagaagtctgtagttctgtcgacccgccgcaaggaccgacggcccgtacttacttacgtggtcgacggaagtcggttaccggcccctaagtaccgtaaccgtacgtcttcgttcccgttacccgactacgtttctttaccgttttagtaacttcgttacggggttaccggggaacccggaagggtaacctacgtttccggtaacccgttccggtttaccttccgttacgcccgtacccgtcccccgaaacgggtaaccgtccccgtacggtttccccgggttacccctttcccccggccgtaccccctaccccgttaccccgtacgtaaccgccggtaccctaccccggttacggggcgggaacccaccggccgggcccggtccggcgggtaccgtcggtccgtacggtaccgtaacggtaccttccgtactaccgttcaaccggtacttacggtaggcggttaccggacgttacggaccgcgggctacgg

SEQ ID NO: 188589 - DNA, 776 bp, Homo sapiens
  misc_feature: GYAE6OF01A5MXE.37.2.A02.1.454.CMB.1.raw
  modified_base (166)..(166): a, c, t, g, unknown or other
  misc_feature (166)..(166): n is a, c, g, or t
  modified_base (175)..(175): a, c, t, g, unknown or other
  misc_feature (175)..(175): n is a, c, g, or t
  modified_base (189)..(189): a, c, t, g, unknown or other
  misc_feature (189)..(189): n is a, c, g, or t
  modified_base (471)..(471): a, c, t, g, unknown or other
  misc_feature (471)..(471): n is a, c, g, or t
tcagtagtgtagatcacgaccggtgctcgatttagactcatctacagggtctccgaagccttcggagaccctgtccctcacctgcactgtctctggttactccatcagcagttggttactacgtgggctggacgtccggcacgccccgagggagggctggagtggngttggactntctctcagtacggnggacgtcacctactacgtacccgtccgtacgaagacgcgacggccgtacctaagttacgtacgtacgtaacgaccgtaccgtaaccgaaaacggtaacctacggttccccttaccgtaggtaaacgtcgttcgtaacggttttcctacggtacggaccccgtaccgacgaacggtaccgtaccggtaccgttcttaacgtcgttcggtacggacgtacggtacgttacccgaccctaagtaccgtacgacgtctcgttcctccgactacgttcgttcgttancgtttacgtccgggacgggtaacgtaagggtaacttacggtcgtaacccggtacgttctccgtccgccgacccgtccgaccgtaaccgtctaccgtcccgttaccctccccgtaccgtaccctcccgtccgtaccgacgaccgtcgtaccgtcggacgggacctccggaccggtcccggtcccgggtacgtaccggtgtaacccggtcggtaaccgaaccggttaccctacccgttacctaccttacctaacccggttacgaccgttaccgggtagtcccgggtacgtcggtaccggtccgacgg

SEQ ID NO: 188590 - DNA, 741 bp, Homo sapiens
  misc_feature: GYAE6OF01A6NXW.37.2.A02.1.454.CMB.1.raw
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (728)..(728): a, c, t, g, unknown or other
  misc_feature (728)..(728): n is a, c, g, or t
tcagtagtgtagatcacgaccggtgctcgatttagactcatctacagggtctccgaagccttggagaccctgtccctcacctgcactgtctctggttactccatcagcagtggttactactggggctggatccggcagccccagggagggctggagtggattgggactanctcgtcatagngggagcacctactatacccgtcctcaagagtacggaggtcgccatatcagtacgactacgtccaagaaccagttctcccgtgaaacgtcctgtagtttctaggttcgacccgtccgacaacgacaccgggtacctttcgtatttaccgtggttacgacggtaggtacgtttcgggacccctagttacgacctacggactcggttcctttacccggccttaatcgtccgttttaggacttacgttccggtaggggcccgtaaaaggggtaccaaacgtttcgggttaacccaacccgttcgttaaccctttcgaacgtaccccgtacccgtaacccggtaacgggtacccctacgttccccgggttacccgttccccccttagggccccgtaaccccgttccgtaccgtaacgaccgtcccgtaacccgtacggttcggggaccaaccggaccgcccgggtaccgttcgggccttacgtccgttcggtaccgaaccgggttactacccggttcctagtccctacgtacctacgtcgacggtcggtacncggtcgaacggtc

SEQ ID NO: 188591 - DNA, 635 bp, Homo sapiens
  misc_feature: GYAE6OF01EQ6UU.37.2.A02.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
tcagtagtgtagatcacgaccggtgctcgatttagactcatctacagggtcgtccgaagccttcggagaccctgtccctcacctgcactgtctctggttactccatcagcagtggttactactggggctggatccggcagcccccgagggaagggctggagtggattgggactatctctcatagtgggagcactactataacccgtcctcaagagtcgagcgccatatcagtagacacgtccaagaaccagttcncctgaagctgagttctgtcgaccgccgcagacctacggccgttctattacgngtcgcgagtacgttcggccccaagtacgtaccagtctgtacttccgccattgtcttttgacttancgttacggggaccaaagggaccaagttggtccaacggtctacttcacgtcctaccacgacgggtccctaacgtccggttccttccccgtggccctacccttacctccgaaacgcgacctaacccgtcgttcgggggaccaacgtcggccggtcccgttcgggcctacggtccgtcggttacgaaaccggtaacttacgttacctacttaccgtaactacctttacgacgtaccggttacgggacttgggaccgaaagggtccg

SEQ ID NO: 188592 - DNA, 856 bp, Homo sapiens
  misc_feature: GYAE6OF01EMLPR.37.2.A02.1.454.CMB.1.raw
  modified_base (182)..(182): a, c, t, g, unknown or other
  misc_feature (182)..(182): n is a, c, g, or t
tcagtagtgtagatcacgaccggtgctcgatttagactcatctacagggtctccgaagccttcggagaccctgtccctcacctgcactgtctctggttacctcatcagcagttcggttactacgtggggctggatccggcacgccccgaggggagggctggagtgagttggactatctactnagtaggtggggacactaccttaactaacgtaaccccgtcctagaagacggtcgacggcgaccatacacgaagtacgaacctacgtaccaaacgaacctacgttaccgtaccgttaacggaacgtcgtagtacgtttactacggtaccggacccgccgtaacggaacgaaccggtaccggtacccgttatttaacgtacggtaggttacggaccggtaaggtaccggtttacccgaacccgtaacgtaaccgtaaccgtaacgtccgttaccggttaccctccgtaccgtaattcggttacttttaacgtaacgttacgtaccgggtaacgggtaaacccggtaaaggtaaccgtacggtacggttaccctacccggtttaccttcgttaccgacccgtacccgacccgtaacccgggtaaacccgggaccccttaccggttacccgttaccccggtttacccccggtaccgtacccccgtacccttacccgaccgtaaccggtacccgtaccgtaccgtaccgggtacgggacctaaccgggtcggtacccggtcggtaccgggtactcgggtaccggttaccggtaacgtaaccggttaaccgtttacctaccctaggtaaccctaataccggtacgtacggaccggtcggtaacgacggtacggaacgtccg

SEQ ID NO: 188593 - DNA, 584 bp, Homo sapiens
  misc_feature: GYAE6OF01BJNFE.37.2.A02.1.454.CMB.1.raw
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (381)..(381): a, c, t, g, unknown or other
  misc_feature (381)..(381): n is a, c, g, or t
  modified_base (562)..(562): a, c, t, g, unknown or other
  misc_feature (562)..(562): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
tcagtagtgtagatcacgaccggtgctcgatttagactcatctacaggggtctccgaagccttcggagaccctgtccctcacctgcactgtctctggttactccatcagcagtggttactactggggctggatccggcagccccgagggaagggctggagtggattgggactatctntcataggtggganccacctactactaacccgtccctanaagagtcgaggcgccagtatcagtacacgacgtccaaagaccagttcctcctagaagctgagttctgtgaccgccgcgagaccacggcccgtctaagttacctgtcgcgaggacgttcggaccccatacgtaccagtcctagtccttccgccagtcgcttttaggnttactcgtgggtccaaggggacaagtcggtactcccgtctccttcgagccctccgaaccgtaaccgggcccacgtccgttacgttccccctacgggcctaccccgtcctacgaacgagacctaccgtcgtacggggcacgcgtacgcccgtggctcggctggcaggactccgtcatctacnctagcgtgcgncgtnacggtcg

SEQ ID NO: 188594 - DNA, 538 bp, Homo sapiens
  misc_feature: GYAE6OF02H62TQ.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgcatgcttttgatatctggggccaagggacaatggtcaccgtctcttcagcctccaccaagggcccatcggtcttccccctggccaccctccctccaacgacgccacctcgtgggggccacgacgccggccctgggctcggcctgggtccaaggtacctacgttccatcctacactactgacgcgggctggcaggcg

SEQ ID NO: 188595 - DNA, 545 bp, Homo sapiens
  misc_feature: GYAE6OF02FY4GP.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaatggtcaccgtctcttcagcctccaccaacgggcccacgtccggtccttcccccgtcggccaccctccctcccaacgacgccaccctcgtcggggcacgacgccggcccgtgggcctcgccgtcggtcacggactacttccactctacactactgacgcggctcggcaggcg

SEQ ID NO: 188596 - DNA, 544 bp, Homo sapiens
  misc_feature: GYAE6OF02I3MHB.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttcgccatgcttttgatatcgtggggccaagggacaatggtcaccgtctcttcacgcctccaccaagggcccatcggtcttcccccgtggccaccctcctccaacgacgccacctcgtcggggccacgacgccggcccgtggggcctcggccctgggtccaaggacctacttccatcctacactactgacgcgggctggacgaggcg

SEQ ID NO: 188597 - DNA, 522 bp, Homo sapiens
  misc_feature: GYAE6OF02IGBTS.37.2.A02.1.454.CMB.1.raw
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaaagaaccagttctccctgaagctgagttctgtgaccgccgcagacacggccgtctattactgtgcgagngttggccccatagtaccagctgtcttccgccatgcttttgatatctggggccaaggggacaatggtcaccgtctcttcagcctccaccaggccatcgtcttcccctgcaccctccnccaagcgcacctcgtggggcacgacgccggcccgtgggctcgcctgtcaggactacttccactctacactactcgagcggcgtggcgaggcg

SEQ ID NO: 188598 - DNA, 524 bp, Homo sapiens
  misc_feature: GYAE6OF02G6LQO.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaaatggtcaccgtctcttcagcctccaccaagggcccatcggtcttccccctggcaccctcctccagacgcacctcgtggggccacgagccggccctgggcctggcctggtcaggactactccatctacactactgacgcggctggcaggcg

SEQ ID NO: 188599 - DNA, 508 bp, Homo sapiens
  misc_feature: GYAE6OF02HQ9CT.37.2.A02.1.454.CMB.1.raw
  modified_base (438)..(438): a, c, t, g, unknown or other
  misc_feature (438)..(438): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaatggtcaccgtctcttcagcctccacaagggcccatcggtcttcccctggcaccctcctcaacgncacctctggggcacagcgccctgggctgcctggcaggctactccatctanactngagcggctggcaggcg

SEQ ID NO: 188600 - DNA, 545 bp, Homo sapiens
  misc_feature: GYAE6OF02H6ROP.37.2.A02.1.454.CMB.1.raw
tcagtagtgtagatcacgaccggtgctcgatttagactcatctacaggggactttctgagagtcatggacctcctgtgcaagaacatgaagcacctgtggtttttcctcctgctggtggcagctcccagatgggtcctgtccctggtgcaactgcaagagtcgggcccaggaatggtgaagccttcggagaccctgtccctcacctgcactgtctctggttactcatcagcagtggttactactggggctggatccggcacgcccccgagggaaggggctgggagtggattgggactatctctcataggtggagcacctactactaacccgtccctacaagagtcgaggcgcatatcagtacgacacgtccaaagaaccagttctccctgaagctgagttctgtcgaccgccgcagacacggccgtctattactgtgcgagaggttcggaccccatacgtaccagctgtccttccgccattgtcttttgacttagtcgttcggggacctaaggggactaaagttcggtactacccgtcttacccg

SEQ ID NO: 188601 - DNA, 522 bp, Homo sapiens
  misc_feature: GYAE6OF02JHSXY.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaagggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttcgccatgcttttgatatctgggccaagggacaatggtcaccgtctcttcagcctcaccacggccatcgtcttcccctggccaccctcctccaacgcgccacctcgtcggggcacgacgccggccctgggctcgccgtggtcacggactacgtccatctacactactgacgcggctcggcaggcg

SEQ ID NO: 188602 - DNA, 570 bp, Homo sapiens
  misc_feature: GYAE6OF02GKOJM.37.2.A02.1.454.CMB.1.raw
  modified_base (373)..(373): a, c, t, g, unknown or other
  misc_feature (373)..(373): n is a, c, g, or t
tcagtagtgtagatcacgaccggtgctcgatttagactcatctacagggtctccgaacgaccttccggtaggaccctcgtccctccacctcgcactgtctctggttactccactcagcagtggttacgtactggggcgtggatccggcagcccccacgggaagggggctggagtggattgggacgtatctctcatagtgggagcacctactataacccgtccctcaagagtcgaggcgccatatcagtagacacgtccaagaacagttctccctgaagctgagttctgtgaccgccgcagacacggccgtctattactgtgcgagagttggccccatagtaccagctgtcttccgccatgcttttgatatcgngggggccaaagggcaaatgggtcaccgttctcttcacgcctccaccaagggcccactcggtccttcccctcggcaccctcctccaagacgcaccctcgtcggggcaccagccgggccctcggggctcgccgtcgggttcgaacggaccgttaccttccacttcgtaccacctacgtagcgccgggctggcgaagcgg

SEQ ID NO: 188603 - DNA, 647 bp, Homo sapiens
  misc_feature: GYAE6OF02GA8RO.37.2.A02.1.454.CMB.1.raw
  modified_base (224)..(224): a, c, t, g, unknown or other
  misc_feature (224)..(224): n is a, c, g, or t
tcagtagtgtagatcacgaccggtgctcgatttagactcatctacgagggtcgtccgaagccttcggagaccctcgtccctcaccgtgcactgtctctggttactccgactcagcagtcggttacgtactggggctggatccggcaggccccccagggaaggggctggagtggattgggactatctctcactaggtgggatcctacctatacttacccgtcctntaagagtcgaggcgccatatcagtagacgacgtccaagacctagtttctccctgaagctgtagttctagtaggaccgccgcagaccacggccgtctattacagtgcgaggaggttcggccccatacgtaccgagctgtcctccgccagtgcttttgatactcgtgggccaagggactaagtcgggtccaccggtctcttcgacgtcctccaccgaacgggtccctacgttccggttccttcccctcggcctacccgttccctaccaagtacgcctacccgttccgtacgggggtccaccgacgggcccggtaccgtcgggtccgtacggtacccgtacgggtaccgtagggtaccgtaccgttccgaaccttacctacctacgttaccgttcgacggtccgggtcctcgggaccgtaggtccg

SEQ ID NO: 188604 - DNA, 533 bp, Homo sapiens
  misc_feature: GYAE6OF02GPL2F.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaatggtcaccgtctcttcagcctccaccaaggcccatcggtccttccccctggccaccctcctccaacgacgccacctcgtcgggggcacgacgccggccctgggcctcgccgtggtcaggactacgttccatctacactactcgacgcggctggcaggcg

SEQ ID NO: 188605 - DNA, 520 bp, Homo sapiens
  misc_feature: GYAE6OF02IOQYH.37.2.A02.1.454.CMB.1.raw
  modified_base (439)..(439): a, c, t, g, unknown or other
  misc_feature (439)..(439): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactactggggctggatccggcagcccccgagggaaggggctggagtggattgggactatctctcatagtggagcacctactataacccgtcctcaagagtcgaggcgccatatcagtagacacgtccaagaaccagttcctccctagaacgctgagttctgtcgaccgcgcacgacacggccgtctattactgtgcgagngttcggcccatacgtaccagctgtctccgcatgtcttttgattagtcgtgggccaagggacagtggtcctaccgtcttccg

SEQ ID NO: 188606 - DNA, 581 bp, Homo sapiens
  misc_feature: GYAE6OF02IF4Z4.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaaagaaccagttcctccctgaagctgagttctgtgaccgccgcagacacgaccgtctattactgtgcgagagttcggccccatacgtaccagtctgtcttccgcatgtcttttgatatcgtggggccaagggacaagtggtccacgtctcttcacgcctccaccaacggcccatccgtccttccccgtggcctaccctccctccaacgacgccaccgtcgtcggggcacgacgccggcccgtcgggccgtcggcccgtgggtaccgaacggtaccttaccgttcccacttcctaacctaccttacgtcggacggtccgggtcgtcggccgaaggccg

SEQ ID NO: 188607 - DNA, 519 bp, Homo sapiens
  misc_feature: GYAE6OF02IMNTG.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaatggtcaccgtctcttcagcctccaccagggcccatcggtcttccccctggccaccctcctccaagacgccacctctggggcacagcggccctgggctgcctggtcaggactacttccatctacactactgagcggctggcaggcg

SEQ ID NO: 188608 - DNA, 537 bp, Homo sapiens
  misc_feature: GYAE6OF02GA2VM.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaaggggacaatggtcaccgtctcttcagcctccaccaacgggcccatccggtccttccccctcgggccaccctccctcccaacgacgccacctctcgggggcacgagcggcccgtgggcctgcctggtcaggactacgttccatcctacactactgacgcggctggcaggcg

SEQ ID NO: 188609 - DNA, 513 bp, Homo sapiens
  misc_feature: GYAE6OF02I1SK9.37.2.A02.1.454.CMB.1.raw
  modified_base (422)..(422): a, c, t, g, unknown or other
  misc_feature (422)..(422): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaagaaccagttctccctgaagctgagttctgtgaccgccgcagacacggccgtctattactgtgcgagagttggccccatagtaccagctgtcttccgccatgctttttgatatctggggccaaggggacaatggcaccgtctcttcagcctcaccaggccatcgtcttcccctcgccncctcctccaagacgcacctcgcggggacacgagcggccctgggctcgccgtgtcagctactcactctacactacngngcggcnggcgagcg

SEQ ID NO: 188610 - DNA, 577 bp, Homo sapiens
  misc_feature: GYAE6OF02GN965.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctatactgtgcgagagttggccccatagtaccagctgtcttccgccatgcttttgatatctgggccaagggacaatggtcaccgtctcttcagcctccaccaacgggcccatccggtccttccccctcggccacccctccctcccaacgacgccaacccgtcgtcgggggccacgacgccggcccgtcgggcctcggccttcgggtccaacgggtacctaccgttcccaattcctaacctaccttacgtcgacggccgggccgtcggacgaaggtaccgg

SEQ ID NO: 188611 - DNA, 593 bp, Homo sapiens
  misc_feature: GYAE6OF02HK91D.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagatgagttctgtgaccgccgcagacacggccgtctattactgtgcgagagttggccccatacgtaccagctgtcttccgccatgcttttgattatcgtggggccaagggacaagtggtccaccgtctcttcacgcctccaccgaagggcccagtccggtccttcccccgtggtccaccccttccctccaacgacgccaccctcgtcggggacaccgacgccggcccgtggggcctcggcccgttgggaccgaacgggtaccttaccgttcccacttcctaacctacctaaccgttcggacggccgggacgtcgggaccgaagggtccgg

SEQ ID NO: 188612 - DNA, 521 bp, Homo sapiens
  misc_feature: GYAE6OF02HU2VW.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgattctgtgaccgccgcagacacggccgtctattactgtgcgagagttggccccatagtaccagctgtcttccgccatgcttttgatatctgggccaagggacaatggtcacgtctcttcagcctcaccaagggcccatccggtcttcccccgtggccacccctcctccaacgacgcacctcgtcggggcaccagccgccgtgggctgcctgcaggctacgttccatctacactactgacgcggctggcaggcg

SEQ ID NO: 188613 - DNA, 597 bp, Homo sapiens
  misc_feature: GYAE6OF02INFGM.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattacctgtgcgagagttcggccccatacgtaccagctgtcttccgccatgtcttttgattatcgtggggccaagggacaagtgggtccaccgtctcttcacgcctccaccaacgggcccacgtccggtccttcccccgtggcccacccttccctccaacgacgcacctcgtcggggccacgacgccggcccgtcgggcctcggtccgtcgggtaccgaacgggtacctaccgttacccacttacctaaccaccgttacgtacggacggccgggccgttcgggaccgtaagggcccgg

SEQ ID NO: 188614 - DNA, 526 bp, Homo sapiens
  misc_feature: GYAE6OF02HLJ41.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgcatgcttttgatatctggggccaagggcaaatggtcaccgtctcttcagcctccaccaaggcccatcgtctcccctgccaccctctccagacgcacctcgtcggggcacgacgccggcccgtgggctcgccgtggtccaggacctacgttccacttctacactactgacgcgggctggcaggcg

SEQ ID NO: 188615 - DNA, 619 bp, Homo sapiens
  misc_feature: GYAE6OF02IGFDA.37.2.A02.1.454.CMB.1.raw
  modified_base (323)..(323): a, c, t, g, unknown or other
  misc_feature (323)..(323): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagccccccagggaaggggctggagtggattgggactatctctcatagtgggagcacctactataacccgtccctcaagagtcgagtttccatgtcagttgacacgtctaagaaccaaatctccctcaggctgacctctgtgactgccgcggacacggccgtctattattgtgcgagggtcccgaanagtagttgttccagcttgcgattgactacgtggggccacgggactccctggtccaccgtctcctcacgccctccaccgaacggcccacgtccggtcccgttccccccggcctacccctccctacccgaacgacgccaccttcgtcggggccaccgacggccggcccgtcgggcctcggcccgtcgggtaccgaacggtaccttaccgttacccacttacctaacctaccttaccgtacggacggccgggtccgtacgggaccgtaacgggcccgaccgtaacgtaggacgtcagcg

SEQ ID NO: 188616 - DNA, 609 bp, Homo sapiens
  misc_feature: GYAE6OF02JUQT0.37.2.A02.1.454.CMB.1.raw
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (472)..(472): a, c, t, g, unknown or other
  misc_feature (472)..(472): n is a, c, g, or t
tcagtagtgtagatcacgaccggtgctcgatttagactcatctacagggtctccgaagccttcggagaccctgtccctcacctcgcactgtctctggttactcatcagcagtggttactactgggctggatccggcagcccccagggacggggctgggagtggattggggactagtcgtctcatagtgggagctacctactanaaccccgtcctcaagngtccgaggcgccatatcagtagacacgtccaaagacccagttccncccgtgaacgtctgacgttctgtgaccgcgcaggaccncgggacctctattacctgtcgcgagagttcggccccatacgtaccagctagtccttcgcctatcgtacttttgattacgtcgttcgggggacaacgggtacgtaatcgggtaccaccgtctacgtcacgtcctccaccgacggcctagtccggtacctccccgtcggccnccctcctcctacgacgccaccgtccgtcggggtccaccgtacgccggccgttcggccgtcgccgtgtccgacgtccgtacgtccctagtcctaccgtactaccgtcgtacggccggtaccgtcggtacgacggtccg

SEQ ID NO: 188617 - DNA, 536 bp, Homo sapiens
  misc_feature: GYAE6OF02FYOVO.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactactggggctggatccggcagcccccagggaagggctggagtggattggggactatctctcatagtgggagcacctatactaacccgtcctcaagagtcgaggcgccatatcagtagacacgtccaagaaccagttcaccctgaagctgagttctgtgaccgccgcagacacggccgtctattactgtcgcgagacgttggccccatacgtaccaggctgttccttccgcctagtcgtcgttttgattacgtcgtcggggtccaagggtcaagtggtacctacccggtcttaccg

SEQ ID NO: 188618 - DNA, 589 bp, Homo sapiens
  misc_feature: GYAE6OF02FSXJH.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaaggggacaatggtcaccgtctcttcagcctccaccaagggcccatcggtcttccccctggccacccctcctcccaagacgccaccctcgtgggggccaccgacgccggcccgtggggcccttcggcccgttcgggtaccaaggggtaccttaccgtttcccaacttcccgttaaccacccttacgttacggacggtccggggccttgggaccaagggtcccgg

SEQ ID NO: 188619 - DNA, 523 bp, Homo sapiens
  misc_feature: GYAE6OF02HLO7A.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaaggggacaatggtcaccgtctcttcagcctccaccaagggcccatcgtcttccccctggccacccgtcctccaacgacgcacctctcggggccacgacgcggcccgtgggcctgcctgtcaggctacttcatctacactactcgagcggctgcagcg

SEQ ID NO: 188620 - DNA, 556 bp, Homo sapiens
  misc_feature: GYAE6OF02II5CW.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttcctccctgaagctgagttctgtgaccgccgcagacacggccgtctattactgtgcgagagttcggccccatagtaccagctgtcttccgccatgtcttttgatatcgtggggccaagggacaagtggtcaccgtctcttcagcctccaccacggcccactcgtccttcccccgtcgccaccctcctcccaagacgccaccgtcgtcgggggcacgacgccggcccgtcgggctcgccgtggtcgacggtactacgttccactctaaccacctacgtcgacggccgggcgtcgggacaggcg

SEQ ID NO: 188621 - DNA, 618 bp, Homo sapiens
  misc_feature: GYAE6OF02HUA6A.37.2.A02.1.454.CMB.1.raw
  modified_base (314)..(314): a, c, t, g, unknown or other
  misc_feature (314)..(314): n is a, c, g, or t
tcagtagtgtagatcacgaccggtgctcgatttagactcatctacagggtctccgaagccttcggagaccctgtccctcacctgcactgtctctggttactccatcagcagtggttactactggggctggattcggcagcccccagggaaggggctggagtggattgggactatctctcatagtgggagcacctactataacccgtccctcaagagtcgaggcgccatatcagtagacacgtccaagaaccagttcctccctgaagctgagttctgtgaccgccgcagacacggccgtctattactgtgcgagngttcggccccatacgtaccagctgtcttccgccatgtcttttgatatcgtggggaccaagggacaagtggtcaccgtctcttcacgtccctaccaccgaacgggcccacgttccggtccttcccccgtcggccctacccctccctaccgaacgacgcctaccctcggtcgggggaccacgacgccggcccgtcgggtccgtcgcccgttcggtaccgaacggtacctaaccgttcccaacttacctaaccgtaaccttaccgtacggtacgggccgggtaccgtacgggaccgaagggtaccgg

SEQ ID NO: 188622 - DNA, 547 bp, Homo sapiens
  misc_feature: GYAE6OF02GPCBU.37.2.A02.1.454.CMB.1.raw
  modified_base (536)..(536): a, c, t, g, unknown or other
  misc_feature (536)..(536): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcatacacggccgtctattactgtgcgagagttggccccatagtaccagctgtcttccgccatgcttttgatatcgtgggccaagggacaatggtcaccgtctcttcagcctccaccaagggcccatcggtccttccccctcggccaccctccctcccaagcgccaccgtcgtcgggggcacgacgccggcccgtgggcctcggccgtcggtcacggtacctacttccatctacacctactgacgccgggtcncgggcaggccg

SEQ ID NO: 188623 - DNA, 591 bp, Homo sapiens
  misc_feature: GYAE6OF02IRE7Q.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtggttactacgtggggctggatccggcacgcccccgaggggaacggggcgtgggagtggagttgggactagtctctcagtaggtgggagcacctactactaacccgtcctcaagagtcgaggcgcatatcagtagacacgtaccaaagaacctagttcctccctagaacgtctagtacgttctcgtacgacccgccgacaacggaccaccggtccgtacttacgttacgtgtcgcgagacgttcggcccctagtacgtaccagctcgttcctccgcctagttcgttacgttttgacttacgttcggtacggggacccgtaaaggggacctaaggtcgggtacctaccgttcttaccg

SEQ ID NO: 188624 - DNA, 586 bp, Homo sapiens
  misc_feature: GYAE6OF02GAP8B.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttcggccccatagtaccagctgtcttccgccatgcttttgatatctggggccaagggacaagtggtcacccgtctcctcacgccctccaccaacgggcccagtccggtccttcccccgtggccacccctcctcccaacgacgccacctcgtcgggggccacgacgccgggccccgtgggcctcggccgtcgggtccaacgggtacctaccgttcccgtacttcctaaccaccttacgtcggtacggccggggtcgtcgggacaagggtccgg

SEQ ID NO: 188625 - DNA, 617 bp, Homo sapiens
  misc_feature: GYAE6OF02GUY6A.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgccccctcacctgcactgtctctggttactccatcagcagtggttactacgtggggctggatccggcacgccccgagggaacggggctgggaggtggagttggggactatctctcataggtgggagcacctactactaacccgtcctacaagagtcgaggcgccatataagtagacacgtaccaagaaccagttcctaccctagaacgtctagtagtttctcggtcgacccgccgacacggaaccacgggtcctacttacgttactgtgaccgaggacggttcggaccccaagtacgtaaccacgtctccgtccttcccgacctagttcgttactttttacggaacttaacgtccggttaacggggaccgaaacggggtactaacggttcggtaccctaacccggtttcctacgttaccccg

SEQ ID NO: 188626 - DNA, 534 bp, Homo sapiens
  misc_feature: GYAE6OF02GPKYX.37.2.A02.1.454.CMB.1.raw
  modified_base (257)..(257): a, c, t, g, unknown or other
  misc_feature (257)..(257): n is a, c, g, or t
  modified_base (393)..(393): a, c, t, g, unknown or other
  misc_feature (393)..(393): n is a, c, g, or t
  modified_base (525)..(525): a, c, t, g, unknown or other
  misc_feature (525)..(525): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttcnccctgaagctgagttctgtgaccgccgcagacacggccgtctattactgtgccgagagttggccccatagtaccagctgtcttccgccatgcttttgattatctggggccaagggacaatggtcaccgtctcttcngcctccaccaacgggcccatccggtcttcccccgtgccaccctccctccaacgacgccacctctcgggggcacgagccggccctgggcctgcctggtcaggactacgttcactctacactactcgagccggntggcaggcg

SEQ ID NO: 188627 - DNA, 595 bp, Homo sapiens
  misc_feature: GYAE6OF02HQO3L.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagccccagggaaggggctggagtggattgggactatctctcatagtgggagcacctactataacccgtcctcaagagtcgaggcgccatatcagtagacacgtccaagaaccagttcctccctgaagctgagttctgtcgaccgccgcagacacggccgtctattactgtgcgagagttcggccccatacgtaccagtctgtcttccgcatgtcttttgatatcgtggggaccaagggacaagtggtcaccgtctcttcacgtcctccacgaacggcccacgtccggtcccttcccccgtggccctacccctcctaccaacgacgccacccgtcgtcgggggaccacgacggccggtcccgtcgggccgtcggcccgtgggtaccgaacggtaccttaccgttcctacttcctaacctaccttacgtcggacggccgggcgtacggaccgaacggcgg

SEQ ID NO: 188628 - DNA, 727 bp, Homo sapiens
  misc_feature: GYAE6OF02JJNVQ.37.2.A02.1.454.CMB.1.raw
  modified_base (433)..(433): a, c, t, g, unknown or other
  misc_feature (433)..(433): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaagggctggagtggattgggactatctcctatagtggtaggcgacctacctactaaccgtaccccgtcctaacgaagtacgtacggacggccgacgtatactacgtaagacgaaccgtaccgtaacgaaaccgaacgttacgttccctacgaagacgtcgtagttacgttgtacggtaccgacccgtcgacgaacgaccggccggtccttataacttcgtgtcggagagttcggtcccgactagttaccgacgcgtcgtcgttccgtccactgtcgtttcgttanaacttcgttcggggaccggaacggtaacggaacttaggtcgtactaggttctccttactacgcccgtccaacccgaacgggacccgacgtcggttcccgttcccccgtaccggtccgaccccttcccgtacccgtaaaccgagtaccccaccgttacccgtcgggggtaccggacccacggccgggccccgttcgggccgtcgtccgtcggttacgaacgtaccggtaccctttcccgtagtacctaccgtaacctaacggtcgtacggccgggtcgtacggtacgaacggtcg

SEQ ID NO: 188629 - DNA, 586 bp, Homo sapiens
  misc_feature: GYAE6OF02F9C2S.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttcggccccatagtaccagctgtcttccgccatgtcttttgattatcgtggggccaaggggacaagtcggtcaccgtctcttcagccctccaccgacggcccagtccggtccttcccccgtggcctacccctcctaccaacgcgccacccgtcgtcggggccacgcgccggcccgtgggcctcggccgtcgggtaccaacgggtacctaccgttcccaacttcctaaccgtacctacgtcggacggtccgggcgtcgggacctaagggcccg

SEQ ID NO: 188630 - DNA, 463 bp, Homo sapiens
  misc_feature: GYAE6OF02H7UDL.37.2.A02.1.454.CMB.1.raw
  modified_base (197)..(197): a, c, t, g, unknown or other
  misc_feature (197)..(197): n is a, c, g, or t
  modified_base (438)..(438): a, c, t, g, unknown or other
  misc_feature (438)..(438): n is a, c, g, or t
  modified_base (444)..(463): a, c, t, g, unknown or other
  misc_feature (444)..(463): n is a, c, g, or t
tcagtagtgtagatcacgaccggtgctcgatttagactcatctacgagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgnggacacggccgtgtattattgtatgtatagcagtggctcagggtactacgtacgggatggacgtcgtgggggccaaggggccacggtcaccgtctcctcagcctccaccaaggcccagtcggtctttcccccctggccaccgtcctcccaagacgccacctcgtggggggcacgagccggcccctggggctgcctggtcaaggctacttccatctacactactgagcgggctggcaaggcncatagnnnnnnnnnnnnnnnnnnnn

SEQ ID NO: 188631 - DNA, 595 bp, Homo sapiens
  misc_feature: GYAE6OF02HX3XB.37.2.A02.1.454.CMB.1.raw
  modified_base (316)..(316): a, c, t, g, unknown or other
  misc_feature (316)..(316): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggccgcatatcagtagacacgtccaaagaaccagttcctccctgaagctgatttctgtcgaccgccgcagacacgaccgtctattactgtgcgagngttcggccccatagtaccagctgtcttccgcctatcgtctttttgattacgtcgtcggggaccaagggacaaagttcgggtcaaccgtcttctcacgcctccaaccgacggcctagtccgtccttccccgtggtccctaccctccctaccaacgacgctacccgtcgtcggggccacgacgtccgtcccgtgggcctgccgtcggtacgaacggtaccgttacgttcctacttacctaactacctacgtcggacggccgggcgtcggaccgtaggaccg

SEQ ID NO: 188632 - DNA, 652 bp, Homo sapiens
  misc_feature: GYAE6OF02G1YCR.37.2.A02.1.454.CMB.1.raw
  modified_base (314)..(314): a, c, t, g, unknown or other
  misc_feature (314)..(314): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactcatcagcagtggttactacgtggggctggatccggcacgccccgagggaacgggctggagtggattgggactatctctcataggtgggancacctactactaacccgtcctacaagagtcgaggcgacatactcagtacgactacgtaccaaacgaaccagttcctaccgtagaacgtctgacgttcgtgtacgaccgccgacgacgaccaccggtccgttacttaacttaccgtgtcgacggaggtacggttccggacccctaagttaaccgtaaccgtacgtccgttcggttacccgtttcccgaccgtacgttcggttaccgttttttcggaactttacggttccgggttaccgggggtacccgtaaaacgggggttacctaaacggtttccgggttacccttacccgggtttccctttacccgg

SEQ ID NO: 188633 - DNA, 592 bp, Homo sapiens
  misc_feature: GYAE6OF02FKHKJ.37.2.A02.1.454.CMB.1.raw
  modified_base (340)..(340): a, c, t, g, unknown or other
  misc_feature (340)..(340): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactactggggctggatccggcacgcccccaggggaaggggctggagtggattgggactatctctcatagtgggagcacctactactaacccgtcctcaagngtcgaggcgcatatcagtagacacgtaccaagaaccagttcctccctagaacgctgtacgttctggtcgacccgccgacacgaccgaccgggccgtcttacttactgtcgcggagtacggttcggccccaagttacgtaaccctagccttgttccttacccgcctagttcgtccgtttttgaattacgtccggttacggggacccgaaagggggtacctaaaggttcgggtaccctacccggttccttaccg

SEQ ID NO: 188634 - DNA, 684 bp, Homo sapiens
  misc_feature: GYAE6OF02JSOCZ.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttacctccatcagctagttggttactacgtgggctggactccggcgaccgccccggaaggggaacgggcgtggaggtggtagttcgggactatctctacgagtaggtcggacgacctacctacgttacctaacccgtccctacgaacgacgtacggacggccgtaccgatactacgtacggtaacgaccgtaaccgtaaccgaaacgtaacccgtacgttaccctacccgtaggaaccgtcgtacgttacggttcgtcggtacgacccggtcgaccgacgtacccgtaccgggtcccgtttactaacgttaccgtggtacgtacggaagtcggttacccgacccgtaattaccggtacctacgttccttacggttacccttccgtacctagttcgtttaccgtttggtaacttacgtcggttacggaccgttaaggaccttaggtcgtaccgtaccgtcttaccg

SEQ ID NO: 188635 - DNA, 581 bp, Homo sapiens
  misc_feature: GYAE6OF02F5O06.37.2.A02.1.454.CMB.1.raw
  modified_base (312)..(312): a, c, t, g, unknown or other
  misc_feature (312)..(312): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtcctcaagagtcgaggcgccatatcagtagacacgtccaagaaccagttctccctgaagctgagttctgtgaccgccgcagacacggccgtctattactgtgcgagngttggccccatagtaccagctgtcttccgccatgcttttgatatcgtggggccaaaggggacaaagtcggtcacccgtctcttcacgccctccaaccgaacgggccctacgtccggttccttcccccgtcggccaccctcctccaacgacgccacctcgtcggggcaccgacgccggcccgtgggcctcggtccgtcgggtaccgacggacctaccgttcctacttacctaacctactacgtcggacggccgggctcggacgaggtccg

SEQ ID NO: 188636 - DNA, 619 bp, Homo sapiens
  misc_feature: GYAE6OF02F7WLE.37.2.A02.1.454.CMB.1.raw
  modified_base (424)..(424): a, c, t, g, unknown or other
  misc_feature (424)..(424): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtcccctcacctgcactgtctctggttactccatcagcagtggttactacgtggggctggatccggcacgcccccgaggggaaggggctggagtggagttgggactatctctcagtagtgggagcacctactactaaccccgtccctcaagtacgtcgacggcgccatactcagtagacaacgtaccaaacgaacctagttcctccctagaacgtctgtattcggggtntcggacccgcgcacgaccgacggtcccgtacttacttactgtcgcggagtacggttccggacccctaagtacgtacccagtcctcgttccttacccgcctacgttcgtccgtttttggaacttacggttccggttacggggacccgtaaacggggtaactaacggttcggtacccgttacccggttctttacccg

SEQ ID NO: 188637 - DNA, 602 bp, Homo sapiens
  misc_feature: GYAE6OF02F1U1Y.37.2.A02.1.454.CMB.1.raw
  modified_base (420)..(420): a, c, t, g, unknown or other
  misc_feature (420)..(420): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtgtactactggggctggatccggcacgcccccgagggaaggggctggagtggattggggactatctctcataggtgggagcactactactaacccgtcctcaagacgtcgaggcgccatctcagtagacacgtaccaagaaccagttcctaccctgaacgtctagacgttctgtacgacccggccncgacgaccgaccgggtcccgtacttaacttacctggtagcggtaagtacggttccgggacccctaagttaaccgtaaccgagtccttacggttccttacccgcctagttcgtcttttaggatttactcggttcggggaccgtaaggggactaaaggttcggtacccgtaccgtcccttaccg

SEQ ID NO: 188638 - DNA, 538 bp, Homo sapiens
  misc_feature: GYAE6OF02GXOW3.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcgggagaccctgtccctcacctgcactgtctctggttactccatcagcagtggttactactggggctggatccggcacgcccccgagggaacggggctgggagtggattgggactatctctcatagtgggagcacctactactaacccgtcctcaagagtcgaggcgccatatcagtagacacgtccaagaaccagttcctccctgaacgctgagttctgtcgaccgcgcagacacggccgtctattactgtgcgagtagttcggaccccagtacgtaccagctcgtccttccgccatcgtcttttgattacgtcgtgggccaagggactaagtcggtcctaccgtcttaccg

SEQ ID NO: 188639 - DNA, 602 bp, Homo sapiens
  misc_feature: GYAE6OF02I6FSE.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaagggctggagtggattgggactatctctcatagtgggagcacctactataacccgtcctcaagagtcgaggcgccatatcagtagacacgtccaaagaaccagttctccctgaagctgagttctgtgaccgccgcagacacggccgtctatactgtgtcgagagttggccccatacgtaccagctgtcttccgccatgcttttgatactctggggccaagggacaaagtggtaccacccgtcgtcttccaagtccctaccaccaacgggcccaacgtcggtccttaccccctggaccacccctcctcccaagcgacctacccgcgtcgggggcctaaccgacggcccgggccctcggggacctcgcccgttacggtacgaacggtaccgtaaccttccgtaacttccgtaacctaactaccgttcgaccgtccggcgtacggcgtaaaggccg

SEQ ID NO: 188640 - DNA, 633 bp, Homo sapiens
  misc_feature: GYAE6OF02F16R3.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcggcccaggaatggtgaagccttcggagaccctgtccctcacctgcactgtctctggttactccatcagcagtggttactacgtggggctggatccggcacgcccccgaggggaagggctggagtggattgggactatctctcagtggtgggacgcaacctactactaaccccgtcctacaagtacgtcgaggcgccatatcgagtagaacacgtaccaaagaacccagtttcctaccctagaagtcctagtagttccgtgtcgacccgccgacacggaccaccgggtcccgtacttagttacgtgtacgccgaaggtcggttcggacccctagtaccgtaccaggtccttacgttccgtttcccgactacgtttcgtacgtttttacgaacgtttaacgttccggtaacgggggtacccgtaaacgggggacttaacgggttccgggttacctacccggttacctttcccg

SEQ ID NO: 188641 - DNA, 561 bp, Homo sapiens
  misc_feature: GYAE6OF02FTC4L.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtggttactactggggctggatccggcacgcccccgaggggaaggggctggagtggagttgggactatctctcagtagtgggagcacctactactaacccgtcctacaagagtcgaggcgccatatcagtagacacgtaccaagaaccagttcctccctagaacgtctggtacgttctggtcgacccgtccgacacgaccacgggtcccgtctaacttactgtggcgagtacgtcggaccccagtacgtaccagtctcgtcctccgctatcgtctttgattcgtcggtgggaccaagggactaaggtcggtacctaccggttcttccg

SEQ ID NO: 188642 - DNA, 601 bp, Homo sapiens
  misc_feature: GYAE6OF02JHJDE.37.2.A02.1.454.CMB.1.raw
  modified_base (189)..(189): a, c, t, g, unknown or other
  misc_feature (189)..(189): n is a, c, g, or t
  modified_base (423)..(423): a, c, t, g, unknown or other
  misc_feature (423)..(423): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggancacctactataacccgtcctcaagagtcgaggcgccatactcagtagacacgtccaaagaccagttctccctgaagctgagttctgtgaccgcgcacgacacggccgtactattactgtgcgagagttcggcccatacgacagctgtctccgcatgtcttttgatatcgtgggaccaaggacagtcgacaccgtctctcagtcctcaccgacggcctatccggtccttcccccncggtccaccccgttcctacccaacgacgtcctaccgtacgttcggggcctaccgacgtcccggcccgtgggtccgtcggcccgttcgggtaccacgggtaccttaccgttacccctagttccgtaaccaccgttaccgtacggtacggtccgggaccgttcggacccgtagggaccgg

SEQ ID NO: 188643 - DNA, 577 bp, Homo sapiens
  misc_feature: GYAE6OF02HAWYC.37.2.A02.1.454.CMB.1.raw
  modified_base (304)..(304): a, c, t, g, unknown or other
  misc_feature (304)..(304): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (446)..(446): a, c, t, g, unknown or other
  misc_feature (446)..(446): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctcctgaagctgagttctgtgaccgccgcagacacggccgtctattacngtgcgagagttcggcccatacgtaccagctgtcttccgcatgtctttgatatcgtgggccaagggacaatcggtcaccgtntctcncgccnccaccgacggcccatccgtccttcccgttcgcctccctccctaccacgtcnccacctcgtcggggccacgacgccggtccgtcgggccgtcgccgttcgggtaccgacggtaccttaccttccgtacttaccgtaaccaccgttacgtacggacggccgggtcgtacgggtaccgaggccgg

SEQ ID NO: 188644 - DNA, 547 bp, Homo sapiens
  misc_feature: GYAE6OF02GRV26.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacgaccgtctattactgtgcgagagttggccccatagtaccagctgtcttccgccatgcttttgatatcgtggggccaaggggacaagtggtcaccgtctcttcacgcctccaccaacgggcccacgtcggtccttcccccgtcggccaccctccctccaagacgccacctcgtcggggcacgacgccgggcccgtgggcctgcctcggcaggacctactcctatcctactactactcggacgcgggctcggcaggcg

SEQ ID NO: 188645 - DNA, 699 bp, Homo sapiens
  misc_feature: GYAE6OF02H0TXT.37.2.A02.1.454.CMB.1.raw
tcagtagtgtagatcacgaccggtgctcgatttagactcatctacagggtctccgaagcctttcggagaccctgtccctcacctgcactgtctctggttactccatcagcagtggttactacgtggggctggatccggcagccccccgagggaaggggctggagtggagttgggactatcctctcataggtgggagcacctactactaaccccgtccctacaaggagtcggaggccgcatactcagtagacaccgtaccaagaacctagttcctcccgagaagctgtacgtttctggtcgacccgccgacagacgaccggtccgtacttaacgttactggtcggacggtaggtcgtccggacctagtacgaccgagtctcgtcctccgctagtgttcgtttgattagtcggacggaacgaggtaactacgtcgactaccgttctctaccgaccgtccctaccgaaccggaccggtaccgtacgttcccgttccctccccggtcgtacccctacccgtccgtacgtaaccgaccgtacctacccggtcgggtaccgggaccgaccggaccggcccggtccggttccgggtcgtccggttaccggtacgggtaaccgtaaccggttaccttaccgtacctacgttaccttaccgtaaccgttacggtcggaccgggtccggtacggtcggaccgacggacg

SEQ ID NO: 188646 - DNA, 613 bp, Homo sapiens
  misc_feature: GYAE6OF02IM9VN.37.2.A02.1.454.CMB.1.raw
  modified_base (339)..(339): a, c, t, g, unknown or other
  misc_feature (339)..(339): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccaggggaaggggctggagtggattgggactatctctcatagtgggagcacctactataaccccgtccctcaagagtcgaggcgccatatcagtagacacgtccaagaaccagttcctccctgaagctgagttctgtcgaccgccgcagacacggccgtctattactgtcgcgagtgttcggccccagtacgtaccngtctcgtcttccgctattgtcttttgatagtcgtggggaccaagggacaagtcggtcctaccggttcttcttcgacgtccctacccaaccgaacgggccctacgtccggttcccttcccccgtcggccctacccctccctaccgaacgacgcccgacctcggtccggggacaccggacggcccgggcccgtcgggccgtcgtccgtcggtacgacggtaccttacctcctactcctactacctacgtcgacggtccggtcgtcggacgaggccg

SEQ ID NO: 188647 - DNA, 569 bp, Homo sapiens
  misc_feature: GYAE6OF02FHO7X.37.2.A02.1.454.CMB.1.raw
  modified_base (429)..(429): a, c, t, g, unknown or other
  misc_feature (429)..(429): n is a, c, g, or t
  modified_base (449)..(449): a, c, t, g, unknown or other
  misc_feature (449)..(449): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagccccagggaagggctggagtggattgggactatctctcatagtgggagcacctactataacccgtccctcaagagtcgaggcgccatatcagtagacacgtccaagaacccagttctccctgaagctgagtttctgtcgaccgccgcagacaccggcctctattactgtgcgagagttcggccccatacgtaccagctgtcttccgcatgcttttgattatcgtggggccaagggacaagtcggtcaccgtctctcacgcctccacacgggccagtccgtccttccccgngccaccctcctaccaacgcncacccgtcgtcggggccacgacgccggtcccgtgggcctcgccgtcggtaccaacggtactacctttccgactcctaacctactacgtcggacggtccggggtctcggaccgtagggccg

SEQ ID NO: 188648 - DNA, 618 bp, Homo sapiens
  misc_feature: GYAE6OF02J0TPX.37.2.A02.1.454.CMB.1.raw
  modified_base (251)..(251): a, c, t, g, unknown or other
  misc_feature (251)..(251): n is a, c, g, or t
tcagtagtgtagatcacgaccggtgctcgatttagactcatctacaggggcgtttctgagagtcatggacctcctgtgcaagaacatgaagcacctgtggtttttcctcctgctggtggcagcctcccagatgggtcctgtcccaggtgcaactgcaatagtccgggcccaggaatggtgaagccttcggagacccctgtccctcaccgtgccactgtccttctggttacctccatcagcaggttgttacncgtggggctggactccggcacgccccgagggagggcgtgggagtgggagttggactatctctcgataggtgggacgccgaccttactactaaccccgtcctcgaacgacgtccggaggccgtaccatacgtcagtacgactaccggtaccaacgaaccagttcctccctagacgtcgtcgtacgttcgtagtcgacccggcccgacgacggacccgacggtccttacgttacttacgtcgttggccgtagtacgttccgggccctagtacgacctacgcttcgtcctccgtccgattcgtcgtttcgattcgtacggttcgggaccgtaacgggactacggttcggtaccctaccggttccttaccg

SEQ ID NO: 188649 - DNA, 575 bp, Homo sapiens
  misc_feature: GYAE6OF02FO5PP.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataaccccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgtcttttgatatcgtggggccaaggggacaagtggtcaccgtctcttcacgcctccaccgaacggcccatccggttccttccccctcggcctaccctccctcccaacgacgccacctcgtcgggggcacgacgccggcccgtgggcctcgtccgtcgggtacgacggacctacgttcccatcctaacctaccttacgtcggacggccgggtcgtgggaccgaggccgg

SEQ ID NO: 188650 - DNA, 704 bp, Homo sapiens
  misc_feature: GYAE6OF02JU34U.37.2.A02.1.454.CMB.1.raw
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
tcagtagtgtagatcacgaccggtgctcgatttagactcatctacagggtctccgaagccttcggagaccctgtccctcacctgcactgtctctggttactccatcagcagtggttactacgtgggctggatccggcagccccgaggggaagggcgtggagtggattgggactagtctctcataggtgggagcaccgtactataacccgtccctcaagagtcgaggcgccatatcagtanacacgtccaagaccagttccncctgaanctgagttctgtcgaccgccgcacgacgaccggccgtacttaattacgtgtggaccgaggtacgttcggacccctagtacgtacccagcctgtccttccgctagtgtcttttagattactcgtcgggaccaaaggggaactaagtgggtacccaccgggtttctccgttacgtacgccccgttaccaacccggaacggtcccgaacgtttcccgggtccctttcccccgtggaccccgtaccccttccccgtacctaacggacctcccgtacccgttccgggttaccggggccgtaacccgtacgggacccgggtcccggttacggggtcctacggcccgttcgggttaccgaacgggtacccgttaccgttccgtaaccttccgtaaccaacccgttacgtcggtacggccgggttccgtacgggcgacggtccgg

SEQ ID NO: 188651 - DNA, 639 bp, Homo sapiens
  misc_feature: GYAE6OF02JCWVY.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctgttactccatcagctagtgttactacgtggggctggatccggcacgcccccgaggggaacgggctggaggtggattgggactatctctctagtaggtggacgctacctactactaaccccgtcctacaagcgtcggaggccgcatactacgagtacgacgacgtaccgaaacgtaaccctacgtaccttaccgtagaacgtcgtggtacgtttctggtcgacccggccgtcgaacgtaccgaccggtccgtacttacttaccgtggttcggacgtaacggttacggttaccgaccccgtacgtaccgtaccgacgttcgttcgtttaacccgttcgacccttagttcgttcgtttagtacgttagttccggacgggtaaccgaacgggtacctaaggttcggtacctaccggttcttacccg

SEQ ID NO: 188652 - DNA, 660 bp, Homo sapiens
  misc_feature: GYAE6OF02F81UY.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcacgcccccaggggaaggggctggagtggattgggactatctctcatagtgggagcacctactataaccccgtccctcaagagtcgaggcgccatatcagtagacacgtccaaagaaccagttcctccctgaacgctgagttctgtcgaccgcgcagacacggccgtctaattctgtgcgagtaggttcggccccatacgtaccagctcgtccttccggctatcgtcttttgattagtcgtcgggggaccaaaggggactaagtcgggtacctacccggttctctttcgacgtccccttacccaacccgaacgggcccctacgtcccggttcccttcccccgtcggtcccctaccccttccctacccgtaacgaccgtccgtacccgttccggtcgggggacctaccggaccggcccgggtccccgtcgggccgtcggtccgttacggaccgtaacggtaccttaccttcctacttacctacctaccgttacgtcggacggccgggtctcgggaccgagggccg

SEQ ID NO: 188653 - DNA, 734 bp, Homo sapiens
  misc_feature: GYAE6OF02JE3YE.37.2.A02.1.454.CMB.1.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagccccagggaagggctggagtggattgggactagtctctcatagtgggagcacctatataacccgtcctcaagagtcgaggcgccatntcagtagacacgtccaagaccagttcctccctgaacnctgattctgtcgaccgccgcagacacggccgtctattactggtgcgagacgttcggccccatacgtaccagctgtccttaccgcctatcgtcttttgattactcgtggggacctaaaggggacctaagttcgggtcctaacccggtcttctttccgacgtccctaccgaaccgaaccgggtccctaagtcccggttacccgttcccccgtcggtaccctaccccgttccgtacccgtaacgaccgtccgtacccgttcgggtaaccgggggtcccaaccgtaccgggtacccgggtccccggttacggggtccgttaccggtacccggttacgggttaacccgaacggggttaaccccttaccgggttttacccctaacggtttaaccccgttaaccgttaaccttaaccggttacgggaccgggttaccggggtaccccgtacggggtacccggtaacgggttaccccgg

SEQ ID NO: 188654 - DNA, 573 bp, Homo sapiens
  misc_feature: GYAE6OF02FYSLU.37.2.A02.1.454.CMB.1.raw
  modified_base (363)..(363): a, c, t, g, unknown or other
  misc_feature (363)..(363): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtgttactacgtggggctggatccggcacgcccccgagggaaggggctggagtggagttgggactagtctctcgagtaggtgggagccacctactactaaccccgtccctacaagagtcgaggcgcatancagtagacacgtcaaagacctagttcctcctagacgtctagtagttcgtgtcgacccgaccgcagaccgaccggtccgtacttattctgtcgaggtagtacggttcggacccagtacgtaccgagtctcgtccttccgctagttcgtccttttgacttacgtcggttacgggaccgtaagggactacgttcggacttacccgtcgttccg

SEQ ID NO: 188655 - DNA, 753 bp, Homo sapiens
  misc_feature: GYAE6OF02HYH9T.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactacgtggggctggatccggcacgcccccgaggggaaggggctggagtggagttggggactatctctcgagtaggtgggagcacctactactaacccgtcctacaagacgtcggacggcgaccatatcgagtagacgacgtaccaaagaacctagttcctccctaggacgctagtacgttctcggtcgaccgccgacacggaaccgaccggtccgttactaacgtttaccgttggtacggaccggtagggtacggtttacccgggacccccgtaaagtttaaccggtaacccgtcggttacccgtttaccggtttccccgttttaccccgggaccccttacggtttaccgggtttttcccgtttttttaaggaacccgtttttaaccggttacccgggggtttaccggggggggtaaaccccggttaaaaccgggggggttaaaccttaaaaccggggttttaccgggggtttaaccccgttaacccccgggtttaccgtttttaccccccgg

SEQ ID NO: 188656 - DNA, 682 bp, Homo sapiens
  misc_feature: GYAE6OF02H9GFN.37.2.A02.1.454.CMB.1.raw
  modified_base (335)..(335): a, c, t, g, unknown or other
  misc_feature (335)..(335): n is a, c, g, or t
  modified_base (446)..(446): a, c, t, g, unknown or other
  misc_feature (446)..(446): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccgttcggacgaccctcgtccctcgacctgacactgtctcgtggttactccatcagctagttggttactacgtgggctggactccggcaccgccccgaaggggacgggcgtgggagtcgggagttcgggactagtctctactagtaggtggacncgaccttactaacgtaccccgtacctacaaaggacgtacggacggaccgacatactacgacgtacgaccaccgtaccaaaacgaacctacgttacctcccgtaagaacgtnttacggtacgtttctacggtcgacccggtaccggtacgaaaccggtaaccgtaccccgggtacccgtttctttaacgttaccgggttcgtccgggtaacggttacggcgggtttaacccgaccccgtaagttacggtaaccctagtccgttcgtcccttaccgacctgttacgttctttagacttacggtcggttacggacgtaacggactaaggtccggtactccgttctacccg

SEQ ID NO: 188657 - DNA, 571 bp, Homo sapiens
  misc_feature: GYAE6OF02JXA4V.37.2.A02.1.454.CMB.1.raw
  modified_base (182)..(182): a, c, t, g, unknown or other
  misc_feature (182)..(182): n is a, c, g, or t
  modified_base (198)..(198): a, c, t, g, unknown or other
  misc_feature (198)..(198): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
  modified_base (534)..(537): a, c, t, g, unknown or other
  misc_feature (534)..(537): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(549): a, c, t, g, unknown or other
  misc_feature (543)..(549): n is a, c, g, or t
  modified_base (551)..(571): a, c, t, g, unknown or other
  misc_feature (551)..(571): n is a, c, g, or t
tcagtagtgtagatcacgaccggtgctcgatttagactcatctacagggaaagtgctggagtgggttggccgaattagaagtaaagctaacagttacgcgacagcatatgttgcgtcggtgaaaggcaggttcaccatctccagagatgattcaaagacacggcgtttctgcaaatgaaacngccctaggaaaaccgnggtaccacggccgtagtattactgtatgtatagcagtgctcgagggtaacctactacgggattcggaccgttcgtacggggcccgaaaggggacccgacggttaccgaaccggttcctccggtccacgtcccctcccgaacccaaacggggcccccaacgtccggtacctttccccccgcggtcccacccctccccgtccaaacgcgcctaaccgtccgtcgggggccacgacgccggcccgtcgggctcggccttcgggccaacggcttaaccgtccacgtcgtactaccgtactgacgcggtaccgcgtcgacggccganacgtaacgntacgnnnnancncnnnnnnncnnnnnnnnnnnnnnnnnnnnn

SEQ ID NO: 188658 - DNA, 659 bp, Homo sapiens
  misc_feature: GYAE6OF02G6GHL.37.2.A02.1.454.CMB.1.raw
  modified_base (540)..(540): a, c, t, g, unknown or other
  misc_feature (540)..(540): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccgaggggaagggctggagtggattgggactatctctcatagtgggagcacctactactaacccgtcctacaagagtcgaggccgccaatatcagtagacacgtaccaaacgaacctagttcctccctagaacgtctaggtagttctggtacgacccggcccgacgaacgaccgaccgggtcccgttacttaattacgtggtcgacggagtacggtttccggcccctaagtacgtacccagtcttcgtccttccggctagttcgttcttttagattactcggtcggggaccaaaggggactaaggtcggtacctaccgttcttctcgacgccctaccgaaccgaacggccctacgtccgttcccttccccgtcgccctaccctccctaccgaacgtcncctacctcggtcgggacacgacgccggccgtcggcgtcgccgtcgaccgacgtactaccgtcctactaccgtaactaccgttacgtacggacggtccgggcgtacggtacgaggtaccg

SEQ ID NO: 188659 - DNA, 703 bp, Homo sapiens
  misc_feature: GYAE6OF02IP2TU.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcggcccaggaatggtgaagccttcggagacctgtccctcacctgcactgtctctggttactcctatcagctagtcggttactactggggctggactcggcacgcccccgagggaaggggctgggagtcggtagttcggggactatctctcgagtaggtgggagcgtaacctactaactaacccgtacctacgaagtacgtcgacggcgtaccatactcaagtacgactacgtaccaaagaacctacggttcctacccgtaggtaaacgtcgtaggtacgttcgtacggttcgaacccgccgtacaacgggaaccaccgggtacccgtacgttaataaccgttggtcgaccgtaaggtacgtttacggacccctaagttaacgtaaccgtacgtccgttacggttccgttaccccgtcgtaagtttccgggtttcttttaacggaactttacggttacccgggttaacgggggtaaccgtaaacggggtaaaccttaaacggttccgggttaaacccgttaccccggttaaccgtttacccgg

SEQ ID NO: 188660 - DNA, 783 bp, Homo sapiens
  misc_feature: GYAE6OF02IHNR0.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggccaggaatgggtgaacgccttacggacgaccctcgtccctcacctgccactgtctcgttcggttacctccatcagtcaggttcggttactacgtggggctggacgtccggcaccggcccccggaggggacggggcgtgggaggtaggtagttgggtactactctctgtagtaggtggacgtctacctactaaccgtacccgtacctacgaacggtcgtacggacggccgacctatactacgaagtacgaaccgtaccgtaaccgaaacgaaccgtacgtttaccctacccgtaggtaacgtcgtaggtacgtttacgtcggttaccggacccggtaccgaccgaaccggtaccggtacccggttaccggtttaaccttaagtttaaccggttcggtacggtaccgggtacggttaccggttacccggacccgtaagttaaccgtacccgttcggttaccgttcgttaccccgttcccgtacgttacgttccggttttaccgtttaggtaaccgtttacgggttacccggggttacggggtaaacccggtaaacgggggtaacctttaacgggttaccggggtttaaccccttacccgggtttaccctttaaccccggg

SEQ ID NO: 188661 - DNA, 697 bp, Homo sapiens
  misc_feature: GYAE6OF02H3ZX3.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataaccccgtcctcaagagtcgaggcgcatatcagtagacacgtccaagaaccagttcctccctgaagcctgagtttcgtgttcgaccggcccgcgaagaccacgggccctactaacttactgtgcgagagttcgaccccatagtaccagctcgtccttccgcctatcgtctttgatatcgtggggaccgaagggactaagtcggtacctacccgttacttctacaccggtccctaccccaaccggaaccggggtaccctacgttcccgggttcccttccccccgttacggcccctaccccgttaccctacccgaaacgtacgaccctacccgttcgggttcgggggaccgtacgaccggtcccgggaccccgttggggcccttcggtcccggttacggggtaccaacggggtacccttaaccgttccctaacgttacccttaacctaacccttacggtacggtaggggacccgggcgttacggggaccgtaccggccgg

SEQ ID NO: 188662 - DNA, 695 bp, Homo sapiens
  misc_feature: GYAE6OF02JHMJ3.37.2.A02.1.454.CMB.1.raw
  modified_base (226)..(226): a, c, t, g, unknown or other
  misc_feature (226)..(226): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtccaggtgcaactgcaatagtcgggccaggaatggtgaagccttcggacgaccctgtccctcacctgccactgtcctcgtcgttacnccatcagcagttcgttactacgtggggactggactccggcgaccgccccggaagggaaggggctgggagtcggagttcgggactactcgtctacgagtaggtaggacgtccaaccttacctaaccgttaacccgtccccgttagaacggcgtcgacggaccgacctaatactacaacggtaacgaacgtaccgtaccgaaacgtaaccctacgttacctaccgtagaacgtcgtagttacgttacgtacggtccgaccgtccgacaacggaccgacggtccgttacttacgttacgtcggtacgtacgacgtaccggttccggaccccgtaagttacccggtaacgacggtttccgttcgtaccccgttacccgacgttcgtttacggttaccgtttaaggaccgttagttcccgggaacgggtaacgaacgggtactaacggttccggtacccgtacggttactcccg

SEQ ID NO: 188663 - DNA, 904 bp, Homo sapiens
  misc_feature: GYAE6OF02IVI1B.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactacgtggggctggatccggcacgcccccgagggaagggctggagtggattgggactagtctctcagtagtgggagcacctactactaacccgtccctacgaagacggtcgaggccgacctatactcgagtacgacaccgtaccaaacgaacctagttcctacctagaagcgtgtagtttctggtcgacccgccgacacgtacaccggaccgttactaactttaccgtagttcggacggtggtaacggtttccggaccccctagttaacggtaaccctaggtacgtcggttcccgtttcccggacctaacgtttcgttaccgtttttagtacgttaacgtttcggtacgggggtaccgtaaacggggaacgtaaaacgttcgggttacccgtacccgtttcgtttacccgtttaccgacgtccccgttaacccgaacccggtaaaccggggtacccctaaccggttaccccgggtttcccgttttacccccccgggtccggtaacccccgttaacccccgtttcccccgtaaacccgtaaaaccgggtaacccgtacccggtaacccgtacccgggttaccggggggtaccccgtacccggtaacccggggtccccgggtacccccggttccgggggttacccgttccgggttacccgttccggggttaaaccgggaacgggttaccccgtttaacccgtttacccggtaaccttacccgttaaaccgtaacccgttacgttacgggtacggtcccgggtacggtaacgggtcggaaccggtaccgg

SEQ ID NO: 188664 - DNA, 791 bp, Homo sapiens
  misc_feature: GYAE6OF02JU3PJ.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagagtgggtcctgtcccaggtgcaactgacaataggtccgggcccaggaatgggtagaacgtccgttcggacgtaccctcgtcccctcacctgccactgtctcgtcggttacctccatcagcagttcggttacacgtcggggctggtacgtccggacaccggcccccggtaaggggaacggggcgtaggggcgtacggggtagttacggggacttacgtccgtacgttacgagttaaggggtgggaaccgtcctaaccctttacgtaaacccggtttaacccccgtaccccgttagaaacgggaacggtccggaaacggggtccctacccggtaattaaccgtacgtaacggttaaaccggacccgaaccgttaacccgaaaacccgtaaccgtaaccgtttcccgtaaccgtacggacgtaccgttacgtagtttcggaccggttacggacccgtaccggacgaccggtaacgcccggttacccgttacgttaacttcccgttggtaccgaccggtaaggtcccggttccggaacccctagttaccgacccgtaacgtcgttcctaccgtcccgtaccgtagttccggtttaacttggttaaccttagtcccgggtaaggtcccggaaaggtcccgttaagtacgtcccgtccgttacctccg

SEQ ID NO: 188665 - DNA, 642 bp, Homo sapiens
  misc_feature: GYAE6OF02INVPU.37.2.A02.1.454.CMB.1.raw
  modified_base (550)..(550): a, c, t, g, unknown or other
  misc_feature (550)..(550): n is a, c, g, or t
tcagtagtgtagatcacgaccggtgctcgatttagactcatctacaggggtcgtccgaagccttcggagaaccctgtccctcacctgcactgtctctggttactcatacagcagtggttactactggggctggagtccggcagcccccagggaaggggctgggagtggattggggactatcctctcagtaggtgggagcacctactataacccgtcctcaagagtcgaggcgccagtactcagtagacgtaccgtaccaaagaacctagttcctcccgtagaacgtctagtacgtttctggtcgacccgccgcagaccgccggccgtcttacttacgtggcggacgaggtgttcggccccagttacgtaccagtcctgtaccgttccgcgtagtcgtacgtttttgacttgtcggtcggggaaccaaggggacctaaaggttcgggtaccctaccggttccttaccgttccgacgtcccgtacccgaaccgtaccgggacctacgtccgtcccgttccccgtcgaccctccctccgtaccgaagacgccncgtcggcgggcacgcgccggccgtcggcgtcgtccgtgtacacggtactacgtccactctacactagtcgacggtcgtacgcggcgaggtcg

SEQ ID NO: 188666 - DNA, 547 bp, Homo sapiens
  misc_feature: GYAE6OF02IFAKE.37.2.A02.1.454.CMB.1.raw
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (469)..(469): a, c, t, g, unknown or other
  misc_feature (469)..(469): n is a, c, g, or t
  modified_base (536)..(536): a, c, t, g, unknown or other
  misc_feature (536)..(536): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgccccccaggggaaggggctggagtggattgggactatctctcatagtgggagcacctactactaacccgtccctcaagagtcgaggccgccatatcagtagacacgtccaagaaccagttctccctgaagctgagttctgtcgaccgccgcagacacggccgtctattactgtgcgagngtcgcccatacgtacngctgtctccgcatgtcttttgatntcgtgggaccgagggacaagtgcaccgtctctcncnccctccaccgaacggccctagtccgtcccttccccgtcgcctaccctcctacacgacgccacctcggcgggacncgacggccggccgtcggctcgccgtgcacgtcctacgtccactcctactactacgtcgaggtccggngcggacaggcg

SEQ ID NO: 188667 - DNA, 908 bp, Homo sapiens
  misc_feature: GYAE6OF02IJ62L.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactacgtggggctggatccggcacgcccccgagggaaggggctggagtggattgggactatctctcataggtgggagcacctactaactaacccgtccctacaagacgtcgaggccgccatatcagtacgacaccgtaccaaagaacctagttcctccctagaagtccttggtagtttcgttggtcgacccggccgacacgaaccgaccggccgttacgtattacgtgtggcgaggtcgttacggcccctaagtacgaacagctacgtccgttccgaccgtattcgttctttttacgaagtttcgtacggttacgggggtaaccgaaacggggtaacgttaaacggttccggtacccgtaacccgggtttccctttaccttaccgtaccgtaccccgttaaccccgaaccccgggaaaccggggtacccctaaacggtttccccgggtttacccccttttacccccccggttaccgggtacccccctaacccccgttttaacccccgtaacggtaaaccggtaacccgtacccggtacccccggttaggggttacccggggggaacccgtaaacccggtacccggggtccccgggtaacccccgggttcggggggtacccgtttccgggtaccccggttaccgggggttaacccgttaaaaccggggtaccccttttacccggtttaacccgttaaacccgtttacccgtaacccttaacccggtttaaccggtacggggtaacccggggtccggggtaaccgggttaccgggaaccggtaacggggcccgg

SEQ ID NO: 188668 - DNA, 578 bp, Homo sapiens
  misc_feature: GYAE6OF02HMT0U.37.2.A02.1.454.CMB.1.raw
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (396)..(396): a, c, t, g, unknown or other
  misc_feature (396)..(396): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaggggctggagtggattgggactatctctcatagtgggagcacctactataacccgtccctcaagagtcgaggcgccatatcagtagacacgtccaagaaccagttctccctgaagctgagttctgtgaccgccgnagacacggccgtntattacngtgcgagngtcggcccatacgtaccagctgtcttccgctatgtcttttgattatcgtgggaccaagggactaagtggtccaccgtctcttcncgtccctaccaaccgaacgggacccacgtccggttcccttccccgtcggccctaccctccctccgaacgacgacctaccgtcgtcggggaccacgcgccggtccgtgggtccgtcgccgtgcgacgtaccttaccgtccactcctaactactacgtcggacggccggtcgtcggacgaggcg

SEQ ID NO: 188669 - DNA, 727 bp, Homo sapiens
  misc_feature: GYAE6OF02H0W1M.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctccagatgggtcctgtcccaggtgcaactgcaagagtcggcccaggatggtgaacgccttcggagaccctgtccctcacctgcactgtctctggttactccatcagcagttggttactacgtggggctggacgtccggcaccggacccccggaaggggaacggggcgtgggaggtggtagttacggggactacgttcttaccgttcgaagttaggtacggggacgaccgtaacccttaacgttaaaccttaaacccccggttaccccttacgaacggtacggtacggacggacccgacctaagtactacgaaggtaacgaaccacgttaacccgaaaacggtaacccgtacgtttaccctacccgtagaacgtccgtacggttaacgtttccgttacggttacccgaccgtaccgacggacctaccgggtaccttacgttatttaccgtaggtacgacgtaggtacggttaccggacccctaagtaccgtaccagtccgttaccgtcgttcccgactacgttcgttcgttttacggaatttacggtacggtcgggtaacctaaggggtactaacgtacggttacctacccgttcttacttaccg

SEQ ID NO: 188670 - DNA, 557 bp, Homo sapiens
  misc_feature: GYAE6OF02GDENH.37.2.A02.1.454.CMB.1.raw
  modified_base (225)..(225): a, c, t, g, unknown or other
  misc_feature (225)..(225): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtcccctcacctgcactgtctctggttacnccatcagcagtggttactacgtggggctggatccggcacgcccccagggaacggggctggagtggattgggactatctctcagtagtgggagcaccgtactataccccgtcctacaagaggtcgaggcgccatatcagtagacacgtacaaagacctagttcctccctgagcgtgattctgtcgaccgtccgacacgaccgacggccgtacttagtactggtgcgagtgttcgccccagtacgtaccagtctgtccttcccgcatcgtcgttttgacttagtccgtacggggtaccaagggactaagttcggtactacccgttcgttacccg

SEQ ID NO: 188671 - DNA, 718 bp, Homo sapiens
  misc_feature: GYAE6OF02HXBRK.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgacaagagtcggccaggaatggtgaagccgttggacgacctgtccctcactgcactgtctcgtaggttactcatcagcagtcgttactacgtggggctggactccggacaccggccccggaaggggaacggggcgtagggtagggtggtacggttagggactatcgtctacgagtaggtcgggacacctacgtaactaacgtaaccccgtcctaagaggacgtcggacggaccacctaagtatcgaagtaacgactacgtaacaaacggtaaccttacgttacctacccgtagaacgtcttaggtacgtttccgtagtacggaacccgcgtacgaacggtaccgtaaaccggtcgttaactttaacgttacgtcggtacggaacccgtaaaccgtaaaaccccttaaccgtttcttaaaaccgtaccttaaacgacggtaccggtaaacggttcggtaaccgggggacgtaaacggggccctaacgggtccctaacccgttcgtacccgtaacgcggacccttaccggaacccgtaaacgggtccctacgttccccgttacccgg

SEQ ID NO: 188672 - DNA, 640 bp, Homo sapiens
  misc_feature: GYAE6OF02FU1G1.37.2.A02.1.454.CMB.1.raw
  modified_base (244)..(244): a, c, t, g, unknown or other
  misc_feature (244)..(244): n is a, c, g, or t
  modified_base (484)..(484): a, c, t, g, unknown or other
  misc_feature (484)..(484): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtgtactacgnggggctggatccgcacgccccgagggagggcgtggagtggagtggactatctctcataggtgggagccacctactaaccttaaccccggtccctacgtaagacgtcggacggccgacatactcaagtacgaccacgtaccaaacggtaaccctagttaccctacccgtagaacgtctaggtagttctggtcgacccgtccgacgacggaccgaccgggtcctacttacgttactggtcgngacgtggttaccggaccctaagtaccggtaccacgtaccttcggttcccgttcccgcctagttcgttccgttttagaaccttcggttccgggttaccggggtaccgtaaggggtaacctaaacgggttcggtacccttacccggttcttaaccccg

SEQ ID NO: 188673 - DNA, 718 bp, Homo sapiens
  misc_feature: GYAE6OF02HKTOY.37.2.A02.1.454.CMB.1.raw
tcagtagtgtagatcacgaccggtgctcgatttagactcatctacagggggctttctgagagtcatggacctcctgtgcaagaacatgaagcacctgttggtttttcctcctgctggtggcagctcccagagtgggtcctgtcccaggtgcaactgcaagagtccgggcccaggaatgggtgaagccttcggacgaccctgtcccctcaccctgctactcgtctcgtacggttacctcctatccaagtctaaggttcgtttaactacgtgggctaggactccggcacgccccgaagggaacgggcgtaggagtggacgttaggactactctctcagtaggtggacgccaacctaactacgtaacccgtcctacaagtacgtacggacggcgaccatactacgaagtacgaacgtaccgtaacgaaacgtaacctacgttaccgtccgtaagaacgtacgtgtacgttacgtcgtaccgaccggtccgacgacgaaccgaccgtaccgttacttacgttacgtcgtacggacgtaacgtacgttaccggaccctaagtaaccgtaaccgtacgtcgttacgttcccgttaccgtaccgtacgttcggttacgtttttaacggaactttacggttaccgggttaccggggaaacccggttaacggggtaaaccgttaaacggttacccggttaacccgttacccggttctttaaccccgg

SEQ ID NO: 188674 - DNA, 611 bp, Homo sapiens
  misc_feature: GYAE6OF02HZ3DA.37.2.A02.1.454.CMB.1.raw
  modified_base (183)..(183): a, c, t, g, unknown or other
  misc_feature (183)..(183): n is a, c, g, or t
  modified_base (292)..(292): a, c, t, g, unknown or other
  misc_feature (292)..(292): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
tcagtagtgtagatcacgaccggtgctcgatttagactcatctacagggtctccgaagccttcggagaccctgtccctcacctgcactgtctctggttactccatcagcagtggttactacgtggggctggatccggcacgcccccgaggggaaggggctggagtggattgggactatctctnataggtgggagcacctactactaacccgtcctcaagagtcgaggcgccatatcagtagacacgtcaaagaaccagttcctcctgaagctgtagttctgtcgaccgccgngacgacacggccgtactattactggtgcgagtagttcggccctagtacgtacagcctcgttctccgcatcgtctttgattatcgtgggaccgaagggacaagtcggtcacgtcttctcncgtccaccaccgaacggccacgtccgtccttccccgnggaccacccgtacctaccacgacgcctaccgtcggcgggcacgacggccggtccgcggtccgtcggccgtacggtaccgtaacggtacctaccgttaccgtacttaccgtaacctaaccgtacgtcgggaccggtccgggtaccggtcggacggaaccggcgg

SEQ ID NO: 188675 - DNA, 777 bp, Homo sapiens
  misc_feature: GYAE6OF02HUCC6.37.2.A02.1.454.CMB.1.raw
  modified_base (215)..(215): a, c, t, g, unknown or other
  misc_feature (215)..(215): n is a, c, g, or t
  modified_base (292)..(292): a, c, t, g, unknown or other
  misc_feature (292)..(292): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaagggctggagtggattgggactatctctcatagtgggagcacctactactaaccccgtccctanaagacgtcgaggcgaccatactcagtacgacaccgtaccaagaacctagttcctccgtagaacgctagtacgtttcnggtcgacccgccgacaacggaccgaccgggtacccgttacttaacgtttaccgttggtcgggacgtaaggtacggtttccgggacccctaagttaccgtaaccaggtccgttacgttcccgttacccgccgtaattacggtttccgtttttagagttaccgttcggtacggggaccgaagggtactaacgtggtaccctaccgtcttacgtcgacgtcctaccgaccgaaccggtccacgttcccggttccctccccggtcgacccgtaccccttccgaccgacgacgaccctaccggttcggtaccggggacctaccgaccggtcccggtacccggtgggtaccgtccggtaccgttacgggtaccggtaaccgttaccgttaacccgttcctaaccgttaccttaaccgttaacccgtttaccggtacgggttaccgggtacccggggttaccggtaacgggtacccggtaacgggtacccgg

SEQ ID NO: 188676 - DNA, 740 bp, Homo sapiens
  misc_feature: GYAE6OF02HY94P.37.2.A02.1.454.CMB.1.raw
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaaggggctggagtggattgggactatctctcatagtgggagcacctactataacccgtcctnaagngtcgaggcgcatatcagtagacacgtacaagaaccagttccncctgaagctgagttctgtcgaccgcgacagacacggccgtatacgttactgtggcgagagttcggcccctaatagtaccagtctcgttcctccgccagtcgtactttttgaattacgtcgtacggggaccaaggggactaagttcgggtaccaacccgtttcgtcctttacctacggtaccctaccccgaaccgtaaccgggacccctaacgttcccgggtttacccttcccccggttccggacccgttaacccccgtccctacccgtaaaccggtaccggaccctaacccgttccggttaaccgggggacccaaccgtaccgggacccgggtaccccggtcggggtacccgtcggtacccgtacgggtaccgtaaaccggtaccgtttaaccccgttaccgttaacctacccgtaaccttaacccgttacgttacggtaaccggtcccgggtaccggttaccggtaccggacgggacccgg

SEQ ID NO: 188677 - DNA, 672 bp, Homo sapiens
  misc_feature: GYAE6OF02GM1DB.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccgagggaagggctggagtggattgggactatctctcatagtgggagcacctactactaacccgtccctcaagagtcgaggcgccatatcagtagacaccgtccaaagaacctagttcctccctagaacgctgagttctggtcgaccgccgcagacgacggccgtctattactgtgcggagcgttcggcccctatacgtaccagctgtccttccgcctagtcgtcttttagattatcggtgggaccgaagggactagtggtaccaccgttctcttcacgtcctacccgaccgacgggaccctacgtccggttcccttcccccgtcggccctaccctccctaccaacgacgcctacccgtcggcggggtaccacgacggcccggtcccggtcgggtcccgtcggtccgttacggggtaccgtaacgggtaccttacccgttccgtaacttacccgtaacccgtaccgttaaccggttacgggtaaccgggtccggggtcccggtttaccggggaccggtacgggtacccgg

SEQ ID NO: 188678 - DNA, 784 bp, Homo sapiens
  misc_feature: GYAE6OF02JLOOD.37.2.A02.1.454.CMB.1.raw
tcagtagtgtagatcacgaccggtgctcgatttagactcatctacagggtcgtccgaagccttccggagaccctgtccctcacctgcactgtctctggttactccatcagcagtgttactacgtgggctggatccggcacgccccgagggagggctggagtggattgggactatctctcatagtgggagctacctactactaaccccgtccctagaagacgtacgaggccgccatactcgagtagacacgtccaaagaacccagttcctccctagaacgtctagtagttctacggtcgaccgccgcacgaaccgaccggccgtacgtacttacgtaggtacgcggtagacgttacggacccctaattacgtacccgagtccgttcgttccttaccgccgtacgttcgtacctttttagacgtttacgtcggtcggggtaccgaaacgggtactaacgtcggtaccctaccggttccttacttaccgaccgtaccttacccgaaccggtaacccggtacccgtacgttacccgggttaccctttaccccccgtcggtacccgtaccccgttacccgttaccccgaacggtaaccgtaccctacccggttaccggtccgggggtaccctacccggaccggtcccggtaccggtcgggtcccgtaccggtacccggttcggtaaccgtaccgtaccgttacccttacccggtaattacccgtaaccgttaccgttaaccgtacggtacccgggccgggtaccggtacgggtaccggacggtacccgg

SEQ ID NO: 188679 - DNA, 855 bp, Homo sapiens
  misc_feature: GYAE6OF02HWIHT.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcagcccccgagggaaggggctggagtggattgggactatctctcatagtgggagcacctactataaccccgtccctacaagacgtcgaggcgccatatcagtagacacgtaccaaagaacccagttacctccctagaacgtctggtaacgtttctcggttacggacccgccgaccgaacggaccaccggggtcccgttacttacgtttaaccgtggttggcggtaaggtacggtttaccgggacccccctaattacggtaacccctaggtccgttcggttccctttcccgacctagttcggttcgttttttcggaattaacgtttcggtacgggggtacccgtaaagggggtaacctaaacgtttacgggttccctaaccggttccttttccttccgtaccgtcccctacccgtaacccggaaacccgggacccgtaaccgtttacccggtcccgttttccccccgcgtaccctaccccgttccctaccgtaaaccggcgaccgtacccgtacgggtccgggggtacctaaccgccgggtacccggtcccggtccgggggttaccgttccggacccggttacgggtaccggtaaaccgggttacccgttaaaccgtttcccgttaacctttacccgtaaaccgttaacccgtaacggttaccggtacgggggtaccccgggttccggtttaacgggacccggtaaacggggtaacccgg

SEQ ID NO: 188680 - DNA, 739 bp, Homo sapiens
  misc_feature: GYAE6OF02H466S.37.2.A02.1.454.CMB.1.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (328)..(328): a, c, t, g, unknown or other
  misc_feature (328)..(328): n is a, c, g, or t
  modified_base (563)..(563): a, c, t, g, unknown or other
  misc_feature (563)..(563): n is a, c, g, or t
  modified_base (610)..(610): a, c, t, g, unknown or other
  misc_feature (610)..(610): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagacgtccggccaggaatggtgaacgccgttcggacgaccctgtccctcgacctgcactgtctcgttggttacctcatcacgactgttcggttactacgtggggctggctccggcacgccccgagggagggcnggngtgtagtgggactattctctacgtagtaggtggganaccgtaacctaacttaccgtaaccccgtcctacgtaagacggtccggacggtccgactaacgttacgtacgaagtaacgaaccgtaccgtaaccgaaaacgtaaccttacggttacccttacccgtagggtaactaccgtaggttacggtttacgtacgggtaccggtaacccggaccgtaccggaacgtacccggtaacggtccccgttacttaacgtttaccgtggtaccggnggaacggttccgggttaccggtaccccgtaagtaacccggttacccngggttaaccttccgggttccttaccggccttacgttcggttcgttttaacgaccggtttactaccggggttacggaccgtaaagggtaccgtaggtacccgggtttacctacccggtttaccttacccg

SEQ ID NO: 188681 - DNA, 843 bp, Homo sapiens
  misc_feature: GYAE6OF02FZC2D.37.2.A02.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaaggggctggagtggattgggactatctctcatagtgggagcacctactataaccccgtccctcaagngtacgaggccgccatatcagtanacacgtaccaacgaaccagttcctccctgaacgctgtagttctggtcgacccgccgccaggaccaccggtcctcttaacttacgttggtgcgagtacggttcggaccccctaagtaacgtacccgagtccgttcggttccttacccggacctagttcgttacgtttttacgtaattaacgtttccggttacgggggacccgtaaaacgggggtaaccgtaaacggtttcgggtaccccgtacccgggtttccttcccgtttaccgtaccgtccccgttaccccaaccccggaaacccggggtaccccgtaccgtttacccgggtttaccccgtttcccccccggttaccgggtaccccttaacccccgtacccctttaccccgaaacggtaacccgtaccccgtaaccccgttccgggttaccgggggggtaccaacccggtaaccgggtcccgggtccccggttaccgggggtccgttaccggtcccggttacgggttaccgtaacgggtaacccgttaacccgtttcccgtaacctacccgttaacctaaccgttaccgtacggacgggtaccgggaccggtaccgggaccgacgggtaccg

SEQ ID NO: 188682 - DNA, 723 bp, Homo sapiens
  misc_feature: GYAE6OF02F0BLN.37.2.A02.1.454.CMB.1.raw
  modified_base (303)..(303): a, c, t, g, unknown or other
  misc_feature (303)..(303): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccagggaagggctggagtggattgggactatctctcatagtgggagcacctactactaacccgtcctacaagacgtcgaggccgccatatcagtagacacgtccaagaaccagttctccctgaacgctgagttctgtcgaccgccgcagacaccggccgtntacttactgtgacgagagtttcggccccatacgtaccagtctgtccttccgcctagtcgttcttttgattacgtcggtcgggggtaccaaacgggggtacaagttcgggtcctaacccgggttcttcctttccgaacgtcccctacccaacccggtaacgggacccctaacgtcccggttacccttcccccgtcggtaccctaaccccctcccgtaacccacgtaccgccgtaaccctcgggtaccgggggaccaaccgaccggtcccggacccggttacgggccgttaccggtccgtacgggttacccggaacggtacccgtttaaccgttcccgtacgttaacccttaacccgtaaccgtttaaccggttcggacccgggtaccggggttaccgaccgggtacggtaacgggtcccgg

SEQ ID NO: 188683 - DNA, 706 bp, Homo sapiens
  misc_feature: GYAE6OF02IRB34.37.2.A02.1.454.CMB.1.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
tcagtagtgtagatcacgaccggtgctcgatttagactcatctacagggtctccgaagccttcggagaccctgtccctcacctgcactgtctctggttactccatcagcagtggttactacgtgggctgactccggcacgccccgaggggagggcgtggagtggagttgggactactctctcagtagtgganctactactaacgtacccgtcctacgaagagtcgacgccaccatacncgtagtagacctaccgtacaacgaacctacgttcctcccgtagacnctagtactcgtcgcgaccgccgacgacgaccgaccggtccgttactattacgtgtcgcgagtcggttaccgccctataccgtaccacgtcgtcgttcctccgctactcgttactttagtattacgttcgtcgggtaaccgtaggaactacgtccggtacctacccggttctaccgttaccgtccgtacccgtaccgtaccggaacccggtaccctacggttccgttccccgttcccccgtacgtccctaaccccttacccgaccgtaacgaccgtccgtaccggtccgggtacgggaccgacggtaccggccgggtccgtccggaccgtacggccgttcggtacgtaccgtaaccgttcccgttaactaccgtaccttaccgaccttcgtacgggtcggtccgacggtcgaccggtcgacgg

SEQ ID NO: 188684 - DNA, 794 bp, Homo sapiens
  misc_feature: GYAE6OF02GCJ2W.37.2.A02.1.454.CMB.1.raw
tcagtagtgtagatcacgaccggtgctcgatttagactcatctacagggggctttctgagagtcatggacctcctgtgcaagaacatgaagcacctgtgtttttcctctgcgtggtgcagcctcccagatggtcctgtcccaggtgcaactgacaagtacggtccgggcccaggaagtggtagaacgtccgttcggacgtacccctcgtcccctcgtaccgtcgcctacttgtccgttacgttcgttacctcctatcgaacgctaggttcgttaacgtcggtgggcgtacggtacgtcccggacgacccggaccccggaaggggtaccgggtcgtagggtaggtacggttaggttaccgggtacttacgtccgttacgttaaccggtagttacggggttacgggaacgtacctaaccttaaccgttaacccttaaccccggtacccttaacgaacggttaccggtacggtacggccgtaaccgtaacgttacgacgtaacggttaacgaacctaaccggttaccgaaaaccgtacccgttaggttccctacgttaagaaccgtcgtttacgtagtttcgtaccggaccgtccggacccgtacgaaccgtacccggtaccggtacccgttctttaacgcggttcgggctaaccggtacgtacgttccgacccgttaagtcccgtaacgtaccgtcgttacgttcccgtacccgcgtttacgttccgtttagttacgtacgttaccgtccggggaacgtacggtaacgtcgtaccgtagggtccctacgttctacg

SEQ ID NO: 188685 - DNA, 797 bp, Homo sapiens
  misc_feature: GYAE6OF02JN01F.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagcctcccagagtgggtcctcgtcccaggtgacaactgacaagtaggtccgggcccaggaatgggtgaacgtccgttcggacgtaccctcgtacccctcaccgtgacctacgttcgtacttcgttacggttacctccatcgacgtcgtaggttacggttaccttaacggtcggggtacgtcgggtacgtcccggaccgtacccggtacccccggaagggggaaccgggtcgtagggaggttcgggtaagttacgggtaacttacgtacgttaccgtacgtaagtcgggtaggtaccgtaccgtaacccgttaacgtaacccgtaaccccgtaccgtaacggaaggtaccgtaccggtacggccgacctaacgtactacgtaacgtacgaaccgtacgtaaccgaaaccgtaccgtacttacccgtaccgtagtaaccgtcgtacggtaacgtttacgtacgtaccggaccgacgtaccgtaacggaccgtacggtaccgttaacttacgttaacgtcgggtaacggtacggtacggttaccggttaccgaacccgttaaggtaacctacgtacgtcgttaaccgttcctaccgtaccgtgttacgtttacgttaggtacttcggacggtacggaacccggtaaggtacctaaggttcggaacccttcgtacgttacc

SEQ ID NO: 188686 - DNA, 706 bp, Homo sapiens
  misc_feature: GYAE6OF02HGLTT.37.2.A02.1.454.CMB.1.raw
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaatagtcgggcccaggaatgggtgaagccttcggagaccctgtccctcacctgcactgtctctgttacncatcagcagtgttacacgtgggctggagtccggcaccggccccgaggggagggcgtggacggtggagttgggactatctctntagtaggtgggacnctacctactactacccgtccacgaagcgtacggacggccgactagtactacgtacgtacgaaccgaccgtaaccgaaacgtaacctaacgtttccctacccgtaaggaacgtcgtggttaacgtttctacggtaccgacccggtacccgaccgaacgtacccggacccggttaccgttaaccgtactttccgacggttcggccggtaacgttaccggtcccggtacccctaagttaaaccggtacccgtaacggttccgtccgtttacccgttccgtaccgtaggtttccgttttaaccggtttttggaaacttccggttcggtaaccgggggtaacccggaaacggtcgtaacggttccgggttaccgtacccgtttcgtacccg

SEQ ID NO: 188687 - DNA, 725 bp, Homo sapiens
  misc_feature: GYAE6OF02HVX5V.37.2.A02.1.454.CMB.1.raw
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaaggggctggagtggattgggactatctctcagtagtgggagcacctactataacccgtccctcaagagcgaggcgccatatcagtagacacgtaccaagaaccagttcctcctaggaagcctgtagttctgtgacccgcgcagacgacggccgtactattacgtgtgcgagtagttcggcccctatacgtaccgagtctgttcctccgcctagtgttcttttagatacgttcggtacgggacaaacggggtaacaagtcggtaccgtaccgtctccttacgacgtcctacccgaaccgtaaccgggaccctacgttcccggttcccgttccccgtcggtaccctaccccgtaccctaccgtaaacgacgacccgacccgttcgggttaccgggggacctaaccggaaccggcccgggtaccccgtcgggtcccgtccggtaacccggttcgggttaacccggtaaccgggttaaccttaacccggtttaccctaaccggtttaccctaccgtaacccgttaacgtccggaacgggttaccccgggacggtacgggaaccggtaacggaacccgg

SEQ ID NO: 188688 - DNA, 826 bp, Homo sapiens
  misc_feature: GYAE6OF02HL33W.37.2.A02.1.454.CMB.1.raw
  modified_base (753)..(753): a, c, t, g, unknown or other
  misc_feature (753)..(753): n is a, c, g, or t
tcagtagtgtagatcacgaccggtgctcgatttagactcatctacgaggggctttctgagagtcatggacctcctgtgcaagaacatgaagcacctgtggtttttcctcctgctggtgcagcctcccagagtggtcctgtcccgaggtgcaactgacaagtaggtccggacccaggaagtggtgaacgccgttacggaacgtccctcgtcccctccacctcggaccacttgttccttcgttaggttacctccaagtcgacgtacgtagttacggttacctacggtgggcgttagggaccgtccggaccgaacccggacccccggtaaggggaacgggtcgttaggggacggttaggggacggtttacggggtaaccttacgttccgttaccgtacgtaacggtagggtacgggtaaccgaccctaaacccgttaaccgttaaaccccgtaaaccccggttccccgtaacgtaaacgggaaccggttaccggaacggccccgacgtactaacgtaccgaaggtaaccgaaccctaccgtaacccgaaacgtaaacccgtccgtttaaccctcccgtaacgtacgtcgttacgtacggtttcgacggttccggacccggtcgaccgaacgtaccgtaacccgggtccgttaattacgttaccgtgtcggcgttaacgtacgggtcccgtaccgtactaacccgtaccgcgttcgtacccgtcgtccccgacgttccgttgtttacgttttaacgngtttaccgtcgggtaccgggaacccgaagggttaccgtaaggttcccgtacccgtttaccgtcgttaacccgg

SEQ ID NO: 188689 - DNA, 914 bp, Homo sapiens
  misc_feature: GYAE6OF02JAVP9.37.2.A02.1.454.CMB.1.raw
tcagtagtgtagatcacgaccggtgctcgatttagactcatctacagggggctttctgagagtcatggacctcctgtgcaagaacatgaagcacctgttggtttttcctcctgctgggtggcagctccagataggtcctgtcccaggtgcaactgcaatagtccggacccaggtaagtggtgaagtcccgttacgggagaccccttcgtcccctcaaccgtgacctacttcgtcctcgttcggttactcctatccaagtctaggttacggttacgtacggtcggggtacgtcgggtacgtcccgggacgaacccggaccccccggaaagggggtaacgggggtccggtaaggggtaacggggttacggggtaacgggttaggggtaaccgttacgttccgttacccgtacgtaggtagggttaggggaaccgtaacccgtaaccgttaaccgtaaccccgttaaacccccggttaccccgttaacggaaacgggttacggtaccggtaacggggtccctacccgtaagttacgtaccggtaacggttaacggaaccgtaaccgttaaccgaaaaccgtaacccgttaccgttacctaccggttaacgaaccggttccgttaggtacctttacggttcgacggacccggtcccaacggtacgaacccgggtacccgtaccggttacttaaacgtttccgttagtcggaaccggttagggtacccggtttaccggaacccttaagtacccgttaacgacgtttccgttacggttcccgttacccgtccgttaggtttcccgtttaacggttttcaaccgggttcccgttaacggggtacccgggtaaaccgggttaaggttaaacccgggtaacgttacccgggtttaaccccgttacccggttaacggttacccc

SEQ ID NO: 188690 - DNA, 654 bp, Homo sapiens
  misc_feature: GYAE6OF02HF85J.37.2.A02.1.454.CMB.1.raw
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcagcccccgagggaaggggctggagtggattgggactatctctcatagtggagcacctaactactaacccgtccctacaagagtcgaggcgccatatcagtagacacgtccaagaaccagttcctacctgaanctagagttcngtacgaccgccacgagaccacggccgtctaattactgtcgacggagtacggttcggaccccatacgtacagtctgttacctccgcctatcgttcttttagattactcggtacggggaccaaagggacaagtcggttaccacccggtttctctacacgtccctaccgaaccgaacggccctagtaccgttccttaccccgtcggaccctaccctcccttacccgaacgtaccgaccaccgtaccggtcggggacctaccgacggccggccgtacgggccgtacggtaccgtacggtacgaacggtaccgtaccgttacctaccgtactaacctaacctacgtacggtaacggccggtacgtacggacgtaggaccg

SEQ ID NO: 188691 - DNA, 703 bp, Homo sapiens
  misc_feature: GYAE6OF02F0ZJG.37.2.A02.1.454.CMB.1.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcacgcccccgagggaagggctggagtggattgggactgtctctcagtagtgggagcacctactactaacccgtcctnaagngtcgaggcgcatatcagtagacacgtacaagacctagttcctcctgaacgctaggtagtttctgtacgccgccgcagacacgaccgttcttatacgtgcgacgacgtaggtcgacccagtacgaccagtctcgtaccttccgctagttgtcttttgacttcgtcggtggggaaccaagggaactacgtcggtacctaccgttcttaccgttcgtaccgtaccccttaccgaacccggtaccggtaccccgtacggtttaccccggttcccgtttacccccgtccggtaccccttaccccgttacccttaccgaaacgccgccgtacccgttccgggtacgggaccgtacgaccggtcccggtcccggttcggcccgttcgtaccggtacggttaccgaccgttaaccgttacccgttacctaacttcccttaacctaacccgttacgtacggaccgggtccggtacggaccggtacgaccggtacg

SEQ ID NO: 188692 - DNA, 852 bp, Homo sapiens
  misc_feature: GYAE6OF02GD4SU.37.2.A02.1.454.CMB.1.raw
  modified_base (286)..(286): a, c, t, g, unknown or other
  misc_feature (286)..(286): n is a, c, g, or t
  modified_base (847)..(847): a, c, t, g, unknown or other
  misc_feature (847)..(847): n is a, c, g, or t
tcagtagtgtagatcacgaccggtgctcgatttagactcatctacagggtctccgaagccttcggagaccctgtccctcacctgcactgtctctggttactccatcagcagtggttactactggggctggatccggcaggcccccagggaaggggctggaggtgggtggccaacataaagacaagagtaggaagtaagaagggagtagtgtggactcgtggtaggaacgggtccgtttaccgaccagtctaccgagacgaacaacgacaacgaacgtaccgtcganagttactgactaaaagttacgaaacgtacgttacgtaggaacggacggaaccggaacggaaccgtaccgggtaacgtttaaagttttaacgttaaccgttacgggacccggtaacggtaaggaaacggggtaacggtaaccgggttcgggggttacggtttaccggtaaccggtttaccgggtacgggggaccccgggaaaccggggttaaaccccggtcggttacccgggaaacccgttcccgttaccggtacccgtaccggtaccccgtacccggtaaacccggaaacccgggtacccgtaccgttacccgggtccccgtttacccccgtacgggtcccccgtacccgtccgtaccggtaccggaacgtccgaccgtacccgtaccgaacggtacgaccgtacgaccggcccggtacccggcggcccgtcggtccgtacggtaccgtaaccgggtaccttaccgttaccgaacgttacccttacggaccttacggtacggtaccgggtcgggtacggtccggtaaccggtaccggtaccgaccgacggtacgtcgacgntcgcg

SEQ ID NO: 188693 - DNA, 785 bp, Homo sapiens
  misc_feature: GYAE6OF02IA6A6.37.2.A02.1.454.CMB.1.raw
  modified_base (193)..(193): a, c, t, g, unknown or other
  misc_feature (193)..(193): n is a, c, g, or t
  modified_base (313)..(313): a, c, t, g, unknown or other
  misc_feature (313)..(313): n is a, c, g, or t
tcagtagtgtagatcacgaccggtgctcgatttagactcatctacagggtctccgaagccttcggagaccctgtccctcacctgcactgtctctggttactccatcagcagtggttactactgggctggatccggcacgcccccgaggggaaggggctgggagtggattgggactattctctcataggtgggngccacctactactaaccccgtccctacaagagtcgacggcgaccatatacgagtacggacacgtaccaagaaccaggttcctacctagaacgtctgtacgttcgtcgtcgaccggccganacggaccgaccggtccgttactacgtttacgtggtcgacggacggtaaggtttccggcccctaagttaccgtaacccagtccttcgtccgttcccgcctaagttcgttcttttaggactttacggtcggtacggggaaccgtaagggggactaaagttcgggtacctaccgttccttaccttacgaccgtcccctaacccgaacccgggtaacccgggtccctaaccgtttcccgggttcccccgtttccccccggtacggtacccccgttacccccttacccttaacccggaacgtaccggtacccctaccggttccgggtaccggggccctaaccgggaccgggcccggtacccgggttcgtcccgtccggtcggttacggtaccgtaaccggtaccgtttaccttaacctaccgtaccttaacgttccgtaagtcggcggtaccgggtcgtacgggacccgacggtccg

SEQ ID NO: 188694 - DNA, 599 bp, Homo sapiens
  misc_feature: GYAE6OF02FMEQB.37.2.A02.1.454.CMB.1.raw
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (366)..(366): a, c, t, g, unknown or other
  misc_feature (366)..(366): n is a, c, g, or t
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagccttcggagaccctgtccctcacctgcactgtctctggttactccatcagcagtggttactacgtggggctggatccggacacgccccgaggggtaagggctggagtggagttgggactatctctcagtagnggganccaccgtatactaacccgtcctagaagacgtcgacggcgcctaatacncagtacgacgtacgtacaaacgaacctacgttccaccctagaagtctgtagttctggtacgtacccgccgtacgagaccgaccggtccgtacttaacgttactgtacggtacgtaggtacgtccggaccctagtaacgtaccagtctcgttcctcgacctagtcgtcgtttagattacgtcggtacgggaccgtaaacgggactaacggttggtacctaccggttactacccg

SEQ ID NO: 188695 - DNA, 792 bp, Homo sapiens
  misc_feature: GYAE6OF02J1ZIE.37.2.A02.1.454.CMB.1.raw
  modified_base (304)..(304): a, c, t, g, unknown or other
  misc_feature (304)..(304): n is a, c, g, or t
tcagtagtgtagatcacgaccggtgctcgatttagactcatctacagggtctccgaagccttcggagaccctgtccctcacctgcactgtctctggttactccatcagcagtggttactacgtggggctggatccggcacgcccccgagggaagggctggagtggagtgggactatctctcatagtgggagcacctactactacccgtccctcaagcgtcgaggccgaccatatcagtacgacacgtccaacgacctagttcctcctagaagtctgagttctgtcgacccgtcgcgtacgaccncggccctacttacgtacgtgtacgcggacgtacggttccgccccgaattacgtacccagaccttcgtccgttaccgctaacttcggttcttttaggacttacgttccggtacgggggaacccgtaaggggtaactaaacggttcggtacccgtaaccggtttcccttaaccgttccgtaaccgtaccccgttaccccaaacccgggtaacccggggtacccctaaaccgtttcccgggttaccccgtttacccccgggttaccggtacccccttaacccccgtttacccgtaaccccgttaacgaccgtaccccgtaacccggtcgggtccgggtaacctaccggaccggtccccgggttaccgtcggggccgttccggaccgttccgggaacctaccgggtacctttaccgtaccgtacctaccttaacccgtaacgttacccgttacggacggtccgggtaaccgttcggggaccgtaggtacccg

SEQ ID NO: 188696 - DNA, 944 bp, Homo sapiens
  misc_feature: GYAE6OF02GC6WA.37.2.A02.1.454.CMB.1.raw
  modified_base (166)..(166): a, c, t, g, unknown or other
  misc_feature (166)..(166): n is a, c, g, or t
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
tcagtagtgtagatcacgaccggtgctcgatttagactcatctacagggtctccgaagccttcggagaccctgtccctcacctgcactgtctcgtggttactccatcagcagtggttactacgtggggctggactccggcacgcccgagggagggctgggagtggngttgggactatctctcataggtgggancacctatactacccgtcctacgaagacgtcggaggacnccatatacgagtaacgaccacgtaaccaacgaacctacggttacctacccgtagaaacgtcgtagtaacgtttcgtaggtaccgaccggaccgtcgaacggacctacccggggtccgttaactttacgttacggtcgtcgggtacggtacggtcgggttaccgggaaccctaagtaaccggtaaccacgttccggttacgttcccttacccgggaccttacgttacggtttacgttttaggtacttaaccggttcgggtaaccgggggtaacggtaaacggggaaacttaaaggttccgggtaacccgtacccgtttaccttaccggttacccgtacccggtacccctaacccggtaacccgggtaacccgggtaacccttacgggttaaccccggttttcccccggttacccccggttccgggtaaccccccttacccctttaccccgtaaacccggtaaaccggtaccgtaaccccggtacccgggttacgggttacgggggaacccttaccgggtacccgggtcccggggttacccggtcccgggggtttacgaccccggtttcgggttaacccgggaaccggttaccgggttaacccgttaacccgtttaccctttaaaccgttcccgttaaacccggttaccggttaaccggtttaaccgggcggggtaaccccgggttacggtcgggtaaaccgggacggttaccgg

SEQ ID NO: 188697 - DNA, 775 bp, Homo sapiens
  misc_feature: GYAE6OF02JWC9F.37.2.A02.1.454.CMB.1.raw
  modified_base (134)..(134): a, c, t, g, unknown or other
  misc_feature (134)..(134): n is a, c, g, or t
  modified_base (509)..(509): a, c, t, g, unknown or other
  misc_feature (509)..(509): n is a, c, g, or t
tcagtagtgtagatcacgaccggtgctcgatttagactcatctacagggtctccgaagccttcggagaccctgtccctcacctgcactgtctctcggttactccatcagcagtgttactacgtgggctggtacnccggcacgcccccgaggggaacgggcgtggtagtggtacgttgggtcctatcctctacagtaggtgggactccacctactaacgtaacccgtccctacaagtacgtccgacggccgtacctattacctcgtaacgtacggaacctaccgtaccggaaacgaacccgtcgttaccctcccggtaagtaacggtctaggtaccggtttcctacggtaccggtccccggaccgtcgaacgaccggtccggtacccgttacttacgttacgtggtaccgtaacggcggttacggtcccggtaaccgtacgttaaccgttacgaccgggtcttccggttacctccgtactacggttcgttcgttagtactacgtaccggngggtaaacgtaacggaagttctaccggtcgtaccgtttcaccgttacgacccgtacccgtacccgtaccggaaccggttccctcggttaccgtacccgttccccgtccgcccgttaccctcccgtaccgaaccgcgacccgtaccgacgtaccggcaccgacgccgtaccgtccgttcgacggtccgtacgtcgacgtaacgtccgtaccgtacgtacctacgttacctacggtactcggacggtccgtcggtacggacgtaccgg

SEQ ID NO: 188698 - DNA, 812 bp, Homo sapiens
  misc_feature: GYAE6OF02I8H51.37.2.A02.1.454.CMB.1.raw
tcagtagtgtagatcacgaccggtgctcgatttagactcatctacagggggctttctgagagtcatggacctcctgtgcaagaacatgaagcacctgtggtttttcctcctgctggtggcagctcccagatgggtcctgtcccaggtgcaactgcaagagtcgggcccaggaatggtgaagtccttacgggacgaccctgtcccctcacctgccactcgtctcgtggttacctccatcagctaggttggttactacggtggggtcgtggtacgtcccggccgaccggacccccggaaggggaacgggggtcgtacgggtaggtacgggtaggttacggggtaacttacgttcctacgttcgaagttacgggtagggacgtacctaacccgttaacttaacccgttaacccccgttacccgtacgaaacggtacggtaccggacggaccgtacctaagttaacgtacgaacgttaaccgaccgtaaccgtaccgaaaccggtaaacccttacggttaccctacccgtaggaacgtccgttagtaacggtttccgtaggtcccgtacccggaccgtacgaaccggtaaccgccggttaccgtacgtttaaccgttacggtcggtaccggtaccgggtaacggttaccggttacccgggtaccctaaaggtttaccggtaaccgtacggttccgttcggttaccccgtccggtacccttagttccgttacgttttagaacccgttggttccggtacgggtaccggtaacggtaccttaaccggtccggtaacccttaccggttactttaccccgg

SEQ ID NO: 188699 - DNA, 733 bp, Homo sapiens
  misc_feature: GYAE6OF02FJOCF.37.2.A02.1.454.CMB.1.raw
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (367)..(367): a, c, t, g, unknown or other
  misc_feature (367)..(367): n is a, c, g, or t
tcagtagtgtagatcacgaccggtgctcgatttagactcatctacagggtctccgaagccttcggagaccctgtccctcacctgcactgtctctggttactccatcagcagtggttaactactggggctggatccggcacgccccgagggaagggctggagtggtagttgggactactctctcagtaggtcgggacgacctaaccttactacctaaccccgtccctagaagcgtaccgaggccncctaattcncgagtacgaacctacgtaccaaacgtacctcgtttacctacccgagaacgtcgtgtacgttcagtaccggtacccgccgagaacgaccggtaccggtccgttacttacttacgngtacgacgtaggttacgtccgacctaggtacgtacgcgtcgttcgtacctccgtcgtatcgttactttggaactggtcggacggggaactaaggacttaacggtcgtaccctacgttcgttacgttacaccggtccctaaccgaacccggtaaccggtaccctacgtttcccgttacccgttccccggtaccgtacccgttacccctcgttaaccgaccgtaccgtccgtaccggttcgggacggccgtacgcccggtcgcccggtcgccttccggtaccgtacggacctacgttaccttaccgtacgacctttaccgaacccgttagtcggttacggccggtcggtacggtacgacggtcgtacg

SEQ ID NO: 188700 - DNA, 892 bp, Homo sapiens
  misc_feature: GYAE6OF02GX28J.37.2.A02.1.454.CMB.1.raw
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
tcagtagtgtagatcacgaccggtgctcgatttagactcatctacagggggctttctgagagtcatggacctcctgtgcaagaacatgaagcacctgttggttttcctcctgctggtggcacgctcccagagtgggtcctcgtcccaggtgcaactgacaagtacggtccgggacccaggaagtggtagaacgccgttcggacgtacccctcgtccctaccnccngtctacgttcgtcttcgttacggttacctccactcgacgctacggttaggttacgtacggtcggggcgtaggaccgtccggccggaaccccggaccccgggaagggggaaccgggtcggtgggtacgggttcgggtaaaggttcggggtaaccttacgttccttaccgtacgtaaggttacggggtacggggtaccgtaccccgtaaacccgtttaaaccgtaaccccggtttaaccccccgtaccgttaacccggtaaacggttacccgggacgggtaaccggaccgtaaccgtaactaacgtcgaaacgttaccgaaccgtacccgtaaaccgaaaccgttaaccgtaccgttttacccacccggtagaaccgtacgttacgttacggttacgtaccgtacccgggacccgaccgtacgacccggtaaccggacccggttccgttaaccgtttaccttacgtacggtaccgggtacggttaacggtaaccggttccccgaacccttaagtcccggttacgtacgttccgttccggtttaccccgttcgtaccggttattccggttttaaccgtttggtaaccgtttcggtcccggggtaccgggtaaaccgttaacgggaaccgtttacgtaacccggttacccgttaccctttcccggtacccg

SEQ ID NO: 188701 - DNA, 929 bp, Homo sapiens
  misc_feature: GYAE6OF02HOB45.37.2.A02.1.454.CMB.1.raw
  modified_base (200)..(200): a, c, t, g, unknown or other
  misc_feature (200)..(200): n is a, c, g, or t
tcagtagtgtagatcacgaccggtgctcgatttagactcatctacagggtctccgaagccttcggagaccctgtccctcacctgcactgtctctggttactaccatcagctagttaggttactacgtggggctggacgtccggcaccggcccccgaaggggacgggtcgtaggtaggtggtagttaggactatcctactntagttaggtacgggcacctaacctacgttaaccgtacccgttcctaacgaaacgtacgtaccggacggtaccgcctaactacgtacgtaacgtaacgtaacccgaaccgttaacccgaaacgtaaccgttacgttacccgttaccgaacgtaacggttacgttacggttaccggttacgtaccggtaccggacccggtaccgaacgaaaccggtacccggtaaccggttaccgtttaacgttaaccgttacggtacggtagggtaacgtaaccggtacgttacccggtaaccgtaacggtaccgtaacgtaccgtccggtttccgttacccgtacgttacgtacgtttacgtttacgtttaagtaccgttacggttaaccgggaacgggtaacgtaaacggtaacgttaacgttacccgggtaccctttacccggtttacctaccgtacccgtacccgtaaccccgaacccgtaacccggtacccggtaccgttacccgttacccgttccccgtaccccgttacccgtacccttacccgtaccgtaaccgtaccgtacccgtacgtaccggtaccgggtaccggtaaccgacccggtaccggaccggtaccggtcgttccgtaccggtaccgggttaacgtacggtaccgttaccggtttaacctaccgtacgtaaccgtaccggtaacgtcggtacggtaccggtaggtccggacggtacggaccgcg

SEQ ID NO: 188702 - DNA, 543 bp, Homo sapiens
  misc_feature: GYAE6OF01AP1I6.53.1.A01.1.454.CMB.1.raw
  modified_base (228)..(228): a, c, t, g, unknown or other
  misc_feature (228)..(228): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaactagcttggtaccagacaaaaaccaggacagcctcctgagctgctcatttactggctctacccgggaatcgtgggtccctgaccgattcattggaagcgggtctgggacagtatttcactctcacatcagcagcctgcaggctagaagatgtggctagtttattctgtcagtctaattcttctacgtttccgcttcgtacgtttcggacggacggtacccgagggtcggagtacgtacgaaaaccgtagtcggtcggccttagcctaaccgtattcctcgttccttcgtaccg

SEQ ID NO: 188703 - DNA, 524 bp, Homo sapiens
  misc_feature: GYAE6OF01BN38S.53.1.A01.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (403)..(403): a, c, t, g, unknown or other
  misc_feature (403)..(403): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanaccacctccaacaataagattaacttagcttggtaccagacaaaaaccaggacagcctcctgagctgctcatttacngggctctacccgggatcgtgggtccctgaccgattcagttggaagcgggtctgggacagtatttcactctcaccatcagcagcctgcaggctagaagntgtggctagtttattcgtgtcagctaattcttctagtttccgctctacgtttcggcggtacggacctagggtgagtactacgaaacgtatggtcgctagcctactattctcgttctcgtac

SEQ ID NO: 188704 - DNA, 572 bp, Homo sapiens
  misc_feature: GYAE6OF01EUYB8.53.1.A01.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagcaaaaaccaggacagcctcctgagctgctcatttacngggcgtctacccgggaatctggggtccctgaccgattcattggaagcgggtctgggacagatttcactctcaccatcagcagcctgcaggctgaagatgtggctagtttatttctgtcagtctaatacttctagttttcccgcttcacgttttcgggaccgggtacgggtacccctagggttcggacgtaacgttacgaaaaccggtaacgttggttcgggaccgttggaccctaacccgtaacgttccttcggttccttccgtaaccg

SEQ ID NO: 188705 - DNA, 536 bp, Homo sapiens
  misc_feature: GYAE6OF01EFTSD.53.1.A01.1.454.CMB.1.raw
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccacatcaactgcaagtccagccatattttanacacctccaacaataagattaactagcttggtaccagacaaaaccaggacagcctcctgagctgctcatttacnggctctacccggatcgtgggtccctgaccgattcagttggaagtcgggtctgggacagtatttcactcncacatcagcagcctgcaggctagaagatgtgctagtttattctgtcagtctaatcttctagtttcccgcttctacgtttcgggacggtacgggacccgtagggtcgtaacgacgttacgaaacgtaacgtggtcggcttgacccgtaccattacctgttcctgtacc

SEQ ID NO: 188706 - DNA, 109 bp, Homo sapiens
  misc_feature: GYAE6OF01A2CE0.53.1.A01.1.454.CMB.1.raw
tcagcgcgtatacacacgaccggtgctcgatttagacgtctcatcagggcacgaccggtgctcgatttagtgacatctcgcagttctgagcggctggcaaggcgcatag

SEQ ID NO: 188707 - DNA, 560 bp, Homo sapiens
  misc_feature: GYAE6OF01AMJIC.53.1.A01.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (400)..(400): a, c, t, g, unknown or other
  misc_feature (400)..(400): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagcaaaaaccaggacagcctcctgagctgctcatttacngggctctacccgggaatcgtgggtccctgaccgattcattggaagcgggtctgggacagtatttcactctcaccatcagcagcctgcaggctgaagntgtgctagtttattctgtcagcaacttcttctacgttttcccgcttcctaccgtttcggacgggtacgggtaccccgagggtcggaacgtacgtaccgaaaacggtaacttgggtcggccttaggaccctacccgtattccgtggttccttcgtaacccg

SEQ ID NO: 188708 - DNA, 528 bp, Homo sapiens
  misc_feature: GYAE6OF01DPOS4.53.1.A01.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactattttanacacctccaacaataagattaacttagcttggtaccagacaaaaaccaggacagcctctgagctgctcatttacnggctctacccgggatcgtgggtccctgaccgattcattggaagcgggtctgggacagtattcactctcaccatcagcagcctgacaggctagaagatgtggctagttttattctgtcagctaattcttcacgttttccgcttcgtacgtttcggacgggacggaccctagggtcggagacgtacgaaaacgtactggtcggctgacctaccatctgtcttcgac

SEQ ID NO: 188709 - DNA, 574 bp, Homo sapiens
  misc_feature: GYAE6OF01C4YMR.53.1.A01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctcatttacnggctctaccgggatcgtggggtccctgaccgtattcattggaagcgggtctgggacagtatttcactctcaccatcagcagcctgcaggctagaagntgtggctagttttattctgtacagtactaattactttctacgtttttcccgcttccacgttttccgggacgggtacgggaccccgtagggtcggacgtagtaccgaaaacggtacgttggtcggtccttacggaccctaacccgtattccgttacggttcctttaccgtaccg

SEQ ID NO: 188710 - DNA, 555 bp, Homo sapiens
  misc_feature: GYAE6OF01BHQXO.53.1.A01.1.454.CMB.1.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (541)..(541): a, c, t, g, unknown or other
  misc_feature (541)..(541): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgtttgacccagtctcccgactccctggctgtgtctctgggcgagagggccaccatcaactgcaagtccagccatatttanacacctccaacaataagattaacttagcttaggtaccagacaaaaaccngacagcctctgagctgctcatttacnggctctacccgggatcgtgggtccctgaccgtattcagttagggaacgcgggtctgggacaggtattcactctcacatcagcagcctgcaggctagaagatgtagctagtttactttcgtgtacgagactaaattaccgttctaacgttttcccgacttaccgtacgtttcgggacggtacgggaccctagggtcggacgtactacgaaacgtacgtggtcggctcgactaccacgttntcgttcttctaccg

SEQ ID NO: 188711 - DNA, 701 bp, Homo sapiens
  misc_feature: GYAE6OF01A7BUM.53.1.A01.1.454.CMB.1.raw
  modified_base (230)..(230): a, c, t, g, unknown or other
  misc_feature (230)..(230): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagagggccaccatcaactgcaagtccagccactattttanacacctccaaacaataagattaacttagcttggtaccagcaaaaaaccaggacagcctcctgagctgctcatttactgggctctacccgggaatcgtgggtccctgaccgattcagttggaagcgggtctggacacgtagttactactacctctaccgactactacgacgtacgtaccgtcgtcgacggtacggtacgaaaggtaacgtaggttcgggtacgttaacgttttaagttttaccgtttcgtacgtacgtacgtaaacgttaactttaccgttaccgtttttacccgttccgttccgttaacccgtttacggggttacccgggtaggggtaaccccccgggtaacggtaggggtaacggtaaccgttacggtaaaaacccggtaaccggttacggttcggggtaccgtacggtacccgttacccgtaacgttaccgtttaccggttcgtttcccgttaaccccg

SEQ ID NO: 188712 - DNA, 586 bp, Homo sapiens
  misc_feature: GYAE6OF01C5ANE.53.1.A01.1.454.CMB.1.raw
  modified_base (230)..(230): a, c, t, g, unknown or other
  misc_feature (230)..(230): n is a, c, g, or t
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
  modified_base (431)..(431): a, c, t, g, unknown or other
  misc_feature (431)..(431): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctcgtgggcgagagggccaccatcaactgcaagtccagccactattttanacacctccaaacaataagattaacttagcttaggtaccagacaaaaaccnggacagcctctgagctgctcatttacgngggctcgtacccgggatcgtcggggtccctgaccgtattcagttggaagcgggtctgggacagtatttcactctcaccatcagcagcctgcaggctagaagntggtggcttagttttattcgngtcagtactaattactttctacggttttcccgcttaccgtaccggtttcgggacggtacgggtaccctagggtacggacgtactaaccggtaaaacgtacgttggtcggaccttaggaccctaaccgtacgttccgttcgttccttcgtaacccg

SEQ ID NO: 188713 - DNA, 572 bp, Homo sapiens
  misc_feature: GYAE6OF01C4QGM.53.1.A01.1.454.CMB.1.raw
  modified_base (228)..(228): a, c, t, g, unknown or other
  misc_feature (228)..(228): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttaggtaccagacaaaaaccaggacagcctctgagctgctcatttacgtgggcgtctacccgggaatcgtggggtccctgaccgattcattggaagcgggtctgggacagtattcactctcacatcagcagcctgcagctgaagatgtgntagtttattcngtcagtcaattcttctacgttttcccgcttctacgtttcgggacggtacgggacccctagggtacggtagtacgttacgaaaaccggtaattcgggttacgggccttaggaccccgtaaccgttaacttccgtttcggttccctttcgtaacccg

SEQ ID NO: 188714 - DNA, 610 bp, Homo sapiens
  misc_feature: GYAE6OF01B9T5V.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgtttgacccagtctcccgactccctggctgtgtctctgggcgagagggccaccatcaactgcaagtccagccactattttatacacctccaaacaataagattaacttagcttggtaccagacaaaaaccaggacagcctcctgagctgctctatttacgtggcgtcgtaccgggaatcgtcggggtccctgaccgtatcagttggaagcgggtctagggacaggtactttcgactctacacctatcagcagccctgcgaggctagaagtatggtggtctagtttattctgtcagactaattacctttcgtaacgttttcccgccttacgtaccgttttcgggaccgggtaccgggtaaccccgtaggggtacggaacggtaacgttaaccgaaaccggtaaacgttcgggtcgggtaccttaggaccctaacccgtattccgttcgtttccttacttaacccg

SEQ ID NO: 188715 - DNA, 547 bp, Homo sapiens
  misc_feature: GYAE6OF01BU55C.53.1.A01.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccaccatcaactgcaagtccagccactattttanaccacctccaacaataagattaacttagcttggtaccagacaaaaaccaggacagcctcctgagctgctcatttacngggctcgtacccgggaatcgtcggggtccctgaccgtattcagttggaagcgggtctgggacagtatttcactctcacatcagcagcctgcaggctagaagntgtggctagttttacttctgtcagtctaattacttcgtacgttttcccgcttactacgtttcgggacggtacgggacccgtagggtggagataccgaaacgtacgtggtcggctagcctactactcgtcgttcttcgtac

SEQ ID NO: 188716 - DNA, 628 bp, Homo sapiens
  misc_feature: GYAE6OF01ESDIC.53.1.A01.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttanaccacctccaaacaataagattaacttagcttggtaccagacaaaaaccnggacagcctctgagctgctctatttacngggctctacccgggatcgtcgggtccctgaccgtattcagttaggaagtcgggtacgtagggactagtactttccacttcctaccaacctatccagacacgccctgcaggctaggaagtagtggtcggtacttaggttttattcgtgtacagtactaattactttcgtacgttttcccgcttaccgtaccggttttcgggaccgggtacgggtacccgtagggtacggaacgtaacgttaaccgaaaaccggtacgttagggtcggtaccctacggtacccgtaccctacgttacccgttacggttccttaccgttacccg

SEQ ID NO: 188717 - DNA, 673 bp, Homo sapiens
  misc_feature: GYAE6OF01CLLVN.53.1.A01.1.454.CMB.1.raw
  modified_base (304)..(304): a, c, t, g, unknown or other
  misc_feature (304)..(304): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttcgacccagtcctcccgactccctggctgtgtctcgtgggcgaggacgggccaccatcaactgcaagtccagccactatttacacacctacaacaaataagtattaacttagcttaggtaccaagaacaaaaaccaggacagacctcctganctgctactatttacgtcggcgtaccgtacccgggaatcggtcgggtccctgaccgtattcgtagttagggaacggtcgggttcgtagggactaacggtactttaccgacttacctaccgtaaccacttacgaacgtccgaacgcccgttaggaccgagggtactaaggaagtagttcgggtaggtactttaacggtttttacttcgtacgtacgtaacgtactaaactttacgtttcctaacggttttcccacgttacgttaccggttcgggaccgggtacgggtacccgtaggggtacgaagtaactaaccggtaaacggtcgtaggtcggtacgagccctaacacgttcttcggtacttccgtaccg

SEQ ID NO: 188718 - DNA, 581 bp, Homo sapiens
  misc_feature: GYAE6OF01EFKWK.53.1.A01.1.454.CMB.1.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccaccatcaactgcaagtccagccactattttanaccacctccaacaataagattaacttagcttggtaccagacaaaaaccaggacagcctcctgagctgctctatttacgngggcgtctacccgggaatcgtcgggtccctgaccgattcagttggaagcgggtctgggacagtatttcactctcaccatcagcagcctgcaggctagaagatggtggacttagttttattcgtgtacagtactaattacttctacgttttcccgcttcctacgtttccgggacgggtacgggacccgtagggtcggacgtaacgttaaccgaaaaccggtaacgttgggtcggccgtacgacccgtaaccctattcccgttgttcctcgtaccg

SEQ ID NO: 188719 - DNA, 541 bp, Homo sapiens
  misc_feature: GYAE6OF01A9PQU.53.1.A01.1.454.CMB.1.raw
  modified_base (228)..(228): a, c, t, g, unknown or other
  misc_feature (228)..(228): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttggtaccagacaaaaaccnggacagcctctgagctgctcatttacnggctctacccgggatcgtgggtccctgaccgattcagttggaacgcgggtctgggacaggtatttcactctacaccatcagcagcctgcaggctagaagatgtgctagtttattcgtgtcagctaattcttctacgttttcccgacttctacgtttccgggacggtacggacccgtagggtcggagtactaccgaaacgtatggtcggctcgactacctattactcgttccttctacc

SEQ ID NO: 188720 - DNA, 603 bp, Homo sapiens
  misc_feature: GYAE6OF01EXEHH.53.1.A01.1.454.CMB.1.raw
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgaccccagtctcccgactccctggctgtgtctctgggcgagagggccaccatcaactgcaagtccagccactattttanaccacctccaaacaataagattaacttagcttggtaccaagaccaaaaaccaggacagcctcctgagctgctctatttacgngggcgtcctacccgggaattcgtcggggtccctagaccgtattcagttggaagcgggtctgggactagtactttcactctcaccagtcacgcagcctgcaggctagaagtgtgtggtacttagttttactttcgtgtacagtactaattactttccgtacgttttcccgacttaccgttaccgtttacgggcgggacgggtacccgtagggttacggagtaacgtaaccgaaacggtacgttggtcgggctacggacctaaccgtacgttccttacgttccttacgtaccc

SEQ ID NO: 188721 - DNA, 605 bp, Homo sapiens
  misc_feature: GYAE6OF01A9Z1U.53.1.A01.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagacgggccaccatcaactgcaagtccagccactattttanacacctccaaacaataagattaacttagcttggtaccagacaaaaaccaggacagcctctgagctgctctatttacgngggccgtcgtacccgggaatcgtcggggtccctagacccgtattccagttacgggaagtcggggtctggggaacagtactttccactcctacaaccatcagcagcctgcaggctaggaagagtggtggactagtttattctgtcagctaattacttctacgttttcccgacttaccgtacgtttccgggacgggtacgggacccgtagggtcggacgtaagtaaccgaaaaccggtacgttgggtcggtaccttacggaccctaccgtaacttccgtcgtttccgttccgtaaccg

SEQ ID NO: 188722 - DNA, 556 bp, Homo sapiens
  misc_feature: GYAE6OF01D85VG.53.1.A01.1.454.CMB.1.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgttttgacccagtctcccgactccctggctgtgtctctgggcgagagggccaccatcaactgcaagtccagccactattttanaccacctccaacaataagattaacttagcttggtaccagacaaaaaccnggacagcctctgagctgctcatttacgnggctcgtacccgggatcgtcgggtccctgaccgtattcagttggaagtcgggtctgggacagtatttcactctcacatcagcagcctgcaggctagaagntgtggctagtttattcgngtcagtactaactcttacttacgttcncttacgtacgttcgggacggaccggtacgtagggtcgacgtagtaaccgaaacgtagtggtacggtccgtgaacccgtactagttccgttcgttcctgtacccg

SEQ ID NO: 188723 - DNA, 541 bp, Homo sapiens
  misc_feature: GYAE6OF01EB2Y0.53.1.A01.1.454.CMB.1.raw
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
  modified_base (537)..(537): a, c, t, g, unknown or other
  misc_feature (537)..(537): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccaccatcaactgcaagtccagccactattttanacacctccaaacaataagattaacttagcttaggtaccagacaaaaaccaggacagcctcctgagctgctctatttacgngggcgtacgtacccgggaatcgtcggggtccctgaccgtnttcattggaagcgggtntgggacagtattcactctacacatcagcacgcctgcaggctagaagntggtggcttagttttatttctgtcagtactaattcttctacgtttccgctactacgtttcgggcgggacggacccagggtgacgtagtacgaaacggtatggtcgctgcctactatctgttcctntacc

SEQ ID NO: 188724 - DNA, 615 bp, Homo sapiens
  misc_feature: GYAE6OF01CRTEQ.53.1.A01.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactattttanaccacctaccaacaataagattaacttagcttggtaccagacaaaaaccaggacagcctcctgagctgctctatttacgnggctcgtacccgggatcgtcgggtccctgaccgnttcagttggaagtcgggtntagggacagtattcactctacaccntcagcagcctgcgaggctaggaagtagttggtcggtacttagtttttactttccgtaggttaccaacgtactaaactttacctttaccgttaacgtttttccccggcttccgttaccgttttccgggaccgggtacgggacccgtaggggtcggaacgtacgtaccgaaaaccggtacgttgggtcgactacgacccgtaacctagttcctcggttccttcgtacccg

SEQ ID NO: 188725 - DNA, 728 bp, Homo sapiens
  misc_feature: GYAE6OF01CCNH9.53.1.A01.1.454.CMB.1.raw
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtcctcccgactccctggctgtgtctctgggcgagagggccaccatcaactgcaagtccagccactattttanacacctaccaacaataagattaacttagcttggtaccagacaaaaaccnggacagcctcctgagctgctcatttacgtggactccgtacccgggaatccggtcggggtccctaggaccgtattcgagtttacgggaaggtcggggtcgtaggggaacctaggtacttttccgaacttcctacctaaccctagttccgaacggtaccgaacggtcccgttggacccgagggtccgtaggaaacgtaggttgggtagggtacccttaagggtttttaatttccgttagttaccgaaggttacctaaacgtttaccgtttaccgttaacgtttttccccggtactttacccgttaaccggttttccgggaccggggtaccggggtaaccccgtaggggtacggaaacgtacgtaaccgtaaaaccggtaacggttacggtcgggtaccgttacggaccctacccgtaattcccgtttacgggttccctttaccgtacccg

SEQ ID NO: 188726 - DNA, 604 bp, Homo sapiens
  misc_feature: GYAE6OF01C47GJ.53.1.A01.1.454.CMB.1.raw
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
  modified_base (467)..(467): a, c, t, g, unknown or other
  misc_feature (467)..(467): n is a, c, g, or t
tcagcgcgtatacacacgaccggtgctcgatttagacgtctcatcaagggaagggaagggggtgggtccaggaggcagaactctgggtgtctcaccatggcctggatccctctacttctccccctcctcactctctgcacaggctctgacggcctcctatgagctgacacagtccaccctcggtgtctgtgtcctnaggacagacggccaggatcacctgctcgtggcatgcattgaccaaaanatatgtacttactggtaaccagcagacgccgaggccacggcccctgtcgttgtagtatttaanaacgtcttgagcgcctacgacggtaccctgacgtctattcncgtacggctccgagtctacgacggacacgtacgtctaacttcgacctancgtagtcggacgtcccggacgagaacggacggaggtactacgtaacttattacgtcgtactacgtccganacggacacgtcgaggtgacgtaagtttgtcggtacgttacggtcgggacggtacggtacgttaccgaccgttacggtacccgtaccgttagggaaccacggaccccgtaaggtcccctaccggtcccccgttacggg

SEQ ID NO: 188727 - DNA, 629 bp, Homo sapiens
  misc_feature: GYAE6OF01AV9GJ.53.1.A01.1.454.CMB.1.raw
  modified_base (230)..(230): a, c, t, g, unknown or other
  misc_feature (230)..(230): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgtttgacccagtctcccgactccctggctgtgtctcgtgggcgagagggccaccatcaactgcaagtccagccactattttanaccacctaccaacaataagattaactagcttaggtaccagacaaaaaccnggacagcctcctgacgctgctctatttacgngggcgtctacccgggatccgtggggtccctagaccgtattcgagttggaacggtcgggtcgtagggactagtattccactctacacctagtcacgcacgccctgcgaggactaggaaacgtagtcggtacggacttaggttttactttcgtgtacacgtactaagttacctttcgtacggttttcccgacttaccgtacggttttccgggacgggtaccgggacccgtaggggtacggaacgtacgtaccgtaaaacggtacgtacggtacggtccgtagacccgtaaccgtacgttaccttcgttccttcgtacccg

SEQ ID NO: 188728 - DNA, 602 bp, Homo sapiens
  misc_feature: GYAE6OF01B0HJM.53.1.A01.1.454.CMB.1.raw
  modified_base (232)..(232): a, c, t, g, unknown or other
  misc_feature (232)..(232): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctcgtgggcgagacgggccaccgatcaactgacaagtccagccactatttanaccacctaccaaacaataagattaactagtcttaggtaccagacaaaaaccgaggaacagcctctgagctgctactagtttacgtgggccgtacgtaccgggatcggtcgggtcctgacctattcagtcggaagtcgggtcgtgggactagtacttcactcacactatcagcacgcctgacgaggtctagaacgtgtggtacggtacttagttttacttcgtgtactagtactaattcgttacttacgtttcccgacttcgtaccggtttcgggaccggaccgggtaccgtaggggtacgtacgtaacgtaccgaaacggtacgtgggtcgactacggacctactacgttacgtcgttccttcgtacccg

SEQ ID NO: 188729 - DNA, 800 bp, Homo sapiens
  misc_feature: GYAE6OF01DQ7Q8.53.1.A01.1.454.CMB.1.raw
  modified_base (253)..(253): a, c, t, g, unknown or other
  misc_feature (253)..(253): n is a, c, g, or t
tcagcgcgtatacacacgaccggtgctcgatttagacgtctcatcaaggaagggaagggggtgggtccaggaggcagaactctgggtgtctcaccatggcctggatccctctacttctccccctctcactctctgcacaggctctgacggcctcctatgagctgacacagtccacccgtggtgtctgtcgtcctacgaggacaggacggccaggactccacctgctcgtggcgatgctattcgaaccaaaaanatatgacttacgtcggtaccagcgaggacggccgacggcccgacggtccccttggttcgtttggtagttaattttaaagtaaagttacgtttaggaacggtaccggtccctaccggacgggtacccctaggacggtcgtacttccgtcgtcggccttaccgacgtccgtacggaacgggaacctaaacgtacggttaccctaaccgttacgaaccctagtaccgtacgggttacgggtaccgggtaccccgggaccggaaacgggaacggggaacgggacgggtaccgtacggtaaaccgtttaacgtttaaccgttacggtaccgtaaccggttacccggacgtaacgggaaccgacgggtaaccgaggggttaccggacggtttaaggtttaccggttacgggttaccggttacgggttaccgggggtaccggggtaacggggtaccgttacccgggtacgttaccggtaccccggttaccggttacgggtacccgaccgggtaccccggaacgggtcccgttccccggtccccccggttaccgg

SEQ ID NO: 188730 - DNA, 769 bp, Homo sapiens
  misc_feature: GYAE6OF01CAMVB.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgccgtggcggggtacgttcgttttcgaccctagtcctcccgactccctggctgtgtctcgtgggcgaggacggccaccatcaactgacaacgtccagcctaatattttacaccacctaccaaactaataagtaacttaacttagcgttacggtaaccaagaaaccaaaaaccgacggaaccaccgacctaccgtagacgctcgtacctacgtacgttacggtcggtaccgtacccggtaacccgggtaacgttccgggtccggggtaccctacgggtacccgttacgttaccgtaaggttacgggaacgggtccggggttacggtacgggtaactacggttaacctttccaacttcctaccgaacctacgtacgacgacgtaccgtccgtggaccgagtcgtaagaacgtggtacgtgtactttaggttttactcgtataccgtaagtactaagttaccgtttaccgttaccggtttaccgtaccttacccggttacgggtttacccggggacggggtaacccgggtaccgggtagggtaccggtaaaggtaccgtaaacggtaaaccggttacggtacggtaccggtacgacgtaccgtaccgttacgttaccttaccggtttacctccgttacccg

SEQ ID NO: 188731 - DNA, 591 bp, Homo sapiens
  misc_feature: GYAE6OF01CHK5L.53.1.A01.1.454.CMB.1.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctcgtgggcgagaggccaccatcaactgcaagtccagccatattttanacacctacaacaataagattaacttagcttaggtaccaagacaaaaaccgaggacacgcctcgtgagctgctctatttacgnggctacgtaccggatcgtcgggtcctgaccgtattcgagtggaacggtcggtcgtagggactagtactttcgactctacacctatcgacgcacgtccctgaccgaggactaggaagtatcggtggtacttagttttattcgtgtacagtactaacttctttaccgtacgtttcccgacttcgtacgtttcgggacgggtacggtaccgtagggtgaactagtaaccgaaacgtagtcggtcggacctcgaccctaccgtattcgtacgttcttcgtacccg

SEQ ID NO: 188732 - DNA, 610 bp, Homo sapiens
  misc_feature: GYAE6OF01B38M9.53.1.A01.1.454.CMB.1.raw
  modified_base (231)..(231): a, c, t, g, unknown or other
  misc_feature (231)..(231): n is a, c, g, or t
  modified_base (412)..(412): a, c, t, g, unknown or other
  misc_feature (412)..(412): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgttttgacccagtctcccgactccctggctgtgtctcgtgggcgagagggccaccatcaactgcaagtccagccactattttanaccacctaccaaacaaataagaatttaaacttagctttaggtaaccaagaaccaaaaaaccaggaaccacgcctcctgagctgctctatttacgtgggccgtccgtaccgggaatccgtcggggtccctgaccgtattcagttggaaggtcgggtcgtgggacagtatttcactctacacntcagcagcctgcaggctagaagtagtggtggtacttagttttacttcgtgtacagtactaagttctttcgttacgttttcccgcttaccgtaccggtttcgggaccgggtacggtacccgtagggtaggacgtaacgtaaccgaaacggtacgtgggtcggccttacgacctacctattccgtcgttccttcgtaccg

SEQ ID NO: 188733 - DNA, 583 bp, Homo sapiens
  misc_feature: GYAE6OF01BONGE.53.1.A01.1.454.CMB.1.raw
  modified_base (195)..(195): a, c, t, g, unknown or other
  misc_feature (195)..(195): n is a, c, g, or t
  modified_base (318)..(318): a, c, t, g, unknown or other
  misc_feature (318)..(318): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctggcggggacgttcgttttgacccagtctcccgatccctggctgtgtctcgtgggcgagnggccacatcaactgcaagtccagccactatttacaccacctaccaacaataagtattaacttagcttaggtaaccagaccaaaaaccgaggacacgcctccgtgacgctagctctatttacgngggctccgtaccggatcgtgggtccctgaccgnttcagttggagtcgggtctagggacagtacttcactctcactntcagcacgcctgcgaggctagagtagtcggtgacttagtttacttcgtcgtcacgtactaattccgttcgtacgttttcccgcttccgttacgttccgggacgggaccggtaccggtaggttcgacgtacgtaacgaaacgtagtggtacggtctacgaccgactatccgttacgttctacgttacccg

SEQ ID NO: 188734 - DNA, 511 bp, Homo sapiens
  misc_feature: GYAE6OF01BDN3Y.53.1.A01.1.454.CMB.1.raw
  modified_base (227)..(227): a, c, t, g, unknown or other
  misc_feature (227)..(227): n is a, c, g, or t
tcagcgcgtatacacacgaccggtgctcgatttagacgtctcatcaggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanaccacctccaacaataagattaacttagcttggtaccagacaaaaaccaggacagcctcctgagctgctcatttactgggctctacccgggaatcgtgggtccctgaccgattcattggaagcgggtctgggacagatttcactctcaccatcagcagcctgcaggctgaagatgtgctagtttattctgtcagcaatcttcatttccgctcactttcggcggtaggacccaggtggagtagtacgaaacgtactggtcggctgcctaccatcgtcttctctac

SEQ ID NO: 188735 - DNA, 550 bp, Homo sapiens
  misc_feature: GYAE6OF01CUPSV.53.1.A01.1.454.CMB.1.raw
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (403)..(403): a, c, t, g, unknown or other
  misc_feature (403)..(403): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctcaacaatagattaactagcttggtaccagacaaaaacnggacagcctctgagctgctcatttacngggctctaaccgggatcgtgggtccctgaccgnttcatttggaagcgggtctgggacagtactttcactctacaccatccgagcagcctgcaggctgaagatgngtctagtttattctgtcatcaattcttcgagttttccgactcgtactttccgggcggtacgggacccctagggtacggacgtaagtaccgaaaacggtacttgggtacggtcctaggaccctaacgtacttcgttgttccttctacg

SEQ ID NO: 188736 - DNA, 629 bp, Homo sapiens
  misc_feature: GYAE6OF01DEJE2.53.1.A01.1.454.CMB.1.raw
tcagcgcgtatacacacgaccggtgctcgatttagacgtctcatcagggggagctacaacaggcaggcagggggcagcaagatggtgttgcagacccaggtcttcatttctctgttgctctggatctctggtgcctggccgggacgttcgttttgacccagtcctcccgactccctggctgtgtctcgtggggcgaggacgggcccaccatccaactgacaagtccagccaactattttacaccacctaccaaacaaataagtattaacttagcttaggtaaccagaaccaaaaaccgaggaacacgcctctgacgctgacctactatttacgtgggccgtaccgtacccgggaatcggtcggggtccctgaccgtattcagttggagtcgggtcgtagggacagtacttacactcctacacatcagcagcctgcagctagaagtgtggtcgtcttagtttacttctgtcagactaagttactttcgtacgttttcccgcttccgtaccggtttcgggaccgggtaccgggtacccgtagggttagggaacgtaacgtaaccgaaaacggtacgttgggtaccggacttacggaccctaccgatttcccgttcttccgttccgtacccg

SEQ ID NO: 188737 - DNA, 664 bp, Homo sapiens
  misc_feature: GYAE6OF01BB475.53.1.A01.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggactcgttttgacccagtctcccgactccctggctgtgtctcgtgggcgagacgggccaccatcaactgcaagtccagccactatttanaccacctccaaacaataagattaacttgcttaggtaccagacaaaaaccnggaacacgcctaccgtgacgctagccttactagtttaccgtcgggccgttaccgtaacccggggtaattccggttcgggggtaccccttacggaacccgttacgttaccgtagtttacgggaacgggttccggggtacgtaggggacctaggtaactttccgaacttcgtacaacctagtccagctaacgcctcggacgtacggactaggaaagtagttggtcggtacttagttttactttcctggttacagtactaacgttacttacgttacgtttccgctaccgttacgtttcgggacggtaccggaccgtaagggtcgacgtaagtaccgaaaggtactcgggtcgcgtacgacctactacgtctcgttactcgttaacccg

SEQ ID NO: 188738 - DNA, 589 bp, Homo sapiens
  misc_feature: GYAE6OF01EXROI.53.1.A01.1.454.CMB.1.raw
  modified_base (390)..(390): a, c, t, g, unknown or other
  misc_feature (390)..(390): n is a, c, g, or t
  modified_base (418)..(418): a, c, t, g, unknown or other
  misc_feature (418)..(418): n is a, c, g, or t
  modified_base (476)..(476): a, c, t, g, unknown or other
  misc_feature (476)..(476): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagagggccaccatcaactgcaagtccagccactattttatacacctccaacaataagtattaacttagcttagtaccagacaaaaaccaggacagcctcctgagctgctctatttacgtcgggccgtacgtacccgggaatcgtcggggtcccctgaccgtattcgagttggaagcgggtcgtgggacagtattcactcncaccatcagcagcctgcaggctagaagngtgtaggacttagttttactttcgtgtacagactaacttacttccttagttttcccgnttaccgttacgtttacggaccgggtaccgggtaccgagggtcggtaagaacgttaccgaaacgtacgttggacggtctacgacctaccgttactccgttcgttcgtcctaccg

SEQ ID NO: 188739 - DNA, 697 bp, Homo sapiens
  misc_feature: GYAE6OF01DXIB4.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacatttatacacctccaacaataagattaacttagcttggtaccagacaaaaaccaggacagcctctgagctgctctatttacgtgggtccgtaccgtacccgggaattccgtcggggtcccctggaacccgtattccgagttgggaacggtcggggtactggggaacaggttacttttccgacttccgttccaaccgtattaccgaacgccaacgtccccttggaccagggtccttaggaagtacgttggtcgggtcttaaggtttttacttttcgtagtaccaaggtactaaacgttacctttacgtacggtttttcccgactttaccctaccggttttccgggaccgggtacgggtaccccgtaaggggttacgggaacgtaacgttaccggaaaaaccggtaacgttgggttaccggtaccgtacggacccgtaaacccgtacgtttaccgtttggttccctttcggttaaccc

SEQ ID NO: 188740 - DNA, 596 bp, Homo sapiens
  misc_feature: GYAE6OF01CJA30.53.1.A01.1.454.CMB.1.raw
  modified_base (230)..(230): a, c, t, g, unknown or other
  misc_feature (230)..(230): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctcgtgggcgagagggccaccatcaactgcaagtccagccactattttanaccacctccaacaataagtattaacttagcttggtaaccagaacaaaaaccaggacacgcctcctgagctgctctatttacgtgggccgtccgtacccgggatccgtcggggtccctgaccgtatcagttggaagtcgggtcgtgggacagtacttcactctacacatcagcagcctgcaggctagaagatggtgtcttagtttattcgtgtctagtactaacttcttcgttacgtttccgcttaccgtaccggtttcgggaccgggtacggacccggtagggtacggacgtaacgtaaccgaaaccgtacggttcggtcggtcctacggaccctaaccgtacttccgttcgttccgttctacccg

SEQ ID NO: 188741 - DNA, 599 bp, Homo sapiens
  misc_feature: GYAE6OF01ETJKK.53.1.A01.1.454.CMB.1.raw
  modified_base (235)..(235): a, c, t, g, unknown or other
  misc_feature (235)..(235): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgttttgacccagtcctcccgactccctggctgtgtctcgtgggcgaggacgggcccaccatcaactgcaagtccagccactattttanaccacctccaaacaataaagattaacttagcttggtaccagaaccaaaaaccgaggacacgcctcctgagctgctctatttacgtgggccgtaccgtacccgggaattcgtcggggtccctgaccgtattcgagttcggaacggcgggtcgtgggactaggtactttccactcctaccaacctatcagacacgcctgacgaggtctaggaagagttggtcggtacttagttttattcgtgtacagtactaattacttcgttacgtttccgcttacgttacgtttcgggacgggacggacccgtagggtagacgagtacgaaacgtagtggtcgacgtgaccgtactattcctgttcgttctacg

SEQ ID NO: 188742 - DNA, 747 bp, Homo sapiens
  misc_feature: GYAE6OF01CR6YR.53.1.A01.1.454.CMB.1.raw
  modified_base (139)..(139): a, c, t, g, unknown or other
  misc_feature (139)..(139): n is a, c, g, or t
  modified_base (257)..(257): a, c, t, g, unknown or other
  misc_feature (257)..(257): n is a, c, g, or t
tcagcgcgtatacacacgaccggtgctcgatttagacgtctcatcaaggaagggaagggggtgggtccaggaggcagaactctgggtgtctcaccatggcctggatccctctacttctcccctcctcactctctgcacnggctctgaggcctcctatgagctgacacagtccacccgtcggtgtctgtcgtcctcgacggacaggacggccaggtactccacgtgcctcgtggcgatgactagttacgaaccaaaanatatcgtacgttacgtacggtaccagcgagacggaccgaggcccgtacggtcccctttgttaggttacgtaatttaagtaaagttacgtttaggaacggtacggtaccccgtacggaccgggtacccctggaacgtccgtactttccgtcgtcggccttaccgacgtaccgtaacggaacgggaaacctaaaccgtacgtaccgttaaccgttacgaaccctagttaccggaggttacgggaacggtcccggacgtaagggacggaccggtaagtaccgttaaggtaaccctttaagttaccgtacggtaccaaccggttcccgaagaacggtacgaacggtccgtaaggtacgggtacgttaaggtttcgttacggtagtttacgggtcgggaacgggtaggtacgaccggtccgtacggaccgttccggtaacgggtaccgaaccggtacccgacggtccccgttccccgtccccggtggttaccccg

SEQ ID NO: 188743 - DNA, 593 bp, Homo sapiens
  misc_feature: GYAE6OF01CNE51.53.1.A01.1.454.CMB.1.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
  modified_base (454)..(454): a, c, t, g, unknown or other
  misc_feature (454)..(454): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgttttgacccagtctcccgactccctggctgtgtctcgtgggcgagaggccaccatcaactgcaagtccagccactattttanacacctccaaacaataagattaacttagcttggtaccagacaaaaaccaggacagcctcctgagctgctcatttacgngggctcgtacccggatccgtggggtccctgaccgattcagttggaagcggtctgggacagtnttcgactctcaccatcagcagcctgcagctagaagngtgtggtctagttttattctgtcagactaattcttcgtacgttttccncttcgtaccgtttcgggaccgggtacgggtacccgtagggtacggtaacgtacgttaaccggaaacggtaacgttgggtacggtaccgtacggtaccctaacccgttagtttcccgttacggttccctttaccgtaccg

SEQ ID NO: 188744 - DNA, 744 bp, Homo sapiens
  misc_feature: GYAE6OF01C8XK1.53.1.A01.1.454.CMB.1.raw
tcagcgcgtatacacacgaccggtgctcgatttagacgtctcatcaaaggaaggaagggggtgggtccaggaggcagaactctgggtgtctcaccatggcctggatccctctacttctccccctcctcactctctgcacaggctctgaggcctcctatgagctgacacagtcacccgtcggtgtctgtcgtcctcaggacagacggcaggatcacctgctcgtggcgatgctattcgaccaaaatatatgtcttacgtacggtaccacgacgagacggccaacggccgacggtcccctgttcgttggttacgtaatttaagtaaacgtacgtttggaaggacggtcccctacggaacgggtaccccgtaggacgtcgtactttccgttcgtcggtacctccgaacgtcgtaccggaacgggaaccctaagtaccgttacctaccgtttacggacctaatacgaggtcgggtacggtcccggaccgtaaggacgggaacgtacgggcttacgtaacgttacgtttacgtacgtaccgtacggtacccgtacgacggaaccgaacggtcgtaacgggtacgacgttaaggtttacgttcggttacgttacgggttccggggacgggtaacggggtacccgttaacgggtccgttaccgggtaaaccccgttccgggttaaacggtccccgtaaaccggtaacccccggtaagggtccccggtccccgggtccccccgtttaccggg

SEQ ID NO: 188745 - DNA, 677 bp, Homo sapiens
  misc_feature: GYAE6OF01D2VJ2.53.1.A01.1.454.CMB.1.raw
  modified_base (340)..(340): a, c, t, g, unknown or other
  misc_feature (340)..(340): n is a, c, g, or t
  modified_base (550)..(550): a, c, t, g, unknown or other
  misc_feature (550)..(550): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgtttgacccagtctcccgactccctggctgtgtctcgtgggcgagacgggccaccatcaactgacaagtccagccactattttacaccacctaccaaacaaataagtaattaaacttagtcgttacggtaaccaagaaccaaaaaaccgaggaaccacgccctccgtagacgtctgtcctactagtttacgnggggtaccgtaccgtaacccgggtatccggtcggggtcccctagtaacccgtattacgtaagttacgggaacggtcggggtacgtaggggactaggtatttccgactcctacactatacacggctacgcctgacgaggtctaggaagtagtggtcggtacttaagttttacttcgtgtacagtactaattcgttacgtacggttttcccncgttacgtacgtttccgggacgggtacgggtcccgtaaggggtcggacgtaacgtaacccgaaaaggtacgttggtaccgggctaccgacccgtaaccgttattcccgttagttcccttccgtaacg

SEQ ID NO: 188746 - DNA, 595 bp, Homo sapiens
  misc_feature: GYAE6OF01BHMUF.53.1.A01.1.454.CMB.1.raw
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (419)..(419): a, c, t, g, unknown or other
  misc_feature (419)..(419): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttgacccagtctcccgactccctggctgtgtctcgtgggcgagacgggccaccatcaactgcaagtccagccactattttacacacctaccaacaataagattaacttagcttaggtaccagacaaaaaccnggacagcctcctganctgctctatttacgtgggccgtacgtacccgggaattccggtcggggttcccctaggaccgtattacgagtttggaacggtcgggtctaggggactagtacttttacacttcctacaacctntaccagcacgcctgcaggctagaagtgtggtaggcttaggttttattcgtgtcgagtactaattacgttctacgttttccgcttccgtacgtttccgggaggtaccggccgtaggtgacgtactacggaaacgtacgttggtcggctacggaccctagacttatcgttctctaccg

SEQ ID NO: 188747 - DNA, 721 bp, Homo sapiens
  misc_feature: GYAE6OF01CDMGI.53.1.A01.1.454.CMB.1.raw
  modified_base (245)..(245): a, c, t, g, unknown or other
  misc_feature (245)..(245): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtctcccgactccctggctgtgtctcgtgggcgaggacgggccacatcaactgcaagtccagccatattttacacacctaccaaanaataagtattaacttagacttacggtaaccaagaaccaaaaaccgaggaacacgcctccgtgacgctgctctatttacgtgggacctacgtaccgggatcggtcggggtccctaggacccgtattccgtagttgggaacggcgggttacgtaggggaacctaggtactttaccgaccttcctaccaaccgtataccgaacgcgtaacgtcccgtggaccgtagggtccgtaaggtaaacggtacgttaggttcgggtacgtttaaggtttttactttccggtagtactacggtaacttaaacgtttaccttttccgttacgggttttccctaccgttaccgttaccgggtttcggggaccgggtaacgggtacccgtaggggtaacgtaacggtaacgtaaccggaaaccgtaggttcggtacgggtcctacgggacctaaccgttagttaccgttcgttacccgttcttaccccg

SEQ ID NO: 188748 - DNA, 630 bp, Homo sapiens
  misc_feature: GYAE6OF01DKH93.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtctcccgactccctggctgtgtctcgtgggcgaggacgggccaccatcaactgacaacgtccagccaactattttactaccacctaccaaacaaataagtattaaacttagcttaggtaccaagaaccaaaaaaccgaggaacacgcctcctgagctgctctatttacgtggcgtcgtacccgggaatcgtcggggtccctggaccgtattcgagttggaacggtcgggtcgtgggacagtacttcactctcactatcagcagtcctgacgaggctagacgtagtggtcggtacttagttttacttcgtgtctacgtactaacttacgttacgttaacgtttccgtaccttacgtaccggtttcgggaccggggtacggtacccggtaagggtggaaacgtagtaaccctaaaacgggtagtcggtcgggtctacgacctaaccgtcttacgttcttccttcgttacccg

SEQ ID NO: 188749 - DNA, 1028 bp, Homo sapiens
  misc_feature: GYAE6OF01CB4U8.53.1.A01.1.454.CMB.1.raw
  modified_base (314)..(314): a, c, t, g, unknown or other
  misc_feature (314)..(314): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgccgtggccgggacgttcgttttcgacccagtcctcccgactccctggctgtgtctcgtgggcgaggacggcccaccataccaactgaccaacgtccagcctaatattttaacaccaccttaccaaacaaataacgtaatttaacgttacgcgtttacggaaccaaagaaccaaaaaaccgnggaaccacggaccctaccgtaggacgtcgtacgtaccttacttaacgtttaccggtcgggtacccgttacccggtaacccggggtaacttccgggttaccggggggttacccccttacgggtaaccccgttacgtttacgtaacgggtttacgggtaaaccggggtccgggggtttacggtacgggggaaacccttaaggtttacccgtttttaacccgaacccgtttacccgtacccgtaaacccgtaacttacccgaaccggacccgtaccgttaccccggtacgggtacccgtaacgggtaccgtttaagggaaacgttaacgggttacgggttaccgggttaaccgtttaaacgggtttttaccttaccggtttaccgggttacctaacgggtttaaccctttaaaccgttttaacccgttttaacccgggtttaaccggttttttacccccggtaacccgtttttaccccgggtttaacccggggttttacccggggggtaaaccccggggggttaaacccggggttaaacccccggttaagggggggttaaacccgggtaaaccgggttaaaaaccggttaaaccccggtaaaaacccgggttacggtttccggggttaacccggggaaccctttacccggtaaacccccgttacccgttaacggtttcggttaacccggtttccctttaccccggtttaacccccgg

SEQ ID NO: 188750 - DNA, 627 bp, Homo sapiens
  misc_feature: GYAE6OF01A1FGY.53.1.A01.1.454.CMB.1.raw
  modified_base (227)..(227): a, c, t, g, unknown or other
  misc_feature (227)..(227): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagaggccacatcaactgcaagtccagccactattttanacacctccaacaataagattaacttagcttggtaccagacaaaaaccagacagcctcctgagctgctctattactgggctactacccgggatcgtgggtcctgaccgtatcagttggaagcggtcgtagggacagatttcactctacaccatcagcagcctgcaggctagaagtatcgtaggactagttttattcgtgtacagtactaacttacttcgttaccgttttccgaccttaccgttaccggttttacggggaccgggtaacggggtaccccgtaagggttacgggtaacgtaaacgtaaccgtaaaaccgggtaaccgttgggtaccgggtaccgttaacggtacccgtaacccttacgttaccgtttacggttaccgtttaccggttaacccg

SEQ ID NO: 188751 - DNA, 686 bp, Homo sapiens
  misc_feature: GYAE6OF01CZGHS.53.1.A01.1.454.CMB.1.raw
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctgttgcctggcggggacgtcgttttgacccagtcctcccgactccctggctgtgtctcgtgggcgagagggccaccatcaactgacaagtccagccactattttacacacctaccaacaaataagtattaaacttagcttaggtaccagacaaaaaccnggacagcctctganctgctnatttacgnggctacgtaccgggaatcgtcgggtcctgacctattcagttggaacgtcgggtntacggggactagtactttcgacctcgtacacctatcgagtcaacgtccgtagctaggctaaggaagtgtacggaggtcttaacgtttttatttccgagtacctaagtacctaaactttaccgtttacgttaaccggtttttcccgacgttaccgttaccggttttaccggggacccgggtaccgggttaaccccgagggggttaccggaaacggttacgtaaacccggtaaaaccggtaacggtttcgggtcgggttaccctaggaccccgtaacccgtaagtttcccgtttacggttcccgtttaccgttaaccccg

SEQ ID NO: 188752 - DNA, 686 bp, Homo sapiens
  misc_feature: GYAE6OF01C82Y5.53.1.A01.1.454.CMB.1.raw
  modified_base (232)..(232): a, c, t, g, unknown or other
  misc_feature (232)..(232): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagacgggccaccatcaactgcaagtccagccactattttaanaccacctaccgaaacaataagattaaacttagcttacggtaccaagacaaaaaaaccgnggaacagcctacctagacgtctcgctacattttacgngggaccgtcctaaccggggaattcggtcggggtcctagaacccgtattcgaagttggaaggcgggttactcggggaactaaggttactttccacttctaccgaaccaatcacggtcaacgtccctgaacagggactaggaacgtagtaggtcgggtacttaggttttaactttcgtagtactaggaactaagttacgtttctacgttttacccgacttacgtacgttttccgggaaccgggtacgggtaccccgtaaggggttacgaacgtaattacccgaaaaaccggtaccgttcgggttaacggccttggaaccctacctaacgttccgttacgttcccgtttacgttaaccccg

SEQ ID NO: 188753 - DNA, 719 bp, Homo sapiens
  misc_feature: GYAE6OF01CNDO2.53.1.A01.1.454.CMB.1.raw
  modified_base (235)..(235): a, c, t, g, unknown or other
  misc_feature (235)..(235): n is a, c, g, or t
  modified_base (418)..(418): a, c, t, g, unknown or other
  misc_feature (418)..(418): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctggcggggtacgttcgttttcgacccagtcctcccgactccctggctgtgtctcgtgggcgagcggccacatcaactgacaagtccagccactattttanaccacctacaaacaataagtattaactagcgttaggtaccaagaacaaaaaccacggacacgcctcctgagtctgctactattacgtcggcgtacgacccggtaatcggtcgggtccctgaccgtattcagttggaacggtcgggtcgtaggacagtacgttacacgttcctacgtaacccgntaccgacgtcgacgtccgtggaccgtacggtcgtaggtaaaggtacgttcgggtaggttacgtttaaggtttttccttcgttacggttaccgacgttaacgtttaacgtttacctttaccggtttaccggtttttaccccgaccgtttaccgtttaccggtttaccggggaccggggttaacccggggtacccgtaaggggttacgggaaacgtaaccgttaaccggtaaaaccggtagttacgggtccggtacgtacggaccctaccgttaacgttcttaccgttcgttacccgtacccg

SEQ ID NO: 188754 - DNA, 588 bp, Homo sapiens
  misc_feature: GYAE6OF01BH2HT.53.1.A01.1.454.CMB.1.raw
  modified_base (226)..(226): a, c, t, g, unknown or other
  misc_feature (226)..(226): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccacatcaactgcaagtccagccacattttanacacctccaacaataagattaacttagcttggtaccagacaaaaaccaggacagcctcctgagctgctctatttacgtgggcgtcgtacccgggaatcgtgggtccctgaccgattcagttggaagcgggtctgggacagtatttcactctcaccatcagcacgcctgcaggctgaagntgtgctagtttnttctgtcagtctaattacttctacgttttcccgcttccgtaccgttttcgggcgggtacgggacccgtagggtacggtacgtaacgtaaccgaaaaccggtagttacgggttcgggaccttacggaccctaacccgtagttacccgttacgtttccctttcgttaaccccg

SEQ ID NO: 188755 - DNA, 599 bp, Homo sapiens
  misc_feature: GYAE6OF01D0KHY.53.1.A01.1.454.CMB.1.raw
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
  modified_base (477)..(477): a, c, t, g, unknown or other
  misc_feature (477)..(477): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagaggccaccatcaactgcaagtccagccatattttacaccacctaccaaacaataagtattaacttagcttggtaaccagaaccaaaaaccgnggacagcctctgacgctgctactatttacgngggcctaccgtacccgggaattccgtcgggtccctgaccgtattacgagttggaacgtcgggtctagggacagtactttcgactcctcactatcgagcagcctgcgngctagaagntggtgcttagtttactcgtntcagtctaattacttctacggtttccncgttcctacggtttcgggaccggtacggtacccgtaggtacggaacgtacgtaaccgaaaccgtaggttcgtcggtcctacgtaccgtaacccgtacgtttacctcgttccttcgttacccg

SEQ ID NO: 188756 - DNA, 560 bp, Homo sapiens
  misc_feature: GYAE6OF01E3MRF.53.1.A01.1.454.CMB.1.raw
  modified_base (229)..(229): a, c, t, g, unknown or other
  misc_feature (229)..(229): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactattttanacacctcaacaataagattaacttagcttggtaccagacaaaaaccaggacagcctcctgagctgctctatttacgtgggccgtaccgtacccgggaattccgtcggggtccctggaccgtattcagttggaacggtcgggtcgtgggacagtactttcactcctcaaccatcagcagcctgcacggctagaacgntggtgctagtttntttcngtcagctaatcttctacgtttccgcttctacgtttcgggcggacgggtacccgtagggtggacgataccggaaacgtattgggtcggcgtgacctacctattcgttctcttctaccg

SEQ ID NO: 188757 - DNA, 738 bp, Homo sapiens
  misc_feature: GYAE6OF01DAOHB.53.1.A01.1.454.CMB.1.raw
  modified_base (557)..(557): a, c, t, g, unknown or other
  misc_feature (557)..(557): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggtacgttcgttttcgacccgagtcctcccgtacctcccgtggctgtgtctcgtgggcgacggacgggccaccataccaactgacaagtcccacgcccaacttattttacaccacctaccaaacaataagtacttaacttagtcttacggtaaccaagaaccaaaaaccgaggaccactaccctccgtagactctcgtcctactagtttacggcgggtaccgtacccggtaaccgggtagttccggttaccggggtcccctcggaaccgttattacgtaacgttaggggaacggtccggggttacgcgggaactagttactttccgacttcctaaccacccgtataccgacgcctacggtcccgtaggaccgacggacgtaggaaacgtacgttgggtacgtactttaacggttttntttccgaggtacctaacgttaactaattttcccgttaacgtttacccggtttccaccgttcgttaccgggtttccgggacggggtaccgtaaccggtagggtacggacgtaaccgtaacgaaacggttcgttggtaccggcgtaccgacctaccgtattccgttactccgttacctcccgg

SEQ ID NO: 188758 - DNA, 705 bp, Homo sapiens
  misc_feature: GYAE6OF01BZPG1.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggactcgttttgacccagtcctcccgactccctggctgtgtctcgtgggcgagcgggccacatcaactgcaagtccagccactattttacaccacctaccaaacaataagtattaacttagcttaggtaaccaagacaaaaaccgaggacacgcctcctgacgtctgcttactatttacgtcggggtaccgtaccgtaacccgggtaattccggtcggggtccctaggaccgtattcgaagtttacgggaacgtccggggttactaggggtacacggttactttccgacttcccgtacaaccctacgtacgacgactaccggtccctcggacgagggtacgtaggaagtagtggtacggtacttacgttttattcgtggtactagtactaactttcttacgttaaccgtttccgtaccttcgttaccggtttccgggaccggggtaacggtacccggtaggggtacggtaacggtaacgttaaccggtaaaaccggttacgttacgggtcggtaccgtacgacccctaaccgtactttaccgtttccgttccgttccgttacccg

SEQ ID NO: 188759 - DNA, 624 bp, Homo sapiens
  misc_feature: GYAE6OF01EN209.53.1.A01.1.454.CMB.1.raw
  modified_base (236)..(236): a, c, t, g, unknown or other
  misc_feature (236)..(236): n is a, c, g, or t
  modified_base (322)..(322): a, c, t, g, unknown or other
  misc_feature (322)..(322): n is a, c, g, or t
tcagcgcgtatacacacgaccggtgctcgatttagacgtctcatcaggggggagctacaacaggcaggcagggggcagcaagatggtgttgcagacccaggtcttcatttctctgttgctctggatctctggtgcctgccgggacgtcgttttgacccagtcctcccgactccctggctgtgtctcgtgggcgaggacgggccaccatcaactgcaacgtccagccactattttanaccacctaccaaacaataaagattaacttagcttggtaccagacaaaaaccgaggacagccctcctagagtctgctctatttacgngggtcgtccgacccgggtatccgtcggggtccctcgaccgtattcagttagggacggtcgggtcgtagggacagtactttcactcctcaaccatacagctacgccgtgccgaggcttacggaaagtgtggtacgtacttagttttactttctagtcgtacgacttaattcctttcgttacgtttcccgtaccttcgttaccggttccgggacgggtaccgggtacccggagggttacggacgtactacgaaacggtacgtggtcggaccgtcgaccctacgttactactcgttctcgtaccc

SEQ ID NO: 188760 - DNA, 723 bp, Homo sapiens
  misc_feature: GYAE6OF01CRONS.53.1.A01.1.454.CMB.1.raw
  modified_base (127)..(127): a, c, t, g, unknown or other
  misc_feature (127)..(127): n is a, c, g, or t
  modified_base (670)..(670): a, c, t, g, unknown or other
  misc_feature (670)..(670): n is a, c, g, or t
  modified_base (698)..(698): a, c, t, g, unknown or other
  misc_feature (698)..(698): n is a, c, g, or t
tcagcgcgtatacacacgaccggtgctcgatttagacgtctcatcgagggggagctacaacaggcaggcaggggcagcaagatggtgttgcacgaccaggtcttctatttctctgttgctcgtaggntctcgtggtcgccgtggcgggtacgttcgtttcgaccgtacgtcctcccgtactccgtggcgtgtcgtcgtcggtcgggacgaggacggccaactacgtacaacgtgacaacgtccacgacctaacttactttacacctaacctaacaaactaaagtaacgtaactttaacgtcgtacgttacgtaaccaaacgaaaaccaaaacgacggaactccgtaccttaccgtagacgtcgtacgtccttacgttacgtttaccggcggtaccgtaaccggtaacggtacgttccgggttccgggtacctacggtaccgttagttcgtaacggttacggacggttcggtacggacggtactacgttcttacaccgtacacgactagtcgacgtcaacggtcagaccgtaggtactaggaagtgtacggttctacgtttagtttacttcgagtaactagtaacttacttcgtttcgttaccgttctaacgttcgttaccgggtcggaccgggtacgtcggtaagtacggaacgttaacaacgtcggtancgggtataccgcgttaactccggtttanccggtttcttccgtaccgtttaccg

SEQ ID NO: 188761 - DNA, 703 bp, Homo sapiens
  misc_feature: GYAE6OF01CY164.53.1.A01.1.454.CMB.1.raw
  modified_base (119)..(119): a, c, t, g, unknown or other
  misc_feature (119)..(119): n is a, c, g, or t
  modified_base (474)..(474): a, c, t, g, unknown or other
  misc_feature (474)..(474): n is a, c, g, or t
tcagcgcgtatacacacgaccggtgctcgatttagacgtctcatcagggggagctacaacaggcaggcaggggcagcaagatggtgttgcagacccaggtcttcatttctctgttgctntggatctctggtcgcctggcggggacgttcgttttcgacccgagtcctcccgactccctggctgtgtctcgtgggacgaggacgggaccaccatacaactggaccaaacgtccacgccaactattttacaccacctaccaaacaaaataagtaacttaaacttagctttaaggtaaccaagaacaaaaaaccgaggaacacgcccttaccgagagcttcgcttactagtttacgcggtaccgtaccgtaaccgggtaatcggtccggggtaccctacggtaccgtattacgaagtttacgggaacggtcggggttacgtcggggaactaagttactttacacttctaccaactanacacgcaacgcctacgacgtacggactacggaagtagttaggtcgttacttaggttttaactttcgtagtacacgtaactaacgttactttacgttacgtttacccgtacttaccgtcgttacgggacggacgggtaaccgaagggttcggaaacgtacgaaacgtaaaacgtacggttaggtacgggtcctacggaacctactacttcgttaccgtcttacgtacccg

SEQ ID NO: 188762 - DNA, 689 bp, Homo sapiens
  misc_feature: GYAE6OF01CZ70W.53.1.A01.1.454.CMB.1.raw
  modified_base (521)..(521): a, c, t, g, unknown or other
  misc_feature (521)..(521): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctgggtgcctggcgggggtacgttcgttttgacccagtcctcccgactccctggctgtgtctcgtggggcgaggcgggccaccatcaactgacaagtccagacccactattttacacctaccctaccaaacaaataagtacttaaacttagtcgttaggtaccaagaaccaaaaaccgaggacacgccctctgacgctgcctactactttacgtcgggaccgtaccgtacccgggtaatccggtcggggtcccctggaccgtattcgagttggaacggtccgggtacgtgggactagtactttaccacttcctaccacctatcgacgtccaacgtcccgtggaccgagggtactaggaacggtagttcggtacggtactttagttttactttcgngttactacgtaccttaactttaccgtttaccgttaccggttttccgacttaccggttacgggtttaccggggaccgggtacgggaacccgtaggggtacggaacgtaactaaccggtaacggtacgtggtacggcctcgactacctattccgtcgttccttcgtaccg

SEQ ID NO: 188763 - DNA, 562 bp, Homo sapiens
  misc_feature: GYAE6OF01CAAQS.53.1.A01.1.454.CMB.1.raw
  modified_base (230)..(230): a, c, t, g, unknown or other
  misc_feature (230)..(230): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagagggccaccatcaactgcaagtccagccactattttanaccacctccaaacaataagattaacttagcttaggtaccagacaaaaaccaggacagcctcctgagctgctctatttacgtgggccgtcgtacccgggaatcgtcggggtccctgaccgtattcagttggaagtcgggtctggacagtactttcactctcacatcagcacgtcctgcgaggctagaagtagtggtagctagttttattctgtcagactaattcttctacgtttcccgcttcgtacgtttcgggacggacggtaccgagggtcgaatacgtaacgaaacgtagtggtcgccgtgacccgtactagttcctcgttcttcgtacc

SEQ ID NO: 188764 - DNA, 801 bp, Homo sapiens
  misc_feature: GYAE6OF01CKA6O.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgccgtggccgggtacgttcggttttcgaccctagtcctcccgacttcccgtggctgtcgtcctcgtggggacgaggacgggccaacctatcaactgacaacgtccagcctaactattttacaccacctacaaacaataagtattaacgttgcttacggaaccaagaaccaaaaaccgaggacacgcctactgacgtctgctactacgtttacgtcgggtaccgttaccggtaacccgggtagtccggttaccggggtcccctacggtaaccgttagttacgtaaggttcgggaaacgggtcgggttacggtacggggtaacctacgttacgtttaccgaccgttacctaccgaacctacgttaccgaacgcccgtacgtcccgtaggaccgtacggtacgtaggtaaagtacgttacgggtacggtacgtttacggttttactttccgtacgtacgtaacgttacgttaaactttccgtttacgtttaccggtttttcccgaccgttttaccggttaccggtttaccggggaacgggtacccgggtaaccggtacggggttacggaaacgttaaccgtaaacccgggtaaacgttcggttacgggtaccggtaaccgtcggtaaccctaaccggttacgtttcgttaccgtttacgttcccgttaacccg

SEQ ID NO: 188765 - DNA, 642 bp, Homo sapiens
  misc_feature: GYAE6OF01CKV1V.53.1.A01.1.454.CMB.1.raw
  modified_base (133)..(133): a, c, t, g, unknown or other
  misc_feature (133)..(133): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
tcagcgcgtatacacacgaccggtgctcgatttagacgtctcatcgagggggagctacaacaggcaggcaggggcagcaagatggtgttgcagacccaggtcttcatttctctgttgctctggatctctggtncctgcggggactcgttttgacccagtctcccgactccctggctgtgtctcgtgggcgagagggccaccatcaactgcaagtccagccactattttanacacctccaanaataagtattaacttagcttggtaccagacaaaaaccgaggacagccctacctgacgctgctactatttacgngggcctcgtaacccgggatccgtggggtcccctgaccgtattcgagttggaacgtcgggtacgtggggactaggtactttccgaactccgtacaccattcgagccacgcctggacaggctagaagtgtaggtcggtacttagttttattacgtgtactagaccttaattacgtttcttacgttttcccgaccgtttccgtacggtttcgggaccgggtacgggtacccgtaggggtcggaacgttacgtaaccgtaaaacggtacgttacgggtcgtaccgtaggaccctaaccgttacttacccggttcgttccttcccgttacccg

SEQ ID NO: 188766 - DNA, 706 bp, Homo sapiens
  misc_feature: GYAE6OF01C8LQF.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgttttgacccagtcctcccgactccctggctgtgtctcgtgggcgaggagggccaccatcaactgacaagtccagccactattttacacacctaccaacaataagattaactagcttgacagacaaaacaggacagcctcctgagctgctactatttactgggtccgtaccgtacccgggaatccgtcggggtcccctacgaccgtattcgtagttacggaacggtcggggtcgtaggggactaggtactttccaactcctaccaaccgtatccaaggccacgtcctacgacgtacgggactaggaaagacgttgggtacggtaccgttaaggttttatttccgtatacgtagtacttaactaccgtttccgtaacggtttttcccgaccttaccgttaaccggtttaccggggaccggggtaacccggggtaaccccggtaaggggttacggaaacgttaacgtaaaccggtaaaaccggtaccgttgggtaccggggtacctagggtacccctaaccgttacggttaccgtttccgtttaccgttacccgttacccg

SEQ ID NO: 188767 - DNA, 731 bp, Homo sapiens
  misc_feature: GYAE6OF01DS9VE.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggccgggacgttcgttttcgacccagtcctcccgactccctggctgtgtctcgtgggcgaggaggcccacatcaactgacaacgtccacgccattattttacacctaccctacaaacaaataagtacttaaacttagactttacggtaccaagaacctaaaaaaccgaggaaccacgtcccctaccgtagacgctgtcctctacttttacggcgggtccgtaccgtaacccgggtaacttccggtcgggggtcccctacggaccgtacttacgtaggttacgggaacggtccggggtacggtaggggtaacctaaggttactttccacctccgtaccacctaacgtccgacgcgtacgtcccgtaggaccgaggtactaaggtaaacgtgttagggtcggttacgtttaagtttttacgttccgtaggtacctagtaaccttaatttacccgtttcgtttaacgtttcccgtaccgtttacccgttacggtttccggggaacgggtaccgggtaccggtagggtaacggacgtactaaaccggaaggttaccgtggtcgtcgtacaccgtaccttagtccgtcgttcctctacccg

SEQ ID NO: 188768 - DNA, 762 bp, Homo sapiens
  misc_feature: GYAE6OF01E4OZW.53.1.A01.1.454.CMB.1.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtcctcccgactccctggctgtgtctcgtgggcgaggacgggccaccatcaactgacaagtccagccactattttanaccacctaccaaacaataagtattaaacttagcttacggtaaccacgaaccaaaaaccgaggacacgcctctaganctgctactatttacgnggtccgtaccgtaacccgggaatccgtcgggtcccctagaccgtattcgtagttacgggaacggtccggggttcgtacggggactaaggttactttaccaccgttcctacccgtaaccactaccgacggaccgtacgtcccgtaggtaccgacggtacgtaaggtaaacggtgttacgggtacggttaccgttaagtttttacgtttccgtacggttacctaacgtaccttaacctttaacgtttccgtttaaccggttttcccctaccgttaccgttacccggtttaccggggaccgggtaaccggggtacccggtagggtaccggtaaacgtaaccgtaaaccggtaaaaccggttacggttacgggtccggtaccgtacccgaaccgtacccttacgttacccgttccgtttaccgttacccgttaccccg

SEQ ID NO: 188769 - DNA, 561 bp, Homo sapiens
  misc_feature: GYAE6OF01B4BRF.53.1.A01.1.454.CMB.1.raw
  modified_base (228)..(228): a, c, t, g, unknown or other
  misc_feature (228)..(228): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
  modified_base (424)..(424): a, c, t, g, unknown or other
  misc_feature (424)..(424): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagacaaaaaccnggacagcctcctgagctgctcatttacgnggcgtctaccgggaatcgtgggtccctgaccgattcagtggaagcgggtctgggacagtatttccacttcctcaccatcagcacgcctgcaggctagaagtntgtgctagttttattcngtcagctaacttattcgtacgttttccgcttccgtacgtttcgggacggacgggtacccgtagggttcggaacgtataccgtaaacgtacgtggtcggctacggacctaaccgtattccgttcgttccttcgtaccg

SEQ ID NO: 188770 - DNA, 765 bp, Homo sapiens
  misc_feature: GYAE6OF01CFBH2.53.1.A01.1.454.CMB.1.raw
  modified_base (215)..(215): a, c, t, g, unknown or other
  misc_feature (215)..(215): n is a, c, g, or t
tcagcgcgtatacacacgaccggtgctcgatttagacgtctcatcagggggagctacaacaggcaggcaggggcagcaagatggtgttgcagacccgaggtcttcatttctctgttgctctggatctctggtgcctggcggggacgttcgttttgacccagtcctcccgactcccgtggctgtgtctcgtgggcgaggacggccaccatcaactncaacgtccagcccatatttacaccacctaccaacaataagtattaacttagtcttagtaaccaacgaaccaaaaaccgaggaaccacgtcctactgagctgactctagttacgcggaccgtaccgtaaccggatccggtcgggtccctagaccgtattcgaggttggaacggtcggggttacgtacgggactacggtacttccgactcctaccacctactcgaacgccgtaacgtcccgtaggtaccgaaggtacgtaaggtaaacgtggttacggtacggttaccgtttaagtttttactttcccggttaggtacctaacggttaacctttaaaccgtttaccgttttaccgtttaccggttttccccgaccgtttaaccggtttaccggtttacccggggaaccggggtaccgggtaaacccggttaggggtacgggtaaaccgtaacgggttaacccgtaaaaccggttcgggttacgggtccggtaccgttacccggaacccttaacgtacccgtttccgttaccgtttacccgttactaccccgg

SEQ ID NO: 188771 - DNA, 711 bp, Homo sapiens
  misc_feature: GYAE6OF01CC3PZ.53.1.A01.1.454.CMB.1.raw
  modified_base (340)..(340): a, c, t, g, unknown or other
  misc_feature (340)..(340): n is a, c, g, or t
  modified_base (406)..(406): a, c, t, g, unknown or other
  misc_feature (406)..(406): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttcgacccagtctcccgactccctggctgtgtctcgtgggcgaggacggccacatcaactgcaagtccagccactattttaacaccacctccaaactaaataagtaattaacttagtcgttacggtaaccaaggaaaccaaaaaaccgaggaacacgtccctccgtagagtctacgctactagtttacgngggtccgtaccgtaccgggaatcgtcgggtcctacgaccgtactgtacgttaggaggtcgggtcgnggacagtacgtttccactacgtacaccactcgacgtacgacgtccgtgaccgaggtactaggtaaactggtcggttaggtacctttaagtttttcgttccgtagtaccgtaaggtaccttaaaccgtttacctttaccgttacggtttttccccgaccgtttacccggttacgggttacccggggaccgggtaaccgggtacccggttaggggtagtaaccggaactaaccggtaaaccgtacggtaggtcccggtacgtacgaacccgttacgtaactttccgttcttccgttaccgtaccccg

SEQ ID NO: 188772 - DNA, 751 bp, Homo sapiens
  misc_feature: GYAE6OF01C9KQ9.53.1.A01.1.454.CMB.1.raw
  modified_base (370)..(370): a, c, t, g, unknown or other
  misc_feature (370)..(370): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggccgggtacgttcgttttcgacccagtcctcccgactcccgtggcctgtcgtctcgtggggcgaggcgggcccaaccatcaaacgtcggacaaacggtccagaccaactattttaacaccaccctaccaaacaagtaaagtaatttaacttagacgttacggtaaccaagaaccaaaaaaccgacggaaccaacggccctaccgtagtaagcgtcgacctctacgttttaccgngggtccgtaccggtaacccgggaattccggtacggggtcccctaggtaacccggtattccgtagttacggaaacggtcggggttcgtacggggtaacctaggtatttaccctacttcccgaccctaacctactacgaacgtccgaacggtcccgtcggaaccgtacgggacctaagggtaacgtagttcggttaggaccgtttaagttttcttacgtcgttaccgaagtacctaattaccgtttacgttaccgtttccgtaccgttactaccggtttcggaccggtacgggaccgtagggtcgtaacgtagttaaccgaaacggtacggttggtccgtacgtacgaccgtaacttcgtaccttcggttctacgttaccccg

SEQ ID NO: 188773 - DNA, 612 bp, Homo sapiens
  misc_feature: GYAE6OF01ENZ44.53.1.A01.1.454.CMB.1.raw
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagacgggccaccatcaactgcaacgtccagccactaattttacaccacctaccaaacaataagacttaaacttagtcttcggtaaccagaccaaaaaaccgaggacagcctcctgagctgctctatttacgngggtccgtacctacccgggaattcgtcgggtcctacgaccgtnttccagttggaacggcgggtcagggactagtactttcactcaccacntcagcacgcctgcgagctagaagngtggtgacttaggtttcttctgtactagtacctaagttacctttcgtttaccggttttcccacgttacccgtttacggtttccgggacgggtaccgggtacccgagggttacggaatactaaccgaaacgtagtggtcgcgtagaccctacttacgtaccgttcgtcttctacccg

SEQ ID NO: 188774 - DNA, 682 bp, Homo sapiens
  misc_feature: GYAE6OF01DQVOD.53.1.A01.1.454.CMB.1.raw
  modified_base (141)..(141): a, c, t, g, unknown or other
  misc_feature (141)..(141): n is a, c, g, or t
  modified_base (259)..(259): a, c, t, g, unknown or other
  misc_feature (259)..(259): n is a, c, g, or t
tcagcgcgtatacacacgaccggtgctcgatttagacgtctcatcaagggaaggaagggggtgggtccagggaggcagaactctgggtgtctcaccatggcctggatccctctacttcctccccctctcactctctgcacnggctctgacggcctcctatggagctgaacactagtccacccgtggtgtctgtcgtcctgaggacaggaccgcaggactcacgtgctcgtggcagtcgctagtcgaaccaaaaatagtntcgtaccttacgtcggtaacagacgaggacgaccgcggaccgacggtccccttagttcgttggtagtaatttaacgtaaagttcgttaggacggtaccggtcctacgaaccgggtaccctaggacgtcgtacttcgtacgtcggtacctcgagtcgacgacggaacaacgtcgtaccacgttcgactacgtcgtacgtcgggacgtaccgacgtacgggacggacgtagtcgtaagtacttacgtacgtcgtacgcgtacgactagactacggacgtacggtacgcgttaacgttacgtacggtacggttacggtccgggaacggtacgggtaacccgtcggtaccgtacgggtaccccgttcggtaaccggtcccgaccggttaacccggaaccggttcccctacccggtcccccggttacg

SEQ ID NO: 188775 - DNA, 988 bp, Homo sapiens
  misc_feature: GYAE6OF01BTVIH.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggtacgtcgttttgacccagtcctcccgactccctggctgtgtctcgtgggcgagacggccaccatcaactgcaacgtccagaccctactaattttacacctaccctaccgaaacaaagtaaagtaactttaaacgttagtacgtttacgggtaacccaacggaacctaaaaaaaacccgcgggaaacctaacggtcccccttaccgttacgggaacggtcccttaggtacccgtttaactttaaaccgtttttaccgggtacgggggttaccccgttaacccgggtttaaaccccggggtaactttacccggggtttcccggggggtttaccccctacgggtaaaccccggttacgtttttaaccgtaacgggttttaacggggaaaccggggtcccggggggtttacggttaacgggggaaacccgttaacggttttaacgttttaaccccgtacccgtttaacccgttaccccgtaaaccccgttaagttacccgaaacgggtaccgtaacccggtaccccggttacgggaccgtaacgggtaacggttaacgggtaaaaggttcggttacgggttaccgggttacttttaacgggttttttaacttttccggttacggttaccgtaaacgttacgttaaaccgtttttccgtttaacctttaaccgggttttttcccgtaccgtttacccggttaaccggttttacccggggaaccggggtaacccgggtaacccgtaggggtacggtaaacccgtacgttaaaccggtaaaaccgttaggttaccgggtacggtaccgttaccgacccgtacctacgttcggttacgttcctttcgtaccccg

SEQ ID NO: 188776 - DNA, 760 bp, Homo sapiens
  misc_feature: GYAE6OF01AP4H8.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacttcgtttgacccagtctcccgactccctggctgtgtctcgtgggcgaggacgggccaccatcaactgacaacgtccagcctatattttacaccacctaccaaacaataagtactttaactagtcttacggaaccaagaaccaaaaaccgaggaaccacgtaccctccgtagacgtctacgccttacgtaagtttaccggtcggggtacccgtacccggtaacccgggtaattccgggttaccggggtcccctacggtacccgttattaccgtaggttagggaacggtcgggtacgtagggactagtactttccaactcctacgacctagtaccacggtcctaacggtcctacggacgtacggtacgtaacgaagtcggtcggtacggtacctttaaggttttattcccgtagtaaccgtaggtaacccttaacgtttacccgttacctttaccgggttttcccacgtttaccggttaccgggtttaacgggcccgggttaaacggccggttagggtacgttaacgaacggttaacccgaaacggttacggttcgggtacggtaccgttaccggtaacctaccgttacgttaccgtcctttcccgttaccttaccccg

SEQ ID NO: 188777 - DNA, 683 bp, Homo sapiens
  misc_feature: GYAE6OF01BIA6M.53.1.A01.1.454.CMB.1.raw
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtcctcccgactccctggctgtgtctcgtgggcgaggcggccacatcaactgacaagtccagccactattttacaccacctaccaacaataagtattaacttagtcttaggtaccaagaacaaaaaccgnggacacgtccctactgacgctgcctactatttaccgngggtcctaccgtaccggatcgtcggggtcctgaccgtattcgagttaggaacgtcgggtacgttcgggactaggttactttccgaactccgtaccacgtatacgacgcacgtccgtacgacgaaggtcgtaagaacgtagttcgtacggtacgtttaagtttctttcgtagtcctagtaacctaagtttccttaccgtaacggttttccgtacttacgttaccgtttacggggacgggttaccgggtaacccgtagggtacggtaaccgaacttaaaccgggtaaaacgtaccggttggtacggtacctacgggtaaccttaaccgtagttccctttacggtcctttcgtaaccccg

SEQ ID NO: 188778 - DNA, 642 bp, Homo sapiens
  misc_feature: GYAE6OF01D24VO.53.1.A01.1.454.CMB.1.raw
  modified_base (394)..(394): a, c, t, g, unknown or other
  misc_feature (394)..(394): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacttcgttttgacccagtcctcccgactccctggctgtgtctcgtgggcgagaggccaccatcaactgcaagtccagccatattttacaccacctaccaacaataagtattaacttagtcttaggtaaccaagaccaaaaaaccgaggaacacgccctcctagacgtctgctctaatttaccgtggggcctaccgtaaccgggtatccggtcgggtccctggaccgtattcaagttcggaacggtcgggtgngggactagtactttccactctacactatcgacgcacgtcctaggtacgcgtagaagtgtggtcggtacttagttttattccgtgtactagtactaacttacctttcgttaacgtttcccgtacttaccgttaccggtttacgggaccgggtacggtacccgtagggtacggtaacgtacgtaaccgaaacgtacggttggtacggtcctacggacctacgtacttacgtcttaccttctacttccccg

SEQ ID NO: 188779 - DNA, 946 bp, Homo sapiens
  misc_feature: GYAE6OF01DOUUT.53.1.A01.1.454.CMB.1.raw
tcagcgcgtatacacacgaccggtgctcgatttagacgtctcatcgagggggagctacaacaggcaggcaggggcagcaagagtggtgttgcacgacccgaggtcttctatttctctgttgctcgtggatctcgtggtcgccgtggccggggtacgtttcggttttcgacccgtacgtccctccccgtaccgttcccgtggtccttggttcgttccgtcggtcggggacggaacgggaccgggaccccacctagttaccaacgtcgacctaacgtcccgacgtacccttaacttacttttaaccaccctaacccttaaccaaaactaaacttaaagttaactttaaccgttaggtaccgttacggtaaaccaaacgaaaaccaaaaaccggacggaacctccgtacccgttccgaggtacgtcctgtaccttaacgttacgttaccggtccggtccggttaacccggtaacccgggtacgtcccgggttacccgggtacccttacggtaacccgttacgttaacgtaacgggtttaacggggaaccgggttcgggttaccggacgggtaacctaacggtttaacctttccaaccgttacctaacccgaacgttccgtacgaccggctaccgggtccctagggtaccggaagttacgtaagtaggttacggtcgtttaaggtttctttttaacggtttctaccgggtatttaacgaacgttttaacgtttacccgtttaacggtttcccgtttaacccggttcccttacgggttttaacccgggttacccgggtacggggaccgggttaaccggacggttaacggggtaacgaaaacgttaccccggtaaaagggtttaaacccggtgggttaccgggtcccagtttaaccccggaccttaccggtttactttcccggtttactttcccccgtaacccggtttcccc

SEQ ID NO: 188780 - DNA, 728 bp, Homo sapiens
  misc_feature: GYAE6OF01BLZBV.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtcgcctggccgggacgttcgttttgacccagtctcccgactccctggctgtgtctcgtgggcgagacggccacatcaactgacagtccagcctactatttacaccacctaccaaactaataacgtattaacgttagtcttacggtaaccaagaaccaaaaaccgaggaacacgcctcctagacgctgctctacgtttacgcggtccgtacggtaccggtaattccggttacggggtccctacggtaaccgtagttacgaggttacgggacggtcgggttacgtacgggacgtaacgttactttaccgtactcctaccacctacgtccgtacgacctacggcctaggaccgtagacgttagaaagtgttcgggtacgttacgtttagttttactttccgtagtaccgtaacgtacttaacgtttaccgtttcggtttaccgttttcccggactttaccgttaaccgggtttcgggaccggtacggggtacccggtagggtaaggtaacgtaacgttaaaccggaaacggttacggtacgggttcggacccgttaccgacccgttaacgtcgtttaccctttcgttccttcgttaacccg

SEQ ID NO: 188781 - DNA, 775 bp, Homo sapiens
  misc_feature: GYAE6OF01B7CBS.53.1.A01.1.454.CMB.1.raw
  modified_base (180)..(180): a, c, t, g, unknown or other
  misc_feature (180)..(180): n is a, c, g, or t
tcagcgcgtatacacacgaccggtgctcgatttagacgtctcatcaagggaaggaagggggtgggtccaggaggcagaactctgggtgtctcaccatggcctggatccctctacttctcccctctcactctctgcaccggctctgaggcctctatgagctgacacagtcacccgtcggtntctgtgtcctcaggacagacggccaggactcacctgctcgtggcatgcattcgaccaaaaacagtatcgtacttacgtaggtacccagacgaaggacggaccacgggacccacgggtccccttggtccgtttagggttagtaattttaaagtaaaaggttacctttaggaacggtacggtacccctacgaacgggtaccccgtaggacgtcggtaactttccgtacgttcggggtacccttaccgaacggtaccgtacggaaacggggtaaccaaaccgttacggtaccctaaccgtttacgaaccctagtacgtaggtcggaccggttccggacgtaaggacggaacggtacggtacgtacgtaacgttaacgttaccgttaggtaaccacggtaccgacgtaacggaacgacgtaccgtaggttacggacgttaacgttaggttacggttacggttaacggttccggggaccggggtaaacgggtaccgttacccgggtcgttacccgggtaaccggtttcccggtaaccggtccgaaccggtaccccggtaacgggttacccctacccgggttcccccggtaggtacccccg

SEQ ID NO: 188782 - DNA, 707 bp, Homo sapiens
  misc_feature: GYAE6OF01B6V39.53.1.A01.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggactcgttttgacccagtctcccgactccctggctgtgtctctgggcgagaggccaccatcaactgcaagtccagccacattttanacacctccaacaataagattaacttagcttggtaccagacaaaaaccaggacagcctcctgagctgctcatttacgnggcgtctaccgggaatcgtcgggtccctgaccgattcagttggaagtcgggtctaggggactaggtacttttccaacttctaccgaaccctataccgacgccaaggcccttagaccgagggtccttaaggaaaggtagttgggttagggacctttaaggtttttacttttccgtgttaccgaaggttacctaaacgtttaccgtttccgttaacggttttttcccggactttaccgtaccgtttttccggggacccgggtacggggtaccccgtaaggggttacgggtaacgtaacgttaacccggtaaaaaccggttaaccgttacgggttacgggtacccttacgggtaaccctaaaccccgttagtttacccgtttcggtttaccctttcgtttaaccccg

SEQ ID NO: 188783 - DNA, 814 bp, Homo sapiens
  misc_feature: GYAE6OF01AKM1O.53.1.A01.1.454.CMB.1.raw
  modified_base (113)..(113): a, c, t, g, unknown or other
  misc_feature (113)..(113): n is a, c, g, or t
  modified_base (146)..(146): a, c, t, g, unknown or other
  misc_feature (146)..(146): n is a, c, g, or t
  modified_base (183)..(183): a, c, t, g, unknown or other
  misc_feature (183)..(183): n is a, c, g, or t
tcagcgcgtatacacacgaccggtgctcgatttagacgtctcatcgaagggaaggaagggggtgggtccaggaggtcagaactctgggtgtctcaccatggcctggatccctntacttctccccctctcactctctgcacaggctntgagcctctatgagctgaacacagtccacccgtggtntctgtcgtccagaggtacaggtaccgcgaggactcacctgctgtggctatcgactagttacgaaacccaaaaatagttacgttcggtacctttaacggtaccggtaacccgaacggcgaacgggaccggcccgaacgggccccgtaccggtcccccttaggttccgtttaggtactaattttaaaccgtaagttcgtttaggaccggtcggaccccgtacggacccggtacccgtgacggtcgttacttccgccggtacgcctaccgtagtccgtacggaacggtaacctaacgtccggttacctaacccggttacgaaccgttagttaccggtaacgggtacgggtacccggggtacccgggaccgaagggaaccgggtacggacggttaccgttacggtaactttaccgttacgtacggtacccgtaggtcccgaacgtaccgacgtaacggaccgttagggtcggtactttaacgggtttcgttaccgggttaaccgttaggggttacggggaccgggttaacggtacccggtaccggttacggttaccggtacccgttccggtaacgggttacccgaacccgggtaccgtaacccgggtccccgttcccggtcccccggtttaccgg

SEQ ID NO: 188784 - DNA, 760 bp, Homo sapiens
  misc_feature: GYAE6OF01ENUHT.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggccggggacttcgtttgacccagtcctcccgactccctggctgtgtctcgtgggcgaggacggccaccgatcaacgtgacaagtccagccatatttacaccacctacaaactaaataagtattaacttagtcgttacggtaaccaagaacctaaaaaaccgcggaactaccggtacccttaccgtggaacgtcctagtaccgttacttaacgtttttaaccggcgggtaccggttaccgtaaacccgggtaagtttcccgggttccgggggttacccctggtaaccccgtaatttcccggtaggtttacgggaacgggtccgggttcggtacgggtaacgtaggttactttacgaccttaccgtactaaccacgtacgtaacgtcaacggtccctaggaccggaggtacctaaggtaaacgtggttcggtacggtactttaagttttcttacgtgtacaacggttcctaaacgtttcgtttccgttaaccgtttccgacgtttaccgttacgggtcccggggtaacggaaccgggtacccgttgggacgggtacaacggttaaacgaaccgttagtcggtacgtactcgaaccgtcgtacttccggttattcctaacgttcccg

SEQ ID NO: 188785 - DNA, 647 bp, Homo sapiens
  misc_feature: GYAE6OF01E4UQH.53.1.A01.1.454.CMB.1.raw
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
tcagcgcgtatacacacgaccggtgctcgatttagacgtctcatcagggggagctacaacaggcagggcaggggcagcaagatggtgttgcagacccaggtcttcatttctctgttgctctggatctctggtgcctggccgggacgttcgttttcgacccaggtcctcccgactccctggctgtgtctcgtgggcgaggacgggcccaccgatccaactgcaagtccagccatattttacaccacctacaaacaataagtattaactagcttggaaccagaaccaaaaccgnggacacgcctcngacnctgctctattacgnggcgtaccgtaccggatcgtcggtccagacgtntcagtggacgtcgggtcgtggacagtacttcnctccaccactatcacgcgacgccgtagcgagtcgtagtaacgtggtcggtacgtacgtttagttttacttcgtacgtaccaagtaccgtaacttacgtttccgttaccggtttcccgtaccgttaccgttaccgggtttccgggaccgggtacgggaacccgtaggggtcggaaacgtaacgtaaccggtaaaccggtacgttacggtcggcctacggaccctaaccgttacttccggttacgttccgtacttaccccgg

SEQ ID NO: 188786 - DNA, 630 bp, Homo sapiens
  misc_feature: GYAE6OF01DXO3R.53.1.A01.1.454.CMB.1.raw
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
tcagcgcgtatacacacgaccggtgctcgatttagacgtctcatcagggggagcgtacaacaggcaggcaggggcagcaagatggtgttgcagacccaggtcttcatttctctgttgctctggatctctggtgcctgccgggacgttcgttttgacccagtcctcccgactcccgtggctgtcgtcgtcgtggggcgagacgggccaccatcaactgacaagtccagccactatttaanaccacctacaacaataagattaacttancttgtaaccagacaaaaccgnggaccagcctctagacgctgactntaacgttttacgngggtacctcgtaacccgggatcggtcggggtccctggtaccgtntttccgagttcggacggtccggtntcgggactagtactttcacctgcctacgactacgagtacgtacgtccgtgaccgtagtcctaggtaacgtagttagggtcgtagttaggttttacttcgtagtcagtacttaacttcgtttacgtcgtttccgacgttctacgtttcggacggtacgtacgacgtagggacgtagtaacgaaacgtacgttagtcggaccgttagccgtaaactcgtaccgttctccgttctacccg

SEQ ID NO: 188787 - DNA, 933 bp, Homo sapiens
  misc_feature: GYAE6OF01DUAF6.53.1.A01.1.454.CMB.1.raw
  modified_base (505)..(505): a, c, t, g, unknown or other
  misc_feature (505)..(505): n is a, c, g, or t
tcagcgcgtatacacacgaccggtgctcgatttagacgtctcatcagggggagctacaacaggcaggcaggggcagcaagatggtgttgcagacccgaggtctctatttcttctgttgctcgtggatctcgtggtcgccgtggcggggtacgttcgtttacgaccctacggtccctaccccgacgtcccgtggtccgttggtcgtccgtcggtacggggcgacggaccgggacccaccgtattaccgaacgtcgacgtaacgtcccgacgtacctaactttacgttttaaccaccctaacctacccaaataaacgtaaagttaacttttaacgttacgtaccgttaccggtaaaccaacgtaaaccgaaaaaccgccggaaccgtaccgtacccgttccggtacgtacggtctaccgtcctacgtttaaccgtttcggtaccgggttacccgtaccgggtaaccggtaccgttcccggggttaccggtcccgtacggaccggttntaaccggtagtttacggggacggtcggttaacgggtacgggtaactacgtttaccgttaacgttaccctacgtaacctacccgtacgtaccggtacgtaccgtacccggtacccggtacggacggtaccggtacggttaaggtaacggttacggttacggttacgggttaaccgtttacgtttttaccggttacgttacgttaacggtaccttaaccgttaactttacccgtttacgtttacccggttaccgttcccgttaaccggtttacccgggttaccgggttaccgggtaaccgggttaaccggtacgggtacggttaaacccgaccgggtttaaaaccgacgggtttaaccggacggttaccggtcgttaacccgccgttaaccgttacccgttaacgtttccgtccgtttaaccgtccccgg

SEQ ID NO: 188788 - DNA, 590 bp, Homo sapiens
  misc_feature: GYAE6OF01EO6HU.53.1.A01.1.454.CMB.1.raw
  modified_base (234)..(234): a, c, t, g, unknown or other
  misc_feature (234)..(234): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagcgcgtatacacacgaccggtgctcgatttagacgtctcatcaggggggagctacaacaggcaggcagggggcagcaagatggtgttgcagacccaggtcttcatttctctgttgctctggatctctggtgcctggccgggacgtcgttttgacccagtctcccgactccctggctgtgtctctggggcgaggagggccaccatcaactgcaagtccagccactattttanaccacctaccaaacaataagatttaaacttagcttagtaccagacaaaaaccgaggacagcctcctgagctgctcattactgggccgntctacccggggaatcgtcggggtccngacgtattcagttggaagcgggtcgtgggtacagtactttcactcttcaacctactacacgcgacgtccgtcgacgaacggctaggaagataggtaggtctaggtttactttcgtgtactagtactaattaccttactacgtttacccgtactaccgttacgtttccggacgggacgggtaccaggtggaagacgtcgaaacgtaacgtcgtggactcgacctacagttcttcgtcttaccg

SEQ ID NO: 188789 - DNA, 874 bp, Homo sapiens
  misc_feature: GYAE6OF01DWY2N.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtcctcccgactccctggctgtgtctcgtggggcgaggacgggcccaccataccaactgacaacgtcccagcccaacttaattttacacctaccctaccaaacaataagtattaacttagcttacggtaaccaacgaaccgaaaaaaccgaggaaccacgccctacgtagacgtctcgccttactacgttttaaccggcgggtacccgtaaccggtaacccgggtaattcccgggttaccgggggttacccctacggaaaccccgttattaccgtaaggtttacgggaacgggtccggggttacggtacgggaacctaagtttaacctttaccgaaccgttcctacccgaacctaagtccgaaacggtcctacggtccccgttacggaccgtaacggggtaccttaaggggaaacgttaggttgggtaccgggtactttttaacgggtttttacttaccggtagggttaccaaacggttaaccttaaacttttacccggtttacctttaacccggtttttcccggtacccgttaccggttttaccggggtttcccggggaaaccgggggtacccgggtaacccggtaaacgggggttagaacggtaaacgttaaaccccggaaaagggtttaccggttacgggtaccgggtacccttagggaaaccccttaacggtacgttttcccgttaacggttccctttaaccgtaccccgg

SEQ ID NO: 188790 - DNA, 781 bp, Homo sapiens
  misc_feature: GYAE6OF01AJAMP.53.1.A01.1.454.CMB.1.raw
tcagcgcgtatacacacgaccggtgctcgatttagacgtctcatcaagggaagggaagggggtgggtccaggaggcagaactctgggtgtctcaccatggcctggatccctctacttctccccctctcactctctgcactaggctctgacggccttcctatgagcttagacacagtcacccgtggtgtctgtgtcctgaggacaggacgggccaggactccaccgtgctcgtggcgatcgctattcgaaccaaaaactatactcgtacttacgtcggtaacctagacgagacggccgaggcccgacggtcccctgttcgtttggtacgtatttaacgtaaagtcgtttaggacggtacgggtcccctggaccgggtaccccgtggacgacgtacttccgtcgtcgggtccttccgacgtccgtacggaacgggtaactaaacgtacgttaccgtacccgttacgaaccctaacgtcgtaacgggtacgggtaccggtccccggaccgtaacggtacggaacggacggtactaacgtaacttacttaccggttacgtaccgtacggttacccgacgtaacggaaccgtaacggtacgacgggttaccggtacgttaaggtttaacgttacggtttacggttacggttccggggtaacgggtaccggggtacgttacccgggtacgttaccgggtacccggttaccgggttacggtacccgtaaccgggtaccccggtaaaccgggtcccggttaaccccgggtccccccgtttaacccgggg

SEQ ID NO: 188791 - DNA, 708 bp, Homo sapiens
  misc_feature: GYAE6OF01CASIS.53.1.A01.1.454.CMB.1.raw
  modified_base (314)..(314): a, c, t, g, unknown or other
  misc_feature (314)..(314): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttgacccagtctcccgactccctggctgtgtctcgtgggcgagaggccaccgatcaactgcaacgtccagccactattttacaccacctaccaacaataagacttaacttagcttggtaccagacaaaaaccaggacagcctcctagagctgctctatttacgngggctacgtaccgggaatcgtcgggtccctggaccgtattcacgttggaacggtcgggtctacgggacaggtactttaccacttccgtaccaaccatccgtacgacgacggtaccgtcggacgtacggtaccttagggaaacgtacggttacgggttacgggtaccgtttaacggttttttaacttttccgttacggttactaacgggttacttaaacgtttaccgtttccggtttaaaccgtttttcccggacgtttcccttacccgggtttacgggtaccgggtaccgggtacccggtagggtacggtacgtaacgtacgtaaaccgttacgtcggttacggaccgtacgtaccgtaccgtacgttaccgttccgttacttcccgttacccg

SEQ ID NO: 188792 - DNA, 631 bp, Homo sapiens
  misc_feature: GYAE6OF01EZ8DB.53.1.A01.1.454.CMB.1.raw
  modified_base (462)..(462): a, c, t, g, unknown or other
  misc_feature (462)..(462): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcgggggacgttcgttttgaccccagtctcccgactccctggctgtgtctctgggcgagagggccaccatcaactgcaagtccagccactatttatacacctaccaacaataagattaacttagcttggtaccagacaaaaaccaggacagcctcctgagctagcctctatttaccgtggggtccgtaccgtaacccgggaattccgtcggggtcccctgaaccgattcgagttggaacggcgggtctgggactagtactttcactctcaaccatcacgcacgcctgcgaggctaggaagtatggtagcttagtttatttctacgtntagtactaaattacgttctaacgttttcccgccttaccttacggttttacgggccggtaacgggtaccccgtaggggttaggaaccgtaacgtaaccggtaaaacgtacggttggtaccgggtacctaggacccctaacgtacttaccgttcggttcccttcgtacccg

SEQ ID NO: 188793 - DNA, 757 bp, Homo sapiens
  misc_feature: GYAE6OF01COSDI.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtcgccgtggcggggtacgttcgttttacgacccagttcctcccgactccctggctgtgtctcgtggcgagcggccacatacaactgacaacgtccacgacctaattattttaacaccaacccttaccaaaactaaataagtaactttaacgttacgtaccgttacggtaaccaacgaaaccaaaaaccgaggaaccacgaccttaccgtagacgtctcgtccttacttacgtttaccgtcgggtaccgttaccggtaaccgggtaacgttccggttccggggttaccctacggtaaccgtacgttcgtaacggttaggaaccgggtcgggttacgtagggaactagttacttccactacctactactcgcagcctacgccgtagcgtaggtactaggagtagtacggtgttactttagttttacttcgacgttacgaacgtaacttaacttttacgttaccgtttaccgtttccgtaccgtttccgttaaccgggtttcccggggacggggtacccgggtaaccggtagggtacggtacgtaaaccgtaaccggtaaacgtccggttacggttcgtaccgtacgaacctaccggtactttacggttcttacccgtttcttaccccgg

SEQ ID NO: 188794 - DNA, 769 bp, Homo sapiens
  misc_feature: GYAE6OF01DZAIF.53.1.A01.1.454.CMB.1.raw
  modified_base (244)..(244): a, c, t, g, unknown or other
  misc_feature (244)..(244): n is a, c, g, or t
tcagcgcgtatacacacgaccggtgctcgatttagacgtctcatcaggggggagctacaacaggcaggcaggggcagcaagatggtgtgcagacccaggtcttcatttctctgttgctctggatctcgtggtgcctggccgggtacgttcgtttgaccctagtcctcccgactcccgtggtctgtcgtctcgtgggcgaggacgggccacgattcaactgacaacgtccagccattacttttanaccaccctaccaaactaataagtaacttaacttacgtcgttacggtaaccaaggaaaccaaaaaaccgtacgggaacctaacggtcccctttaccgtaggaacggtccttacggtcttacgttaacgttttaccggcggggttaccgttacccggttaaaccgggtaacttccggttaccgggggtcccctaacggtaaccgtaacgttctaaggttacgggaacggtccgggtacgtacgggactaggttactacgtacctacctaccgaacctatacgacgtacgaccgtccgtaggactacgggtctaaggaacgtacgttgggtaacgtacgtttacgtttagtttcggatcgtaagtaccttaattaccgtttacgttaccggtttcccgcttaacgttaccgggtttaccggggacggtaccggggtaacgtcgggtacggtaacgtaacgttaacccgaaattccggtagggtaccgacgtacgaaccttccgaagttcttacggtcttacggtaccg

SEQ ID NO: 188795 - DNA, 923 bp, Homo sapiens
  misc_feature: GYAE6OF01AGBYX.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcccgccgggacgttcgttttcgacccagtctcccgactccctggctgtcgtctctgggcgaggacggccaccatcaactgacaacgtccagcccactatttttacaccaccctaccaaacaaagtaagtactttaaccttagtccttacggtaaccaacgaaccaaaaacccgagggaccacgtaccctccgtgagtctcgtccttacgtactttacgtcgggtccgtccgttaacccggggaacttccggttcggggtcccctaggaccgtagtttactaggtttacgggaacgggttcggggtcgttaaggggacgtaacgtttactttaccctaaccttcctaccctaacccaacttaccgaacggtacccgtacggttacccgcggtacccgtaacggggtaccgttaacgggtaaaggtagttacggggttacggttaccgttttaacgggttttttaactttttccggtaccgggtttaacaaccggtttaaacttaaacccgtttttaacccgtttttaccggttttaacccggtttttttcccccggtaaccgtttttccgggtttaaaccccggggttttaccggggggtacccggggggttaaaccccggggtaacccggttaacgggggggtttaaaccggaaccgtttaaaacgtaaaccccgggttaaaaaaccggttacccggggttggggtttaccggaccggttaaccggacccgtaaaccgttacttttacccgggttcgttttaccctttaccgtcccggttttacccccccg

SEQ ID NO: 188796 - DNA, 658 bp, Homo sapiens
  misc_feature: GYAE6OF01E5Q70.53.1.A01.1.454.CMB.1.raw
  modified_base (329)..(329): a, c, t, g, unknown or other
  misc_feature (329)..(329): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (603)..(603): a, c, t, g, unknown or other
  misc_feature (603)..(603): n is a, c, g, or t
tcagcgcgtatacacacgaccggtgctcgatttagacgtctcatcagggggagctacaacaggcaggcaggggcagcaagatggtgttgcagacccagtcttcatttctctgttgctctggatctcgtggtcgccgtggcgggtacttcgtttcgaccctacgtcctcccgctccgtggtctgtcgtctcggtgggacgacggaccggaccacatacaactcgacacgcacacctattactttacacctacctaacaataataacgttaacttaacgtcgacgttaacgaacaacgaaaccaaaaccgcgaacctcctctcgtgtctcncgtactacttacgtaccggcggtaccgtaccggtacgtacgtcgggttaccgacgtacgactacgtagtacggtacggaggtcgtacggacgtactactctaccacctcacacnctacgacgtcgcgtacgactcgganacggttaanacgttggtacgttatacgtttagttactcggtacaactacgttaccttcgtttcctcgtttaccgtccgtacgtacgggttaccggacgggaaccgtacggagtggtaaccgtaaacaccggtaanaccgggtgtacctcgaccaccttaccttgtcccttcttacttcccgtcttacccg

SEQ ID NO: 188797 - DNA, 707 bp, Homo sapiens
  misc_feature: GYAE6OF01CQ77G.53.1.A01.1.454.CMB.1.raw
  modified_base (397)..(397): a, c, t, g, unknown or other
  misc_feature (397)..(397): n is a, c, g, or t
tcagcgcgtatacacacgaccggtgctcgatttagacgtctcatcaaggaagggaagggggtgggtccaggaggcagaactctgggtgtctcaccatggcctggatccctctacttcctcccctcctcactctctgcacaggctctgacggcctctatgagctagacacacgtccacctcggtgtctgtcgtccacacggacacggacggccgaggactccgactcgctcgtaggcgaatcgactaattacgaaacctaaaaactaattatcgtacgttaacgtcgtaaccgaagacgaacggacggaccgacggaccgcggcccttgtcgttaggtagttaactttaataaagtacgttaggacggacgacccgtacgacggtacccgtaggacgngtacttcgtacgtacggtactaccgacgtaccgtacgaacggaacctaaaccgtactaccgtaccgtttaacgaccgtacgtacgacgggtacgaccgggtacccggacggaagaaccgggagaacgtgtacgtaacgttaagttaccgtgtaccgacgtacgacgaacgaacggactcggaacgtgggtaactagttaacgttcggacggttaggtaccggaggggtaacgacgttaaccggcgttaccggtaccgtaccggtaacgtcccgaacggtaacccgaggcccgttacccgtcccggtaccg

SEQ ID NO: 188798 - DNA, 694 bp, Homo sapiens
  misc_feature: GYAE6OF01D5OLH.53.1.A01.1.454.CMB.1.raw
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (478)..(478): a, c, t, g, unknown or other
  misc_feature (478)..(478): n is a, c, g, or t
tcagcgcgtatacacacgaccggtgctcgatttagacgtctcatcagggggagctacaacaggcaggcaggggcagcaagatggtcgttgcagacccaggtcttcatttctctgttgctctggatctctggtgcctggcggggtacttcgttttagacccagtcctcccgactcccgtggcctggtgtcctcgtgggacgaggacgggcccaaccataccaacgtcgaccaaacggtcccaaggccctaattacttttaacgacctacccctaccgaaactaaattaaagtactttaacgttacgtcgttacgggtaaccaagaaccaaaaaaccgtcgggaacaacgtcccctaccgtaggaccgtctacggctactagttttaccggnggtcctaccgtaccgggattcgtcgggtcccngaccgtntcgagttcggaaggtcggtctgggactaagtctttcgactcctcgaacngtacagtccacgtcctgtaccaggtctaggaagtgtaggtcgtacgtttacgtttacttcgtcgtacgaactacgtaaacttcgtttaccttacgtttccgacttccgttacgttccgggacgggtacgggacccggtaggtacgtacgtaacaaccgtaaacgtagttacggtcgtccgtactaccgtactactcgttaacttccttacgtaccc

SEQ ID NO: 188799 - DNA, 731 bp, Homo sapiens
  misc_feature: GYAE6OF01C333E.53.1.A01.1.454.CMB.1.raw
  modified_base (298)..(298): a, c, t, g, unknown or other
  misc_feature (298)..(298): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttcgacccagtctcccgactccctggctgtgtctcgtgggcgagacggccaccatcaactgacaacgtccagccacttattttacacctacctaccaaacaataagtattaaacttagtcgttaggtaaccagaaccaaaaacccgnggtaacacgccctcgtaggacgtactgtcctactatttaccgcgggtacctaccggtaaccgggtacgtccggttacgggggtcccctaggtacccgtattcgtaacgttggaaacggtccggggtcgtagggaactaggtactttactaaccgtctaccgacctagtcgacgtccaagcccgttgaccgagtacgtaggtaaagtcgttggtacggtcgttaacgttttctttacgtacgttcaacggtaacctaagttttaccgttactttaacccgggttttcccgctttacccggttaaccggtttccgggaaccggggtacggtaccggtaccgggttaggtaccgtaacgtaaccgtaaaccggtacggttacgggtcggtacccgtacgtaccctacgttacgtcctttagttcccgttgtacccc

SEQ ID NO: 188800 - DNA, 794 bp, Homo sapiens
  misc_feature: GYAE6OF01ETD6C.53.1.A01.1.454.CMB.1.raw
  modified_base (526)..(526): a, c, t, g, unknown or other
  misc_feature (526)..(526): n is a, c, g, or t
tcagcgcgtatacacacgaccggtgctcgatttagacgtctcatcaggggggagctacaacaggcaggcagggggcagcaagatggtgttgcagacccaggtcttcatttctctgttgctctggatctcgtggtgcctggccgggtacgttcgttttgacccagtcctcccgactcccgtggctgtcgtctcggtgggcgacggacgggcccactatacaactgacacgtccacgcctacttacttttaacacctaccctaaccaaactaaataaacgtaattttaaaccgttacgtcgtttacggaaccgaacgaaaaccaaaaaccgacggaaccgaacgtcccttaccgacgtacgctcgacttaccttaggttgaaccttaccgggggaacgttaccttaccggggggtacccgttccgtaccgggggtacccttcgaccgttagtacggacgggttcggtaagggaccgggtagtaggtttaccgaacgtactttcctaaccctacttaccacgacgtacncttaggccctagggccctaggaacgtaggtacgtggactaaggtttatttacggttcgttacgttagttactaacgtaccgttacgtacgtttaaccgttaccgtttaccgttaccgttttaccgggttaccgggttaccggggtacccggttaacggggttaccgggtaacgggtaccgtaaccggtaaaccggtaacgtaaggtacggtaccggtaacgtacgtaccgtaccgtaccgtaccgttccgttaccgttaccgttaccg

SEQ ID NO: 188801 - DNA, 832 bp, Homo sapiens
  misc_feature: GYAE6OF01ARCAQ.53.1.A01.1.454.CMB.1.raw
  modified_base (614)..(614): a, c, t, g, unknown or other
  misc_feature (614)..(614): n is a, c, g, or t
tcagcgcgtatacacacgaccggtgctcgatttagacgtctcatcgagggggagctacaacaggcaggcaggggcagcaagatggtgttgcagacccaggtcttcatttctctgttgctctggatctcgtggtcgccgtggccgggtacgttcggttttcgacccagtccctcccggacttcccgtggcttgtcgtctcggtggggacgacggacgggccaacctagtaccaacgtcgaactaagtccacgtcctaattacttttaacacctaccttaaccgaaactaaattaacggttaacttaacgtttacgtacgtttaccgggtaaccaacgaaaccgaaaaaccgacggaacaccggtaccctaccgtacgcggtacgtcggtaccttacgttaacgtttaccgggcggggttacccgtaaccggtaacccggggtaacgttccgggttaccgggggttaccccgtacggtaaccgttacgttacgtacggggttaacgggtaacggggtccgggtacggttacgggggaacttacgggtttactttaccggaccctttaccgtaccgtaacctagtaccacggtccgaacgtccgtacggacgtacgnggtaagtaaggtgttacggtacggtcgtttaaacgttttcgttacgtcggtaaatccgtaacgtaccgtttacgtttccgtttaacgttcccgtaccgtttacgtaccggggttacgaccggggaacggtaccgggaggtacggacgtaacgtaacgaaaccggtcgtacggtaccgtcgacggtacctacgtcggttactccgttattcccgtaccg

SEQ ID NO: 188802 - DNA, 632 bp, Homo sapiens
  misc_feature: GYAE6OF01AWBE0.53.1.A01.1.454.CMB.1.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (594)..(594): a, c, t, g, unknown or other
  misc_feature (594)..(594): n is a, c, g, or t
  modified_base (601)..(601): a, c, t, g, unknown or other
  misc_feature (601)..(601): n is a, c, g, or t
  modified_base (625)..(625): a, c, t, g, unknown or other
  misc_feature (625)..(625): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctgtgcctggcgggacgtcgttttgacccagtctcccgatccctggctgtgtctctgggccaggacgggcccaccgattcgaaacgtgcgaaagttcccgagccaactattttactaccacctccaaacgaataacgatttaacctagcttggtaaccagacaaaaaccnggaccagcctactgagctaggctcactttacgngggccttacgtaccgggtattccgtacggggtccctgaccggtattcgagtttacggaacggtcgggtacgtgggaactagtacgtttccaacgttctaaacctagtcacgtcaggtccctaggctaggcctggaagcgttgtcgtactagttttattcgtgtacgaggtaccaagtttccttcgtcgttttaccgcttccgtacgtttcgggcgtacgggacccgagggttcgatacgtaaccgaaacgtaccgttggacgtcncggtacncccgtaattcgtactctttcccgnttccccg

SEQ ID NO: 188803 - DNA, 721 bp, Homo sapiens
  misc_feature: GYAE6OF01BUBC6.53.1.A01.1.454.CMB.1.raw
  modified_base (492)..(492): a, c, t, g, unknown or other
  misc_feature (492)..(492): n is a, c, g, or t
  modified_base (556)..(556): a, c, t, g, unknown or other
  misc_feature (556)..(556): n is a, c, g, or t
  modified_base (597)..(597): a, c, t, g, unknown or other
  misc_feature (597)..(597): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtcgcctggccgggtacgttcgttttcgacccaggtcctcccgactcccgtggcctgtcgtctcgtgggcgaggacggccaccatcaactgacacgtccagcctactattttacaccgacctacaaactaaataagtaactttaacgttacgtcgtttacggtaaccaagaaaccgaaaaaaccgacgggtaacaaccgtcccttaccgagtacggcctgtactactaacgtttacggcgggtccttacccggtaacccgggtaattccgggtcggggttacccctggtaaccgttctacgtacggtagggaacggtccgggtacgtacgggaactacgtactttccacttccacgtaacctntacgacgactaccgccgtacggcgtaacggagtaacggaagtagtggtacgtagtttacgtttntaccgtgacgtacgacttaacgttcctcgttaccggttccncgttcctacgggttccgggacgggtaccggtaaccgagggtacacggtaacgttaaccgaaacggttaggtcgtacggacctaggtacccctacgtacttaccgttacgtcccgttacgtcccg

SEQ ID NO: 188804 - DNA, 727 bp, Homo sapiens
  misc_feature: GYAE6OF01DS5NP.53.1.A01.1.454.CMB.1.raw
  modified_base (429)..(429): a, c, t, g, unknown or other
  misc_feature (429)..(429): n is a, c, g, or t
  modified_base (496)..(496): a, c, t, g, unknown or other
  misc_feature (496)..(496): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (565)..(565): a, c, t, g, unknown or other
  misc_feature (565)..(565): n is a, c, g, or t
tcagcgcgtatacacacgaccggtgctcgatttagacgtctcatcagggggagctacaacaggcaggcaggggcagcaagatggtgttgcagacccaggtcttcatttctctgttgctcgtggatctcgtggtgccgtggcggggtacgttcgttttcggacccctaggtcctcccgactcccgtggctggtcgtctcggtcgggcggaggacggccactagtacaactgacgaacgtccagacctacttaattttacaccctaccacctaaacaaagttaactaactttaacgttacgtccgtttacggaaaccgaagaaaccaaaaacgacggacaacggtcctacgagacgtctcgtactcttaacgtttacggtcggacccgtaccggtaacccggaatttccggtccggtacctacggtacgtntaacgtacgtacggacggtcgggtacgtacgggtaactacggttaactccgtactcctacgacctanacgtacgacacgtccgtagaccgtgacgtanaacggtntagggtacttacgtttagttcttgtacgtanaacgtataaaccgtttccgtatttacccggttcacgtttaccgtacgggttcggtacggacgggtaccgtagggtactaacgcgtaaaaccggtacgaggtacggtcggacccgtacggaccctacgttaacgtcccggttttataccccgtgttacccccg

SEQ ID NO: 188805 - DNA, 783 bp, Homo sapiens
  misc_feature: GYAE6OF01EYADO.53.1.A01.1.454.CMB.1.raw
  modified_base (328)..(328): a, c, t, g, unknown or other
  misc_feature (328)..(328): n is a, c, g, or t
  modified_base (693)..(693): a, c, t, g, unknown or other
  misc_feature (693)..(693): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtcgccgtggcgggggtactttcgttttcgaccctagtcctccccgactcccgtggcttgtgtccgtcggtgggcgaggacgggcccacataccaacgtgacaacgtccacgcctaattatttacaaccaccctaaccaataaagtaacgtaatttaacgttagccgtttacggtaaccaagaaaccctaaaaaccgnggaacacgacccttcgaggactcgtgtaccttacgttaactttaccggcgggtcccgttaccggtaaccgggactttccgggtcggggttcccgtaagtaacccggttattacgtacggttaacgggaggtccgggttacgtagggtaacctaggttaaactttccgaaccgtttaccaccctaaacgtactacggtacgtcgaccgttcgacgcgtaggtacgtacgaaaggtgttagggtacggttactttaacggttttcttacgtacgtactaacgttactttaacgtttaccgttacgtttaaccggtttccgacctttacgggttaccggttacggggtaccggtaccgggtaaccggnggtaaacggtaccgtaaacgtaaccggtaacgtaggtacgggtcggactacggtaccgtaactcgttaccgttgttacccctgtaccccg

SEQ ID NO: 188806 - DNA, 874 bp, Homo sapiens
  misc_feature: GYAE6OF01EJ2C6.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggtacgttcgttttcgacccagtcctcccgactcccgtggctgtgtctcgtgggcgaggacggccacatacaactgacacgtccacgcctacttattttacaacctacctaccaaactaaattaaagtaactttaacttacgtcgttacggtaaccaacgaaacctaaaaaacccgaggaaccacgcccctaccgtaggacgtcctacggtccttacgttaacgttttaccgggtcggggtacccggttaaccccgggttaaccccgggggtaaactttcccggggttacccgggggttaccccttacggtaaaccccggttacgtttaccgtaaggggtttaacgggaaacggggttccgggttacggtacgggaactacggttaccttttaccgaccgttaccctaccaaccgtacgtacgacggacctcggtcccgttagggacctagggtacctaaggtaagtacgttgggtacgttacgtttacggttttaacttccgtagttacaacgttaacgtttaacgtttaccgtttcccgtttaacggtttccccgtacgtttacccgggtttaccgggtttaccggggacggggtaaacccgggtaccggttaagggtacccgggtaaacgttaacgtaaacccggttaaaggttaccggttacgggtccgtaccggttacccgacccttaaacgttcgttaccgtttacgttacccgttccgttacccccg

SEQ ID NO: 188807 - DNA, 878 bp, Homo sapiens
  misc_feature: GYAE6OF01A9ODM.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgccgtggcggggacgttcgtttagacccagtcctcccgactcccgtggctgtgtctcgtaggcgaggacggcctacatacaacgtgacaacgtccaagcctaattatttaacaccaccctaccaaaagaataacgtaatttaactagtaccgtttacggaaccaacgaaacaaaaaccaggacaacgtcctccgtaggagtccgtgacctactagtttacgcggtaccgtcgtaacccggtaagtccggtcgggtaccctaggtaaccctagttacgtaaggtacggtaacggcggggttacgtacggggtaactaaggttacttttacccgaaccttacctaaccgtaacccctaacgttccgggaacaccggtacgtacccgtaacgggcccggtaacggttattaaagggaaaccggtaggtttaacggggtccgtttaaccggttttaacgtttttaacgtttacgggaccgtttaacgaacggttaaccgtttaaaattccccgtttttaccgggttaaacctttttccccgaacgtttacccgggttaaccggttttaccgggggaacccggggttaaaccggaccccgggttaaagggggtaactaaaccgggttaacctaaacccgggtaaaaccgtttaagggtcccgggttaagggtaccccgtaaccggtaccgtaacccggttacgggttttaaacccctttcggtttaccccgtttaaccggttaaccccccgg

SEQ ID NO: 188808 - DNA, 695 bp, Homo sapiens
  misc_feature: GYAE6OF01D8A7L.53.1.A01.1.454.CMB.1.raw
  modified_base (120)..(120): a, c, t, g, unknown or other
  misc_feature (120)..(120): n is a, c, g, or t
  modified_base (122)..(122): a, c, t, g, unknown or other
  misc_feature (122)..(122): n is a, c, g, or t
  modified_base (126)..(126): a, c, t, g, unknown or other
  misc_feature (126)..(126): n is a, c, g, or t
  modified_base (332)..(332): a, c, t, g, unknown or other
  misc_feature (332)..(332): n is a, c, g, or t
  modified_base (554)..(554): a, c, t, g, unknown or other
  misc_feature (554)..(554): n is a, c, g, or t
  modified_base (686)..(686): a, c, t, g, unknown or other
  misc_feature (686)..(686): n is a, c, g, or t
tcagcgcgtatacacacgaccggtgctcgatttagacgtctcatcagggggagctacaacaggcaggcaggggcagcaagatggtgttgcagacccaggtcttcattttctctgttgctngntctntggtcgctggcggggtcttcgtttcgacccagttcctcccgactcccgtggtctgtgtcctgtgggcgagcggaccaacctatacaacgtgactaacgccacaccaacttattttacaaccacctaccaaataaataaagtacttaaacttacgtcgttaacggtaaccaagaaaccaaaaaccgaggtaacaacgtccttaacgngacgtctacgtaccttacgttaacgtttacggacggggttacctacccggtaacccgggtaattccggtaccggggttacccctaggtaacccgtattaccgaaggtttgggaaacggtcgggtacgtagggaaccagttaattcacgtctaacactatacagctaacgtcctgaacgttggactaaggtactaagttcggacggttacgtttaactttttntcgtagactacgtaaccttattaccgttacttcgttaccgtcgttaccgtacggttcgggacggaacggtacgtaggtagaactaacgtaacgaaacgtagtcggtcgtacgcgtaactactacttccgttntctaccgtc

SEQ ID NO: 188809 - DNA, 791 bp, Homo sapiens
  misc_feature: GYAE6OF01ACL26.53.1.A01.1.454.CMB.1.raw
  modified_base (131)..(131): a, c, t, g, unknown or other
  misc_feature (131)..(131): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (626)..(626): a, c, t, g, unknown or other
  misc_feature (626)..(626): n is a, c, g, or t
  modified_base (736)..(736): a, c, t, g, unknown or other
  misc_feature (736)..(736): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggngcctggcggggacgttcgtttgacccagtcctcccgactcccgtggctgtcgtcctcgtgggcgaggacgggcccaccagtccaacgtgactaacgtccagcctactatttacacctacctaccaaacaataagtattaactagtcgttacggtaccanaaccaaaaccgnggtaccacgtccctaccgtgacgtcctcgtaccgtactacgtttaccggngggttcccgtaccggtaacccgggtaagttccgggtacccgggttcccgtacggtaccgtacgttaacgacggtttacgggaacgggtccggggttacggtacgggtaacttacggttaccgttttacccgtaccgtacccttacccgaaccgttagtacccgaacgggtcccgtaacgtcccgttacggaccgggtaacgggttacctaaggtaaaccgtcggttacgggttacggttacccgtttagttttaccgtttaccgtacgttaacncggttaactaacgtttccgttacgttacgttcccgtacgttaccgttaccggttacgggaccgggtaccggtaccgttagggacgttaacgaccgtaaccgtaaaccggngtcggtccggtactaccgacccgtacttgtacccgtttacttccgtccgttaccg

SEQ ID NO: 188810 - DNA, 694 bp, Homo sapiens
  misc_feature: GYAE6OF01A6NZ0.53.1.A01.1.454.CMB.1.raw
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggccgggacgttcgttttgacccagtcctcccgactccctggctgtgtctcgtgggcgagacggccaccatcaactgacaagtccagccactattttacaccacctaccaaacaataagtattaacttagtacttggtaaccaggacaaaaaccnggacacgcctcctganctgctctatttcgcgggtccgtccgtacccggtagtccgtcggggtccctacgaccgtattcgagttacgggaacggtccgggtacgtggggacacgttactttccaacctctacccacctacgtacgacgacgacgccgtcggacgtacggtccgtaggaaagtagttacgggtcgtacgtttacggtttttacgtttcgttacgacgttaccggacttaactttaccgtttcgttacggttttccctacgttaccgttacggtttccggggaccgggtaacgggtacccgtaggggtaccggtaagtaaccgtaacggtaaaccggttacgtacggttcggtaccgtccgtactaccgttagttcctttcgttcgtccgttacccg

SEQ ID NO: 188811 - DNA, 673 bp, Homo sapiens
  misc_feature: GYAE6OF01CJ99P.53.1.A01.1.454.CMB.1.raw
tcagcgcgtatacacacgaccggtgctcgatttagacgtctcatcaagggaaggaagggggtggtccaggaggcagaactctgggtgtctcaccatggcctggatccctctacttctcccctctcactctctgcacaggctctgagcctcctatgacgctgacacagtccacccgtggtgtctgtcgtccacgagacaggacgcaggtatcacctgctcaggcatgactagttcgaaccaaaatatctgtacttacgtggtaccagcaaggacgcgagccacggccctgtcgttggtgtaatttaagaaacgtcgtttagacgaccggtaccctacgaccgggtacccaggaaccggtctaacgttccgtacgttacggccctacgagtaccgtacggaacgggaaccaaacgtcggttaacccaccgtttaacggaccctaagttaccggaaggttacgggaccggtacccgggaacggaacggaccgggttaaacggacggtaccgtacgtaaccggttaattaaccgtcggttaacgaacgtccgaagtacgacgtacgtcgagtcggattagtacgtagtaccgttagtacgggacggtaacgtacgttacgacgtacgacccggttacgtaggtacacccgacgtaacgggcctcccgtcccgtacgg

SEQ ID NO: 188812 - DNA, 804 bp, Homo sapiens
  misc_feature: GYAE6OF01A9V14.53.1.A01.1.454.CMB.1.raw
  modified_base (762)..(762): a, c, t, g, unknown or other
  misc_feature (762)..(762): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggtacgttcgttttcgaccctagtcctcccgactcccgtggctgtgtctcgtgggcgaggacgggccaacatcaactgactaacgtccacgacctacttatttactaccaaccctaccaaactaaattaagtaacttaacgttacgcgtttaacggtaaccaacggtaaaccaaaaacccgtaggaaccacgtacccctaccgtaggacgtcctacgccttactacgtttaccggtcggggtaccgtacccggtaacccgggtagttccgggttacggggtacccctaggtaacccgttacttacgtaacggttacgggaccgggtccgggttacggtacgggtactaacgttacgttttaccgaaccttcctaccgtaaccgtacgtacgacgggtacgtaaccggtcccgtaggacccgtagggtaccgtaagggtaaacgtgttacgggttcggttaacttttaaggtttttcttccgtacggtacaaacgttaccttaaacgtttccgttaccgtttaccggtttccccgagtttaccggttacggttccggggaaccgggaccgggtaccggtagggtacggaacctaacgtaaacggtaaccgtagtgggtaaccncgtaaccacgtaccttagttaccttcgtaccgttcctacccg

SEQ ID NO: 188813 - DNA, 730 bp, Homo sapiens
  misc_feature: GYAE6OF01E0PH9.53.1.A01.1.454.CMB.1.raw
tcagcgcgtatacacacgaccggtgctcgatttagacgtctcatcaggggggagctacaacaggcaggcaggggcagcaagatggtgttgcagacccaggtcttcatttctctgttgctctggatctcgtggtgcctggcccgggtacgttccgttttcgaccccaggttcctccccggtacctcccgtggtcttggtcgtctcggtcgggacgaggacgggcccaccataccaactcgactaacgtccacgccctaacttattttaacctacccaccctaaccaaactaaataaactatttaacttagccttaggaccaacgaaccaaaacgacggacacgccctccgtagagtcgtcgtcttacttagtttaccggcgggtacctccggtaacccggtatcgggtccgggtcctacgtaccgtacttacaggttacggagggtccgggtgtagggactagtacttccacttccacgaccagtacacgcctacgccgtgacgagtaccgtagaagtacgtggtcgtatttaggtttcctttgtctacgtacttactaactttccttaggttcctttccggtcttaccgttaccgggttaccgggtaccgggacgggtacccgaaggggttacgtaaacggtaacgttaacggtaaaccggttacgtacgggttccgtacgttaccgacccgttacgttaccgtttctcccgtttacgtccccttacccg

SEQ ID NO: 188814 - DNA, 773 bp, Homo sapiens
  misc_feature: GYAE6OF01DKX8M.53.1.A01.1.454.CMB.1.raw
tcagcgcgtatacacacgaccggtgctcgatttagacgtctcatcgagggggagctacaacaggcaggcagggcagcaagatggtgttgcagacccaggtcttcatttctctgttgctctggatctctggtgcctggccgggtacgttcgttttcgaccctagtcctcccgacctcccgtggtctgtcgtctacgtcgggcgaggcgggcccaccgtactacgaaccgtgacctaacgtacccgacgtaccctaacttactttttaacaaccctaccccgtaaccctaaaactaaaagttaacgttaactttaaaccgtttaacgtccgtttaacgggttaaacccaacggtaaaacccaaaaaaacccggacggaacctaaccggtaccccttaccgttacgggacgtccgttacggtaccttacgttacgttttaaccggtcgggtacccgttaaccggtaaccgggtacgttccggtccgggttaccctccgtaaccgttacttacgtagtcggtaacggtcggtacgcgggtactacgtactttaccgtactcctaccgactacgtcacgtcgacgtccgtcgtacgagtactagtacgtatggttcgtagttacgtttacttagtacgtactacgtacttaagtttccgttactttcggttacctcgttactcgggttacgaccgggtacggccgtaagggcgaacgtacaacgtaagtacggtggtacgcgtacgtacctccttatccttacgttcttccgtacccg

SEQ ID NO: 188815 - DNA, 670 bp, Homo sapiens
  misc_feature: GYAE6OF01AHIG9.53.1.A01.1.454.CMB.1.raw
  modified_base (88)..(88): a, c, t, g, unknown or other
  misc_feature (88)..(88): n is a, c, g, or t
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
tcagcgcgtatacacacgaccggtgctcgatttagacgtctcatcaaggaagggaagggggtgggtccaggaggcagaactctgggtntctcaccatggcctggatccctctacttcctccccctctcacctctctgcacaggctctgacgcctctatgacgtctgacactacgtccaccgtggtntctgtcgtccncgaggacacggacgcgaggactccaccgtgctacggtggcgtatcgactacttacgaacctaaaactagttactcgtacgttacgtacggtaccaggcaggacggccgacggccgaccggtcccttggttcggttagtattaatttaacgtaacgttcgttaggacggtaccgtcccgtacggaccgggtacctagacgtacgtctttcgtcgtacggcctaccggacgtccgtacggacggaacctacgtacgtacctaccgtacaccgtagtcgtacggtacgggtaccgtaccggaaccgaggaaacgggcgtacgtcgtactacgtttacgagtacgtccgtaccgtcgaacacggactcgggacgttagggctacgttagttcggtcgttacggtacggcgggaaccggtgtaccgtcgacgtcggtccctaacgggtcaccgcgacgtcgccctcccgggtcctacg

SEQ ID NO: 188816 - DNA, 874 bp, Homo sapiens
  misc_feature: GYAE6OF01DTE5Z.53.1.A01.1.454.CMB.1.raw
  modified_base (113)..(113): a, c, t, g, unknown or other
  misc_feature (113)..(113): n is a, c, g, or t
  modified_base (564)..(564): a, c, t, g, unknown or other
  misc_feature (564)..(564): n is a, c, g, or t
  modified_base (695)..(695): a, c, t, g, unknown or other
  misc_feature (695)..(695): n is a, c, g, or t
tcagcgcgtatacacacgaccggtgctcgatttagacgtctcatcaagggaagggaagggggtgggtccagggaggcagaactctgggtgtctcaccatggcctggatccctntacttcctccccctctcactctctgcacgaggctcgtggacggtccctacctagtgacgtcgtacgacacacggtcctacccgttggtctctggtccgtcctacggaggacgaggaccggccaggctcccgacgttcgtcctcggtcgggactacgtcgtaccttaacgttaaccggaaaacctaaaaataacgttacgttaccgttaaccgttttaaccggtaccgggttaacccacggtaacccggaacggggaaccgggtaacccggaaccgggtccccgtaccccgggttccccgttttacggtttcggttttaaggtaaccgttttaaaagtttaaacgttaaacggtttacgtttacggaacgggtacccggtacccccgttaacggggtaccccgggtacccgtagggtaccgttacggtacctttcgtaccggtcggtacccnccggtaacgtccggtaaacgggaaccggaacgtaccgcgttaacctacggtactaccgaagttcgtacgggacggtaccggcggaaccgaagggcgaacggttcaacgtaccgtttaactagtccggtacncccggtacgacgacgtagaccggtagtacggtagggttagacctttaaggttccgtagggttaccgtaacggggttcgggaccggttaaaggacccggtcggtaccgacccggtacccggtttacggacgttcccgaaccggtccggtaacccggttcccgcccgttacccgggttccc

SEQ ID NO: 188817 - DNA, 955 bp, Homo sapiens
  misc_feature: GYAE6OF01CPMF7.53.1.A01.1.454.CMB.1.raw
  modified_base (122)..(122): a, c, t, g, unknown or other
  misc_feature (122)..(122): n is a, c, g, or t
  modified_base (133)..(133): a, c, t, g, unknown or other
  misc_feature (133)..(133): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctgntctcgtggtcncctcggccgggtacgttcgttttcgacccacgtcctcccgtactccgtgcttgtgtctcgtgggcgacggcggccacatcactcgacacgtccacgcctaacttatttacaccacctaccaactaaactagtacttaacgttacgtcttacggtaaccaagaaccaaaaacgacggaacctaccgtcctaccgtcggacgtctcgacttacttacgtttacggtcggtccggttaccgtaacccggggtaacgttccgggttaccgggggttaccctacggaaccgttacgttacgttacggttacgggtaacgggtccgggttacgtaacggggacgttacggttacttacctactccttaccaaccttcgtaccgacgtacccgtacggtacctacgggtccggtaaggtacccgggtaaagtaaacgggtacggtttacgggtttaacgggttacctttttaaaccggggttttttagttttacccgggtacccggtttaacggtaaacccggttttaacttaaaaccgttttttaacccgttttaacccggttttacccgggttttttacccccgaccgggttttaaccccggtttaccggggggttttacccgggggtaacccggggggtaacggggtaacccccgggttaacgggggttacggggttaaacccttaaaggtaaaaccccggtttaaaaccggggttacgggggttaccggggttaccgggtaaaccctttccggggaacccccttaaccggggttaccttacccggttttaccccggttttccccttaccggtttaacccccccgg

SEQ ID NO: 188818 - DNA, 1030 bp, Homo sapiens
  misc_feature: GYAE6OF01E2AH6.53.1.A01.1.454.CMB.1.raw
tcagcgcgtatacacacgaccggtgctcgatttagacgtctcatcagggggagctacaacaggcaggcaggggcagcaagatggtgttgcagacccaggttcttctattttctcgttggttgcctgtcggtacttcctcgtgggtcgtccgtcgggcgggggtacgtttcgtttttaccggacccgtacggttcctaccccggtacttccccgtgggtcgttcggttcttccgtacggtcgggggacggaagggggaccggaccctaaccaacgttaccaacgttcgaccgtaaaccggtccgtacgtaacctaacttttacttttaaccaaccctaaccccttaaaccgaaaaaccgttaaagtttaaaacggttaaacctttttaaacgtttaccggtaccggttttaaccggtaaaacccgaaaacgggaaaaacccaaaaaaaccggaccgggtaaccgttaaccggtccccttaccgggtagtaaccggttcgtccgttaccgtttaaccgtttaaccggtttaccggggacgggtttacccgggttaaaccccgggtaacccggggttaacgtttcccggggttaacccgggggtttacccctaacggtaacccggtttacttttaaccggacggggtttaacgggggtaaccggggtaccgggggtttcgtaacggggtaaccttaagtttacctttaccgacccgtttactaaacccggtaaccttacgttaccggaccggtactaccggtacccgttaggtaccgggaaggtcggtaaaggtaacgggttcggtggtacggtttaactttcggtttacttccggtaaggttaccagttaaccttttaagttcccgttttacgttacccgttttccaacgtttcccgggttaacggtcccggggtaacgggtaccggtacgggtagttacggtaaacgaaccggttaaccgaacggttagttccgtacggtccctaaccaccctttaacgttcggttccttaccgtacccttttcggtcccg

SEQ ID NO: 188819 - DNA, 800 bp, Homo sapiens
  misc_feature: GYAE6OF01EQ9QU.53.1.A01.1.454.CMB.1.raw
tcagcgcgtatacacacgaccggtgctcgatttagacgtctcatcaagggaaggaagggggtggtccaggaggcagaactctgggtgtctcaccatggcctggatccctctacttctcccctcctcactctctgcacaggctcgtgacggtcctctagtcggagctgacacgtacgtccacccgtcggtgtcctagtcgtcctcggaacggacgtacggaccggtccgaaggcttcccgtaacggtgaccttcggtcgggaccggtacggtcgaccgtaagttaccggaaaccctaaaaacttacgtaacgttcgttaccgttacgtaccggtaccgacggtacgacggtaccgaccgaccggccgtaccggtaccgttcggttacggtttacgggttaagtttaaacgtttaacgtaacggttacgtaacggtaccggtaccgtacccggtaccggtaaccgggtacccggtacggtaccggttacgttaccttccgtacgtacgtcccgtacgtacgtaccgtacggacggtaacctacgtaccgtaccgtacgtaccacgtacgtacggtacggtccggtaccggtacgacggtaacgggacggacggtacgtcgtaacgtactaacgttcgtacgtaccggtacgtacgacgacgtacgacggtacggagtacgtagttacggttagtacggttaccgtcggggtacgggtacggtacggtcggtaccgtaccggtaccggtacggtccggtacgacggtaccgtacggtaccggttcccgtcccgtccggtaccg

SEQ ID NO: 188820 - DNA, 816 bp, Homo sapiens
  misc_feature: GYAE6OF01E00F3.53.1.A01.1.454.CMB.1.raw
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttcgacccgagtcctcccgactccctggctgtgtctcgtgggcgaggacggccaaccgatcaactgacaagtccagcctaattattttacacctaccctaccaacaaataagtaatttaacgttagcgttaggtaccaagaaaccaaaaaccgnggtaaccacgtccttaccgtaggacgtcgtcgtcctattaacgtttaccggnggggttcccgtacccggtaaccgggtacgttccggtccggggttcccctacgtaccgtattaccgaaggtttcgggaacgggtccggggttacggtaggggaacctaacggttactttccgaccgttaccctacgtaaccacgtactacgtaccggaaccgtcccggtaggtacgtacggggtacctagtaaggtacgttcggtacggtagtttacgtttttaacttccggtagtaacctaacggttacctaatttacccggtttactttaccggtttacccgtactttaccggtttaccggtttaccggggaccggggttaaccggttacccgggaagggggtacggttaaacgtaaacccggtaaccgtaaaacgggtacggttacgggtccgggtacgtacccggtaaccgtaacccgttacgtacccgttttcttcccgttaacccgtttacccg

SEQ ID NO: 188821 - DNA, 758 bp, Homo sapiens
  misc_feature: GYAE6OF01DX4WJ.53.1.A01.1.454.CMB.1.raw
  modified_base (134)..(134): a, c, t, g, unknown or other
  misc_feature (134)..(134): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctgggtcncctggcggggtacgttcgttttgaccctagtcctcccgactcccgtggctggtcgtctcgtgggacgaggacgggccaaccgtatacgtaaccgtgactaacggtcccaacgtccctaacttaatttttaacaaccctaacctaaccaaacgtaaagtaaagttaacttaaccttacgtccgtttaacggtaacccgaaggaaacccaaaaaaccgaggaacctaacgtcccctacgtaggactcgtacgtccgtacttaagttttaccggtggggaccgtaacccggtacccgggtacgttcggtcgggtaccctaggaccgtattcgtaagttacgggaagtcgggtactagggaccttagtacgttctaccgtctacgacctagtacgactcacgtcctacgcgtacgcgttagagtagtggcgtttacgtagttttcgttgtaccgtagtacaccgtttaacttaccgttcgttacgttttacccgtccgtttaccgtacgggtttacccggacgggtaccgggtacccggtaggttaccgagttaaccgtaacgtaaaccggtacgtggcgttaccgaggtaccccttacggctttaccgttacgtacttaccgtaccg

SEQ ID NO: 188822 - DNA, 809 bp, Homo sapiens
  misc_feature: GYAE6OF01D6MBF.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcattttctctgttgctctggatctcgtggtcgcctggccgggtacgttcgttttcgacccacgtcctcccgactccctggtctgtcgtctcgtgggcgaggacggcccaccataccaacgtcgactaacgtccacgcctaacttaattttacaaccctaccccttaaccaaaacgtaaattaaagttaaactttaaaacgttaggtaccgttttaacgggtaaacccgaaccgtaaaccgaaaaaaaccgagggtaccaaccggtaccctccgtagacgtctcgtaccttacgtaacgtttaccggtcgggttacccgtaccggtaacccgggtaattccgggttacgggttacccctaggtaaccgtacgttacgtaggtacgggtaacgggtacgggtcgtaacggacgtacgttaactttcccacgtaccctaccgtactacgtacgacgtaccgtacgtccgtacggccgtacggtacgtaaggaacgtagtcggtaggtactttaacgtttgttacgtcgtactaacggttacttaacgttacgttcgtttaactttcccgtacgttacgttaccgggttaccgggtaacgggtacccggaacggtagggtaacggtacgtaaacggttaaccggaaacgttggttacggtcggacgttaacccgaccttaactaccttacgttcctcgttccttaccccg

SEQ ID NO: 188823 - DNA, 950 bp, Homo sapiens
  misc_feature: GYAE6OF01CF49U.53.1.A01.1.454.CMB.1.raw
  modified_base (910)..(910): a, c, t, g, unknown or other
  misc_feature (910)..(910): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtcgcctggcggggacgttcgttttcgacccagtcctccccgacttccctggtctgtgtctcgtgggcgaggcggccactatacactgacaacgtccgacgccaacttattttaacaccgaaccttaccaaactaaagtaacgtaactttaacgttacgtaccgtttacggtaaccctaacgaaacctaaaaaaccgacgggtaaccaaccggtccccttacccgtaggaaccgtccgttccggtaccttaccgtttaacggttttaccggtaccggggtacccgggtttaacccggttaaccccggggtaaacgttttccccgggtttcccgggggttaccccctacgggtaaacccccgtttaagtttaccgtaacggggtttacgggaaaccggggttccgggggttacgggtaaccggggtaaaacgtacccgggtttaaatttccccggtaacccttccgttaaacccgaaccgttaactaccgacccggtaaccgtaaccggtcccgttacgggccgttaaccggggtacgttaacggaaacgttacggtacgggtttacgggttaccctttttaagggtttttacctttaccgtacgttaacccggtaaacgtaaccgtttaaaccgtttacctttaaccggttttccggtttacccgttaaccggtttcccgtttaaaccggggtttaccgggaccggggtacccggtaaccggtaggtaacgggtaccgtaagtaacccgtaaagtaccggtaggttcccgtaccggtaacncccggtaccttacggttacctcgttcccttacgttacccg

SEQ ID NO: 188824 - DNA, 981 bp, Homo sapiens
  misc_feature: GYAE6OF01DZ3VI.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctcgtggtcgcctcggccgggtacgtttcgtttacgacctacgtccgtacccgctccctggtctgtcgtcctcggtcgggcgaggaccggccactactaccaacgtcgaccaacgtcccacgtacctaactttaacttttacacctaccctaacctaaagtaaagttaactaactttaacgtacgtacgttaccggaaacctaacgaaacctaaaaacggcgtaactaccgtaccctcgagtacgtcgtacgtccttacgtttacgtttccggcggtacctaccgggtaaccggtacttcggtaccggtacctacgtacgttctacgtaggtacgggcggtccggtagacggtatacggttcctttacgtacctacctacgactacggtacctacggacgtacccgtacgtcggtaccggtaacggttaccgggtaaaggtaacgttacgggttacgggtaggtttttaaccgtttaaaccggtttttaccgttttaacggtttaccggtaaacgttaacccggtttaaaccgtttaaccgtttttaacccgggtttttcccggttttacccggttttacccggtttaaccccggtttaacccgggggttttacccggggtttaaccccgggggggtaaccccggggtttaaacccggggaacccgggtttaacggggggttaaccggttaacccgttaaaaaccggggttaaaaccccggtttaaacgggttaacccggggttttacggggttacccttaaccccgggggtttaaccacccccgggtttaaacgttttaacccgtttcccggtttttaaacccgtttaccgggttaacccccgttttaacccccgg

SEQ ID NO: 188825 - DNA, 821 bp, Homo sapiens
  misc_feature: GYAE6OF01CRJ4G.53.1.A01.1.454.CMB.1.raw
tcagcgcgtatacacacgaccggtgctcgatttagacgtctcatcagggggagctacaacaggcaggcaggggcagcaagatcggtgttgacagacccaggtcttcatttctctgttgctctggatctctaggtcgcctggcggggacgttcgttttcgaccctacgtcctcccgactccctggctgtgtctcgtaggcgaggacggccacatcaactgcaagtccagaccacttatttacaccacctacaaacaatagtacttaactagtcgttacggtaccaacgtaaaccaaaaaccgtcggaactacgtccctacgtagacgtccgtcgtaccttacttaacgttttaccgtacggggtccgttacccggttaaccccgggtaattcccgggttccggggtaccccgttacggaacccgttatttaccggtaacgtttacgggaacggttccggggttactacggggactaacggtttacgttcctacgttcctaccgacctataccgacgacctacgaccgtcgtacgtacggtaccgtaagtaagttacggtacggtacggttacgttaacgtttttacgttaccgttggtaaccctaaggtacctttaacgtttaccggttttactttaacccggttttcccgttacgttacccgtttaccgggtttccggggaaaccgggtcccgggttaaccggtaggggttaccgtaacgggtaacctaacggtaaaccgggttaccgttagggtccgggttacctaccggccgttaaacccttcggttaccgtttccgttaccgttacccgttaccccgg

SEQ ID NO: 188826 - DNA, 917 bp, Homo sapiens
  misc_feature: GYAE6OF01EYJAW.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctcgtggtgccgtggcggggtacgttcgttttcgaccctagtcctcccgactccgtgctgtcgtctcgtgggcgagacggccacatacaacgtgacaacgtccacgacctaacttaacttttaacaccctaccctaacctaaactaaagttaaagtaactttaaacttaggtaccgtttacggtaaacctaaacgaaaacctaaaaaaccggtacggaaccgtaccgtccccgttaccggtaggaaccgttccgttacggttacctttaacgtttaaccggttttaccggggtaccggggttacccggtttaacccggttaaaccccgggggttaacgtttccccggggtttaacccgggggggttacccctttaaaccggggtaacccggtttaacgttttaccggtaaacggggttttaacggggtaaacggggtttccgggggttacggttaacgggggttaaacttacggtttaaccttttacccgtaacttacccgtaaccgtaacctaaccgttacccgaacggtaccgtaaccgtcccggtacggaccggtaacggttacggtaaagtaaggtacggttagggttacgtacgttttacgttttaacgttccggtagtaccggtaacttaacttaaactttcgttacctttaacggtttccctaccgtttacgttaccggtttacgggaacgggttaccggaacgtagggtacgtaacgtaccgtaaacgaacggtacgttacggcgtacgtacgccgttaactacttacgtcttaccgtctacccg

SEQ ID NO: 188827 - DNA, 811 bp, Homo sapiens
  misc_feature: GYAE6OF01BPBTS.53.1.A01.1.454.CMB.1.raw
  modified_base (516)..(516): a, c, t, g, unknown or other
  misc_feature (516)..(516): n is a, c, g, or t
tcagcgcgtatacacacgaccggtgctcgatttagacgtctcatcgagggggagctacaacaggcaggcaggggcagcaagatggtgttgcagacccaggtcttcatttctcttgttgctcgtggatctcgtggtcgccgtgggcggggtacgttcgttttcgaccctagtcctacccgtactcccgtggtcttgtcgtcgtcggtggggcgaggtacggccacgtatacaacgtggacacgtccgactactacttatttacaccacctaccaaataataacgtacttaactcgtacgttacgtaaccgaagaaacctaaaaacgcggaaccacgtacccctcgtagacgtacgtctccgttacttaacggtttcggcgggttaccgtaaccgggtaccgggtaacgttccgggttaccgggtaccctacggtaaccgtcgttacggtaggttacggacgggtcgggtagtacgggactacggtctttaccgcgtactacctactacgacggtacncgtaccgcgtcggtagtaacggtcgtaggtaacggtaggttcggttacgttacgttttagtttaccgtttcggtactaccggtaattaaccgtttaacctttaaccgtttccgggtttacctttcccggtacgttttacccggttacggggttaccgggacgggttaaccggacggttaaggggttaccgacgtaaaacccggttaagaaccggttaccggttaggttacccggacttacccgtaacgttaccttgggtttaaaccctttcggttaccccgtttaggtacccccg

SEQ ID NO: 188828 - DNA, 797 bp, Homo sapiens
  misc_feature: GYAE6OF01AZDAC.53.1.A01.1.454.CMB.1.raw
  modified_base (189)..(189): a, c, t, g, unknown or other
  misc_feature (189)..(189): n is a, c, g, or t
  modified_base (656)..(656): a, c, t, g, unknown or other
  misc_feature (656)..(656): n is a, c, g, or t
tcagcgcgtatacacacgaccggtgctcgatttagacgtctcatcaaagggaagggaagggggtgggtccaggaggcagaactctgggtgtctcaccatggcctggactccctctacttcctccccctcctcactctctgcacaggctctgaggcctcctatgagctagacactagtcctacctgggtntctgtcgtcctgacggacacggacggccgtaaggacgtccaccgtgtacctcggtcggacgtatcgtcgtaacgttacggaacctaaaaaacgtattacgtcggttacttaaccgtaggtaccgtacgacgacggacgtaccggacgaccggaccggtacccgttcggtcgttacggtagttaagttttaagtaaacggttaccgtttaggtacggaccgtacccgtacgtaaccgggtaccctggttacgccggttactttcgcgtacggctaacccgtgaccggtaccgtaacggttaccgaaacgttaccgtacccaccggttaacgtaacccgtaagtccggtacgggtaacggtacccggtaacccggttcgaaacccggggtaggtaaccgggacgttaaccgtaaggttacccgtttagttaacccgtcgtaccgtaacggtcgaaccgtacaacgggtnaacgttaggccgttagttaaccggttacgtcgtaacgggttaccggagggttaccgggtaaggttaccggtcgtaggtaccgtttaacggccgttaaccggacgtacccgtaacggacggttccgtcccgtaccggtccgg

SEQ ID NO: 188829 - DNA, 1043 bp, Homo sapiens
  misc_feature: GYAE6OF01DI1F6.53.1.A01.1.454.CMB.1.raw
tcagcgcgtatacacacgaccggtgctcgatttagacgtctcatcgagggggagctaacaacaggcaggcaggggcagcaagatggtgttgcagacccaggtcttcatttctcttgttgctctggatctctggtgcctggcggggtacgttcgttttacgaccctagttccgtcccgtaccttcccgtggtcgttgttcgtccgtcggttcggggacgaggaccgggtaccaaccgtattaccaacgttcgactaacgtcccgacgacctaacttaactttttacaaccccgtaccctaaccaaacgtaaacgttaagtaacttttaaacgttacgttccgtttaacggtaaccaaacggaaacccaaaaaaccggtacggaaccgtaccgtaccccgttaccggtacggtaaccgttccgttacgtaccgtttaacggtttacgtttttaccgggtaccgggggttaccgttaacccccgggttaaccggggttaaccgtttcccggggttacccggggtttaccccgtaacggttaaacccgttacgttttacggtaccggggtttaaacgggtaacgggggtccgggtttaccggggtaaacgggttaccggttaacggttttacccttttaccgttaaccccttaaccgttaccgtaaaccccgtaacgttaccggaaaccgtccccggtaacgtacccgggttacggaaccgttacgggtaaccgtaagggtaaccgttagggttacggtttaacggttaccgttttacgttttaccgtttcgtacggttaaccgttaagttaaccggtttaacttttaccgtttaccggttttaaccgttttaccccggtactttacccgggtttaaccggggttacccggggttaccgggtaaacccggggttcccggtaaggggttaaccggtaacgtaaaccggttaaaccgttaaaccgggttaggttcgggttccgtacccggtaagtaccccgttaaaccggtttcgttccggtttaccgtttccggtacctttaccccgg

SEQ ID NO: 188830 - DNA, 950 bp, Homo sapiens
  misc_feature: GYAE6OF01DDK6V.53.1.A01.1.454.CMB.1.raw
  modified_base (727)..(727): a, c, t, g, unknown or other
  misc_feature (727)..(727): n is a, c, g, or t
tcagcgcgtatacacacgaccggtgctcgatttagacgtctcatcagggggagctacaacaggcagggcaggggcagcaaagatgggtgttgcagacccaggtcttcatttctcttgttgctcgtggatctgtggtcgccgtcggccggggtacgtttcggttttcgaacccgtcgtcccgtacccggcttccccggtgggtccgttggttcgttccgtcggtacggggacggaacgggaccgggtacccaaccgtactaccgaaaccgttcggaccgtaaaccggtcccgaacgtaccctaaactttaatttttaacccgaaccctaaccctaaaccctaaaaactaaagttaaaacggttaaactttttaaaccgtttaacggtaaccgggtttaaccggttaaacccgaaacggtaaaaacccgaaaaaacccgggtagaaaaccggtaccgtaccccgtttaccgaagggtaccgtcgttacgggtacccctttaacgttacggttttaccggggtaccggggtaccgtttacccgggtaaaccggggttccttccggggttacccgggttaccgaccgggttaacctaacgtttcggaacggttaaccgggtaaacggggtccgggttaacggtacggtaaccgttagttaccttaccgtacctaccgtaccaacgtaacgtacgacgacgaccgtcgacggcgtaaggaccgtagtaacgngttacgggtacgttaacgtttagttccgttatacggttacctaaagtcctttaaagtttaccttccggtttaccgttacgttacgttccggttaaccgggtcgggaaccgggtaccggtacgtaaaggggttcaaacgtaggtaaaccgaaaccgttacggggctccgggtaacctacccgttacgtaaccttaccgttcttacgtaccgttacggttacccc

SEQ ID NO: 188831 - DNA, 777 bp, Homo sapiens
  misc_feature: GYAE6OF01BZ7AJ.53.1.A01.1.454.CMB.1.raw
  modified_base (414)..(414): a, c, t, g, unknown or other
  misc_feature (414)..(414): n is a, c, g, or t
tcagcgcgtatacacacgaccggtgctcgatttagacgtctcatcaagggaagggaagggcacgaccggtgctcgtatttagacgtctacatacgaagggaaggggaaggggggtggtacgagggaggcagtaacttcgtgggtgtcctccgaccagtcggccgtggactcccttacttaccttccctccccctcctccacctcctctacgcacgacggtctcgtggaccgtcccttactaagtcggtacgtacgtacaaccgaccgtacgtaccccgtaccggttcgggttcgttcggttccggttccgtaccgtaggaacggaccggacgggaccggacgaacggtactaccgaccgtacgttcgtcggtggactacgcgtactaacgttaaccgaaactaaagtaacgttntaccgttacgttacgaccgtacggcgacgacgggaccgtccgacccggtccgtaccggttcccgtttgggtttacgtaaggttatttaaacgttaaacggttaacgttagttaccgggaaccggtcccggtaccgtaccgggtaccgtaccgtgtacgtaccttacgttcgtccgtcgtaccgtaccgtagtaccgacggtaacgaccgtacgtaactccgtaacgtacgacgtaccgtggaccggtcgaccgggacgaagacggaacgcgtagtacgtacgttacattcggcctacgacgacgacgacgtagagtaccgtaggtagtacgttagttacgttaggacggtggtacgggaacgg

SEQ ID NO: 188832 - DNA, 561 bp, Homo sapiens
  misc_feature: GYAE6OF02GCT0N.53.1.A01.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagcaaaaaccaggacagcctcctgagctgctcatttacngggcgtctacccgggaatcgtggggtccctgaccgattcattggaagcgggtctgggacagatttcactctcaccatcagcagcctgcaggctgaagntgtggctagtttattctgtcagctaattacttctagttttcccgcttcctacgtttccgggcggtacgggtaccccgtagggtcggacgagtaccgaaaacggtaacttggtacggactacggacctaacccgtagttcccgtaggttccttacgtaccg

SEQ ID NO: 188833 - DNA, 530 bp, Homo sapiens
  misc_feature: GYAE6OF02FO0TR.53.1.A01.1.454.CMB.1.raw
  modified_base (227)..(227): a, c, t, g, unknown or other
  misc_feature (227)..(227): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacatttanacacctccaacaataagattaacttagcttggtaccagacaaaaaccaggacagcctcctgagctgctcatttactgggcgtctaccgggaatctggggtccctgaccgattcattggaagcgggtctgggacagatttcactctcaccatcagcagcctgcaggctgaagatgtggctagtttattcgtgtcagctaatacttctagttttccgcttctacgttttcgggcggtacgggaccctagggtggacgattaccgaaacggtaactggtggctgccacctatctgttccttcgtac

SEQ ID NO: 188834 - DNA, 547 bp, Homo sapiens
  misc_feature: GYAE6OF02GJK0A.53.1.A01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctcatttacnggctctaccgggaatcgtgggtccctgaccgattcattggaagcgggtctgggacagatttcactctcaccatcagcagcctgcaggctagaagatgtggctagtttatttctgtacagctaaattacttctagttttcccgcttcgtacgttttcgggcggtacgggacccagggtcggagactacgaaaacggtaacgttggtacggcctaggaccaccgtattcctcgttccttcgtacc

SEQ ID NO: 188835 - DNA, 547 bp, Homo sapiens
  misc_feature: GYAE6OF02IRPPS.53.1.A01.1.454.CMB.1.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcgggacgtcgttttgacccagtctcccgactccctggctgtgtctctgggcgagagggccaccatcaactgcaagtccagccacattttanacacctccaaacaataagattaacttagcttggtaccagacaaaaaccnggacagcctcctgagctgctcatttacnggctcaccgggaatctggggtccctgaccgtattcagttcggaagtcgggtctgggaccaggatttcactcgtacaccatcagcagcctgcaggctgaagatgnggctagtttattcagtcaagtcaatcttctagttttccgcttacacgtttcgggccgaaggtcccaaggttggacgtaagtccgaaaacgacgttcggtcggacctaggtcaaccgtagtccgttacgtccttataccg

SEQ ID NO: 188836 - DNA, 578 bp, Homo sapiens
  misc_feature: GYAE6OF02HKS2H.53.1.A01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (424)..(424): a, c, t, g, unknown or other
  misc_feature (424)..(424): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctcattacgngggctcgtaccggaatccgtggggtccctgaccgtattcagttggaagcgggtctgggacagtattcactctacaccatcagcagcctgcaggctagaagagtgtggctagtttatttcngtcagctaattacttctagttttcccgcttcgtacgtttcgggccggtaggtacccgtagggtacggagtacgttaaccgaaaaccggtaaccgttgggtacggtaccgtaggaccctaaccgtacgttccggttcgtttcccttacgtacccg

SEQ ID NO: 188837 - DNA, 523 bp, Homo sapiens
  misc_feature: GYAE6OF02H03O9.53.1.A01.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (520)..(520): a, c, t, g, unknown or other
  misc_feature (520)..(520): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttataccacctccaaacaataagattaacttagcttggtaccagacaaaaaaccnggacagcctcctgagctgctcatttacngggcgtctacccgggaatcgtggggtccctgaccgattcattggaagcgggtctgggacagtatttcactctcaccatcagcagcctgcaggctagaagatgtggactagtttattctgtcagctaattcttctacgtttccgcttctacgtttcgggcggacggaccgaggtgagtatacgaaacgtactggtcgctgcactatctgtcctntac

SEQ ID NO: 188838 - DNA, 614 bp, Homo sapiens
  misc_feature: GYAE6OF02J3D7M.53.1.A01.1.454.CMB.1.raw
  modified_base (297)..(297): a, c, t, g, unknown or other
  misc_feature (297)..(297): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttgacccagtctcccgactccctggctgtgtctctgggcgagacgggccaccatcaactgcaagtccagccactattttaacaccacctaccaacaataagtattaacttagcttaggtaccagacaaaaccaggacagcctctganctgctactattacgtggcgtaccgtaccgggtaatccggtcgggtcccctagacccgtattctagttacggaagtcgggtctagggacagtactttacactcgtcaccatcagcacgccctgcgaggtctagaaagtgttggtagacttagtttacttctaggtacagtactaagttaccttcgtacgttttccgacttccgtaacgtttccgggacgtaacgggacctagggtacggtacacgttaacccgaaacggtcgtcggtacgtccgtacgtacccgtacctacgtttcgtacgttacccttacgtaaccg

SEQ ID NO: 188839 - DNA, 572 bp, Homo sapiens
  misc_feature: GYAE6OF02JA762.53.1.A01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctcatttacngggctctacccgggaatcgtggggtccctgaccgattcattggaagcgggtctgggacagatttcactctcacatcancagcctgcaggctgaagatgtgctagtttatttcgtgtcagtctaaattacttctacgttttccgcttacctacgttttcgggcgggtaacgggtacccagggttcggacgtacgtaccgaaaacggtaaccgttggtacgggcttacggacctaacccgtagttccgttacggttcctttacgtaaccg

SEQ ID NO: 188840 - DNA, 568 bp, Homo sapiens
  misc_feature: GYAE6OF02F4H02.53.1.A01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctcatttacngggcgtctacccgggatcgtggggtccctgaccgattcagttggaagcgggtctgggacagatttcactctcaccatcagcagcctgcaggctagaagatggtggctagtttacttctgtcagctaattacttctagttttcccgcttctacgttttcgggacggtacgggaccctagggtcggagtacgtaccgaaaacggtaccttgggtacgggaccttaggaccctacccgtagttccgtacggtttaccttactaaccg

SEQ ID NO: 188841 - DNA, 544 bp, Homo sapiens
  misc_feature: GYAE6OF02HU272.53.1.A01.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtctcccgactccctggctgtgtctctgggcgagagggccaccatcaactgcaagtccagccacattttanacacctaccaacaataagattaacttagcttggtaccagacaaaaaccnggacagcctcctgagctgctnatttacgngggctcctaccgggatcgtcgggtccctgaccgattcattggaagcgggtctggggacagtatttcactctcaccatcagcagcctgcaggctagaagatgtggactagttttatttctgtcagcaattcttctagttttccncttctacgtttcggcgggtacgggacccngggtaggacgtataccgaaacgtacgttggtacgctgacctaccgattcgttgttccttactacc

SEQ ID NO: 188842 - DNA, 555 bp, Homo sapiens
  misc_feature: GYAE6OF02GYSDX.53.1.A01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctcatttacnggcgtctacccgggaatctggggtccctgaccgattcattggaagcgggtctgggacagatttcactctcaccatcagcagcctgcaggctagaagntggtgctagtttattcgtgtcagtctaattacttctacgttttccgcttctacgtttcgggacggtacggacccgtagggtcgagtacgtacgaaaacggtacttggtacggcttacggacctaacctagttccgttacggttccttacgtacc

SEQ ID NO: 188843 - DNA, 565 bp, Homo sapiens
  misc_feature: GYAE6OF02HBH5I.53.1.A01.1.454.CMB.1.raw
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (409)..(409): a, c, t, g, unknown or other
  misc_feature (409)..(409): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactatttanacacctccaacaataagattaactagcttggtaccagacaaaaaccagacagcctctgagctgctctattacgnggcgtacgtacccgggatcgtcggggtccctgaccgtattcagtggaagcgggtntgggacagtattcactctcacatcagcagcctgacgagctagaagtagtggngtacttagttttacttcgtgtacagtactaattcttctacgttttcccgcttcgttaccgtttcgggaccggacgggtacccagggtacgagtactaacgaaacgtacgtggtacggctacgacctaccgtacttccgtacgttccttacgtaccg

SEQ ID NO: 188844 - DNA, 529 bp, Homo sapiens
  misc_feature: GYAE6OF02H0IY2.53.1.A01.1.454.CMB.1.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccaccatcaactgcaagtccagccacattttataccacctccaacaataagattaaacttagcttggtaccagacaaaaaccnggacagcctcctgagctgctcatttacngggctctaccgggatcgtgggtccctgaccgattcagttggaagcgggtctgggacagtatttcactctcacatcagcagcctgcaggctgaagntgtggctagtttatttcngtcagctaattacttctagttttccgcttcgtacgtttcgggcggtaaggacccgtagggtcgagtactacgaaacgacgtggtgactgaccacattcgtcgttcttctac

SEQ ID NO: 188845 - DNA, 525 bp, Homo sapiens
  misc_feature: GYAE6OF02HLWWM.53.1.A01.1.454.CMB.1.raw
  modified_base (303)..(303): a, c, t, g, unknown or other
  misc_feature (303)..(303): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttatacacctccaacaataagattaacttagcttggtaccagcaaaaaccaggacagcctcctgagctgctcatttacngggctctacccgggaatcgtggggtccctgaccgattcattggaagcgggtctgggacagtatttcactctcaccatcagcagcctgcaggctagaagatgtggctagtttatttcgtgtcagcaattacttctagttttcccgctctacgtttcggcggacggaccctagggtggagactacgaaacgacgtggtggctgccacgattcgtcgtcttctac

SEQ ID NO: 188846 - DNA, 576 bp, Homo sapiens
  misc_feature: GYAE6OF02I88A2.53.1.A01.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagaggccaccatcaactgcaagtccagccacattttanacacctccaaacaataagattaacttagcttggtaccagacaaaaaccaggacagcctcctgagctgctcatttacgngggcgtcgtacccgggatcgtcgggtccctgaccgattcattggaagcgggtctgggacagtatttcactctcaccatcagcagcctgcaggctagaagatggtgactagtttatttcgtagtcagtacaattacttctacgttttcccgactttccgtacgttttccgggacgggtacgggtacccgtagggtcggagtaacttacgaaaacggtacttgggttacggccttggaccctaaccgtagttcccgtgttaccttcgtaaccg

SEQ ID NO: 188847 - DNA, 543 bp, Homo sapiens
  misc_feature: GYAE6OF02H7YPI.53.1.A01.1.454.CMB.1.raw
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagacgggccaccatcaactgcaagtccagccactattttanacacctcaacaataagattaactagcttgtaccagacaaaaacngacagcctctganctgctcattacnggctctaccggaatctgggtccctgaccgattcagttggaagcggtctggacagtatttcactctcaccntcagcagcctgcaggctagaagatgtgctagtttattctgtcagcaattacttctagtttcccgcttacctacgtttcgggacgggtaacggaccctagggtcgaacgtattaccgaaaaccgtaacgttgtaggtccgtagacctaaccgtattccgtagttccttactaacg

SEQ ID NO: 188848 - DNA, 535 bp, Homo sapiens
  misc_feature: GYAE6OF02G4ZXO.53.1.A01.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacatttanacacctccaacaataagattaactagcttggtaccagacaaaaaccaggacagcctctgagctgctcattacngggctctaccgggatcgtgggtccctgaccgtattcattggaagcggtctggacagtacttcactctcaccatcagcagcctgcaggctgaagntgtgctagtttattctgtcagctaattcttcgtacgttttccgacttcgtaccgtttcggacgggtacggtaccctagggtacggagtacgtacgaaacgtacgtggtcggctgacctacgattcgtacgttcctactacg

SEQ ID NO: 188849 - DNA, 552 bp, Homo sapiens
  misc_feature: GYAE6OF02G02UZ.53.1.A01.1.454.CMB.1.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
  modified_base (410)..(410): a, c, t, g, unknown or other
  misc_feature (410)..(410): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttggtaccagacaaaaaccaggacagcctcctgagctgctctatttacgngggcgtcctacccgggaatcgtcggggtccctgaccgattcagttggaaggcgggtctgggacagtatttcactctcaccatcagcagcctgcaggctagaagntggtggctagtttattctgtcagctaattcttctacgttttccgcttctacgtttcgggcggtacggacccgtagggtcggagtacgtaccgaaacggtaacgttggtcggctgacctaccgtattcgtcgttccttctacg

SEQ ID NO: 188850 - DNA, 572 bp, Homo sapiens
  misc_feature: GYAE6OF02JH42P.53.1.A01.1.454.CMB.1.raw
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctcaaacaataagattaacttancttggtaccagacaaaaaccnggacagcctctgagctgctcatttacgnggcgtctacccgggaatcgtggggtccctgaccgattcgattggaagcgggtctgggaacagactttcaactctacacctatcagctagcctgcaggctagaanagtgtggctagtttacttctgtaccaagtcctaagttacttctagttttcccgattcctacgtttcggacgggtacggaccctagggtcgagtacttacgaaacgtaacgttggtacggtcctaggtaccaccctaagttccttacggttacccttacgtaccg

SEQ ID NO: 188851 - DNA, 573 bp, Homo sapiens
  misc_feature: GYAE6OF02HKSJV.53.1.A01.1.454.CMB.1.raw
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (411)..(411): a, c, t, g, unknown or other
  misc_feature (411)..(411): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacatttanacacctccaacaataagattaacttagcttggtaccagacaaaaaccnggacagcctctgagctgctcatttacnggctctacccgggaatcgtggggtccctgaccgtattcagttggaagtcgggtctggggactagtatttcgactctacaccatcagcagcctgcagctgaagatggtgntagtttatttctgtcagcaattacttctacgttttcccgcttcctacgtttcggcgggtaacggacccgtagggtcgacggtaacttaccggaaaacggtaactcgggtacggtaccttacggacctaacccggtattccggttgttacccgttactaaccg

SEQ ID NO: 188852 - DNA, 580 bp, Homo sapiens
  misc_feature: GYAE6OF02H3U38.53.1.A01.1.454.CMB.1.raw
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtcctcccgactccctggctgtgtctcgtgggcgaggacgggccacatcaactgacaagtccagccactattttanaccacctacaacaataagattaacttagcttgtaccagacaaaaaccnggacagcctcctgacgtctcgctctatttacgngggctcgtacccgggatcggtcgggtccctgaccgtattcagttcggaacgtcgggtacgtgggactaggtactttccactctaccacctatcgagcagcctgcagctagagtagtggagcttagtttcttcgtgtcagtactaacttcttcgttacgtttccacttctacgtttcgggcggtaacggacccgtagggtcgagtactacgaaacgtacgttggcgtactcgaccgtaccgtagttccgttacgttccttactccg

SEQ ID NO: 188853 - DNA, 528 bp, Homo sapiens
  misc_feature: GYAE6OF02HITY1.53.1.A01.1.454.CMB.1.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
  modified_base (468)..(468): a, c, t, g, unknown or other
  misc_feature (468)..(468): n is a, c, g, or t
  modified_base (524)..(524): a, c, t, g, unknown or other
  misc_feature (524)..(524): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaactagcttggtaccagcaaaaaccnggacagcctcctgagctgctcatttacngggctcgtacccgggaatcgtggggtccctgaccgtattcagttggaagcgggtctggggacagtatttcactctcaccatcagcagcctgcaggctgaagntgtggctagtttattcngtcagcaattacttctatttccgcttctactttcggcgtaggacccnggtggagtactacgaaaccgtagtggtacggctgcctaaccagttcctgttccttntacc

SEQ ID NO: 188854 - DNA, 583 bp, Homo sapiens
  misc_feature: GYAE6OF02F11AY.53.1.A01.1.454.CMB.1.raw
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacattttanacacctccaacaataagattaacttagcttggtaccagcaaaaaccnggacagcctctgagctgctcatttacnggctctacccgggaatcgtgggtccctgaccgattcattggaagcgggtctgggacagtatttcactctcaccatcagcagcctgcaggctgaagatggtgctagtttattcgtgtcagctaattctttcagttttcccgcttcgtacgttttccgggacggtaacgggtaccctaaggggttcggacgtaacgtacccggtaaaaacggtaccttagggtacggtccgttacgggaccctaacccgtaagttcccgttacggtttaccttaccgtaaccg

SEQ ID NO: 188855 - DNA, 605 bp, Homo sapiens
  misc_feature: GYAE6OF02HD0GE.53.1.A01.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttanacacctccaacaataagattaacttagcttaggtaccagacaaaaaccnggacagcctcctgacgctgctcatttacngggctcgtaccgggatccgtggggtccctgaccgtattcagttggaagcgggtctgggactagtactttcactcctcacctatccagccacgcccgtgaccgaggtctagaagtagtggtcggtactaggttttacttcgtagtcaagtactaagttacctttcgtacggttttccgcttaccgttaccgttttccgggacggtacgggtacccgtagggtcggagtacgtaccgaaacggtaccttggtacggtccgttaggaccctacgtagttaccgttcggttacttccgtacg

SEQ ID NO: 188856 - DNA, 523 bp, Homo sapiens
  misc_feature: GYAE6OF02FV9AV.53.1.A01.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccacatttanacacctccaacaataagattaacttagcttggtaccagacaaaaaccaggacagcctcctgagctgctctatttacgngggctctacccgggaatcgtgggtccctgaccgattcattggaagcgggtctgggacagtattcactctcaccatcagcagcctgcnggctagaagatgngctagtttatctgcagctaattcttcacgttttccacttctacgtttcggcggtacggtacccgaggtgagataccgaaacgaactcggtagtctgacacctagtctgtccttctacg

SEQ ID NO: 188857 - DNA, 580 bp, Homo sapiens
  misc_feature: GYAE6OF02I0ADU.53.1.A01.1.454.CMB.1.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccacattttanacacctccaacaataagattaacttagcttaggtaccagaccaaaaaccaggacagcctcctgagctgctcatttacngggctcgtacccgggatcgtcggggtccctgaccgtattcagttggaagcgggtctgggacagtatttcactctcaccatcagcagccctgacaggctagaagtagtggtcggacttaggttttatttcgtagttcagtactaattacttcgttacgttttccgcttacctacgttttccgggacgggtacggtaccctagggtcggacgataaccgaaacggtaacgtggtacggtcgtacgacaccgtagtccgtcgtttacctacgtaccg

SEQ ID NO: 188858 - DNA, 581 bp, Homo sapiens
  misc_feature: GYAE6OF02IEFQJ.53.1.A01.1.454.CMB.1.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
  modified_base (482)..(482): a, c, t, g, unknown or other
  misc_feature (482)..(482): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttanaccacctccaaacaataagattaacttagcttaggtaccagacaaaaaccaggacagcctctgacgctgctctatttacgngggcgtacgtaccgggaattcgtcggggtccctgaccgtattcgattgggaagtcgggttctggggacaggtatttcactctacaccatcagcacgcctgcaggctagaagtatggtcggacttaggtttttatttccaggttccagactaaattcttacttacgttttccncttcctacgtttcgggacggacggtacccagggtcgagtactacgaaaacgtactggtacggcctacggtccaaccgtgttctacgttccttactaccg

SEQ ID NO: 188859 - DNA, 552 bp, Homo sapiens
  misc_feature: GYAE6OF02GV48K.53.1.A01.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (422)..(422): a, c, t, g, unknown or other
  misc_feature (422)..(422): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactattttanacacctccaaacaataagattaacttagcttggtaccagacaaaaaccnggacagcctcctgagctgctcatttacnggctctacccgggatcgtgggtccctgaccgattcattggaagcgggtctgggacagtactttcactctcaccatcagcagcctgcaggctagaagtatgtggctagtttattcgngtcagtctaattcttcgtacgttttcccgcttcgtaacgtttcgggacgggacggtacccgagggtcggacgactacgaaacggtacgttggacggtcttaggacctactacgttctgttccttctaccg

SEQ ID NO: 188860 - DNA, 574 bp, Homo sapiens
  misc_feature: GYAE6OF02HS0EQ.53.1.A01.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtcctcccgactccctggctgtgtctctgggcgagagggccaccatcaactgcaaagtccagccactattttanacacctcaacaataagattaacttgcttggtaccagacaaaaaccaggacagccctctgagctgctcatttacngggctctacccgggatcgtggggtcctgaccnttcattggaagcggtctgggacagtattcactctcaccatcagcagcctgcaggctgaantggtgctaggtttnttctgtcagtctaaagttactttcgtacgtttttcccgcttacctacgttttcgggccgggtaacgggtacccgtagggtcggaagtacttaaccgaaaaccggtaacgttggtcggtaccgttagaccctaactacgttccgttacggttccttcgtaaccc

SEQ ID NO: 188861 - DNA, 599 bp, Homo sapiens
  misc_feature: GYAE6OF02JRC5F.53.1.A01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (438)..(438): a, c, t, g, unknown or other
  misc_feature (438)..(438): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagnggccaccatcaactgcaagtccagccactattttanaccacctccaacaataagattaactagcttgtaccagacaaaaacnggacagcctcctganctgctctattacgtggcgtcctaccggaatcgtcgggtccctggacctattcagtaggaagtcgggtctagggacagtactttcactctacgaccatcacgcacgtcctgaccgaggctaggaaagtgtaggtggaccttaaggttttnttccgtaggtacagtacctaagttccttgttacgtttccctacgttcgtaccggtttccgggacgggtaaccggacccgtagggtaccggataaccgtaaccgtaaacgtacggttcgcggtacctggacccgtcttacggttcctaggttccttaccacg

SEQ ID NO: 188862 - DNA, 583 bp, Homo sapiens
  misc_feature: GYAE6OF02HLO97.53.1.A01.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (440)..(440): a, c, t, g, unknown or other
  misc_feature (440)..(440): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccacatcaactgcaagtccagccacatttanacacctaccaacaataagattaacttagcttaggtaccagaccaaaaaccaggaacagcctcctagacgctgctcatttacngggctccgtacccggaatccgtcgggtcctagaccgtattcagttggaagtcgggtcgtgggacagtatttcgactctacaccatcagcagcctgacgaggctagaagatgtcggactaggttttacttcgtntacgatactaaactacgttcttaacgttttcccgctttaccgtaccgtttcgggacggtaccggacccagggttacggatacgtaccgaaaacggtactggtcgtacctggaccctaccgattccttcgttcttaccctaccg

SEQ ID NO: 188863 - DNA, 554 bp, Homo sapiens
  misc_feature: GYAE6OF02IX9TB.53.1.A01.1.454.CMB.1.raw
  modified_base (314)..(314): a, c, t, g, unknown or other
  misc_feature (314)..(314): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactattttatacacctccaaacaaataagattaacttagtcttaggtaccagaccaaaaaaccaggacacgcctcctgagctgctctatttacgngggcgtccgtacccgggaatcgtcggggtccctgaccgtattcattggaagtcgggtctgggactagtactttcactctacaccatccagcagcctgcagctagaagatggtgcttagtttatttctgtcagtactaattacttcgttacgttttccgcttactaccgtttccgggacggtacggaccgaggtcggagtactaacgaacgtagtggtagctgacacgtatctgtctactc

SEQ ID NO: 188864 - DNA, 658 bp, Homo sapiens
  misc_feature: GYAE6OF02INI2J.53.1.A01.1.454.CMB.1.raw
  modified_base (314)..(314): a, c, t, g, unknown or other
  misc_feature (314)..(314): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtctcccgactccctggctgtgtctctgggcgagagggccaccatcaactgcaagtccagccactattttataccacctaccaacaataagattaacttagcttaggtaccagacaaaaaccaggacacgcctcctgacgctgctctatttacgngggctcgtaccgggaatcgtcggggtccctgaccgtattcagttggaaggtcgggtcgtgggactagtactttcacttctaccacctatcagcacgcctgcgaggctagaaagtagtggtcggcttaagtttactttctgtactatactaacttctttccttaacggttttcccgactttaccgttacggttttccggggaccgggtaaccgggtaaccccgtagggttacggtaacgtaacgttaaccggaaaaaccggttaaccggttgggtaccgggtaccgttaccggaccctaacccgttacgttacccggtttacggttacccctttaccgtaacccg

SEQ ID NO: 188865 - DNA, 794 bp, Homo sapiens
  misc_feature: GYAE6OF02IRJQK.53.1.A01.1.454.CMB.1.raw
  modified_base (235)..(235): a, c, t, g, unknown or other
  misc_feature (235)..(235): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtcctcccgactccctggctgtgtctcgtgggcgagacggccaccatcaactgacaagtccagccaactattttanaccacctaccaaacaataagtaattaacttagtcttaggtaaccaagaaccaaaaaaccgaggaaccacgtaccctacctaggacgtcttcgaccttactaacgtttaccgcgggtccgttaccgtaaccccggggtaattccgggtccggggtaccccttaggaaccgtacttaccgtaggttacgggaacggtccggggttacgtacggggaaccgtaaggttacttttaccgaaccgttcctacccgtaaccctaacgtaccgtaacgactaaccgcccgttacggaccgtacggtaccgttaaggaaagggtacgttcgggtacggttaccgtttaaggtttttaacgtttccgttagttaccgaacgtaccgttaaaacgtttccgtttacgtttaaccgtttttcccgtaccgtttaccgttaaccgggtttccgggtaccggggtaaccggtaacccgggtagggttaccggaggtaacctaaccggaaacgttacggttcgtacggtacgtacgacctaaccggtacgtttcgtacgttcctaccgtaacc

SEQ ID NO: 188866 - DNA, 583 bp, Homo sapiens
  misc_feature: GYAE6OF02HP015.53.1.A01.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttanaccacctccaacaataagattaacttagcttggtaccagacaaaaaccnggacagcctcctgagctgctctatttacgngggctaccgtacccgggatcgtcggggtccctgaccgtattcagttaggaagtcgggtctgggacagtatttcactctcaccatcagcagcctgcaggctagaagagtgtggctagtttactttcgtgtcagtactaattactttctacgttttcccgcttaccgtacgtttccgggacgggtaacggacccgtagggtcggagtacgttaacgaaaacggtacgttggtacggtccgtagacccaacgtacttaccgtcggttaccttcgtacc

SEQ ID NO: 188867 - DNA, 611 bp, Homo sapiens
  misc_feature: GYAE6OF02GO1DY.53.1.A01.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (487)..(487): a, c, t, g, unknown or other
  misc_feature (487)..(487): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtctcccgactccctggctgtgtctcgtgggcgagaggccaccatcaactgcaagtccagccatattttanacacctccaacaataagattaacttagcttaggtaccagacaaaaaccnggacagcctctgagctagctctatttacgngggtctccgtaaccgggaatcgtcgggtccctgaccgtattcagttaggaagcgggtctagggacagtactttcacgtctacacctatcaagcacgtccctagcgaggctaggaaagtagtggtacgcgttaagttttacttcgtagtactagtactaattcttacgtacgttttcccncttacgttacgtttccgggacgggtacggtacccgtagggtcggtacgacgttaaccgaaaacggttaacgtcggtacggtacgtacgacctaccgtacttacgtcggtttaccttactacccg

SEQ ID NO: 188868 - DNA, 594 bp, Homo sapiens
  misc_feature: GYAE6OF02IKRR0.53.1.A01.1.454.CMB.1.raw
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
tcagcgcgtatacacacgaccggtgctcgatttagacgtctcatcaggggggagctacaacaggcaggcaggggcagcaagatggtgttgcagacccaggtcttcatttctctgttgctctggatctctggtgcctggcggggacgtcgttttgacccagtctcccgactccctggctgtgtctctgggcgagagggccaccatcaactgcaagtccagccactattttacacacctccaaacaataagattaaacttagcttggtaccaagacaaaaaccaggacagcctcctgagctgctctatttacgngggctccgtaccgggaatcgtcggggtccctggaccgtattcagttggaacggcgggtctgggaacagtactttcacttctcaccatcgagcagccctgcgaggctagaagtagtgtcggtnttagttttattctgtccaagtacctaattacttacgttacgttttccgacttcgtacgtttaccgggcgggtaacggacccgtaagggtcggagtacgtaaccgaaaacggttacgtcggtaggtactacgacgtaactctcgtacgttactcgtaaccc

SEQ ID NO: 188869 - DNA, 681 bp, Homo sapiens
  misc_feature: GYAE6OF02HWSJH.53.1.A01.1.454.CMB.1.raw
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
tcagcgcgtatacacacgaccggtgctcgatttagacgtctcatcagggggagctaacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactatttanacacctacaacaataagattaacttagcttaggtaaccagaccaaaaaccgaggacacgcctcctganctgctctatttacgngggctacgtacccgggatcgtcggggtccctggaccgtattcgagttacggaaggcgggtctaggggactaggtatttaccacttcgtaccaacctatcgacgcacgtccgttacggaccgtagggccttagaaaggtacttggtcggtacttaaggtttttactttccgtagttctaacggtactaaacgtttcgtttaccgtaacggtttttcccgaccttccgttaacccggttttccggggaaccgggtacgggacccgtaagggcggtaacgtacgttaaccggaaaacggttacgttgggtaccggttcctacggtaccctaacccgtacgtttaccgtttcgtttacccgtttacttacccg

SEQ ID NO: 188870 - DNA, 611 bp, Homo sapiens
  misc_feature: GYAE6OF02IEFXP.53.1.A01.1.454.CMB.1.raw
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (496)..(496): a, c, t, g, unknown or other
  misc_feature (496)..(496): n is a, c, g, or t
tcagcgcgtatacacacgaccggtgctcgatttagacgtctcatcaggggggagctacaacaggcaggcaggggcagcaagatggtgttgcagacccaggtcttcatttctctgttgctctggatctctggtgcctggcggggacgttcgttttgacccagtctcccgactccctggctgtgtctcgtgggcgagacgggccaccatacaactgacaagtccagccactattttanaccacctacaacaaataagattaacttagcttaggtaccagaacaaaaaccaggaacacgcctctgacnctgctactatttacgcgggtcgtccgtaaccgggaattcggtcgggtccctgtaccgtattcagttggaacggtcgggtacgtaggacagtacttacacgtctacgacactcagcacgcctgcgaggtctagaagcgtggtgtacttagtttatttcgtgtacgagtactaattaccttctacgttttccncttacgttaccgttacgggacggtaccgggtaaccgagggtaggtacgaactaacgtaaacggtacgttgggtacgtctacggacctaccgtattcggttcttacctactacccg

SEQ ID NO: 188871 - DNA, 564 bp, Homo sapiens
  misc_feature: GYAE6OF02HB4QI.53.1.A01.1.454.CMB.1.raw
  modified_base (229)..(229): a, c, t, g, unknown or other
  misc_feature (229)..(229): n is a, c, g, or t
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagagggccaccatcaactgcaagtccagccactatttanacacctccaacaataagattaactagcttggtaccagacaaaaccnggacagcctctgagctgctcatttacgngggcctccgtaccgggaatcgtggggtccctgaccgtattcattggaagcgggtctgggacagtatttcacgtctacaccatcagtccacgcctagcgaggtctagaagtagtggtaggtcttaagttttatttcgtgtcagactaattacttctacgttttccacttcgtaccgtttcgggcgggtaacggacccgtgggtagacgtactacggaaacgtacgtggtacggctgaccgtacctagttcctgttcctactc

SEQ ID NO: 188872 - DNA, 697 bp, Homo sapiens
  misc_feature: GYAE6OF02H4DWY.53.1.A01.1.454.CMB.1.raw
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggccgggacgttcgttttgacccagtctcccgactccctggctgtgtctcgtgggcgagacgggccaccatcaactgacaagtccagccactattttanacacctacaacaataagtattaacttagcttaggtaccagacaaaaacnggacagcctctgagctcgctacatttacgcggtctaccgacccgggtaagttcgtcgggggtccctggtaaccgtattccgaagtttacggaacgggtcggggttacgtacgggggaactaggttaacttttccgaccttaccgtacctaaccctagtaccgaagtcccgaacggtcccgttcgaccgtaacggtccgttaagaacggtagttcggtacgggtacgtttagtttttatttcgttgtacctaagtactaaactttcgttaccgttaacgttttcccgtacttaccgttaccgtttacggggaccgggtaacggacccgtagggtacggtacgtacgttaaccgaaacggttaccgtggtacggctacggacccgtacctacgttcgttcttacccttactacccg

SEQ ID NO: 188873 - DNA, 589 bp, Homo sapiens
  misc_feature: GYAE6OF02IN3UO.53.1.A01.1.454.CMB.1.raw
  modified_base (228)..(228): a, c, t, g, unknown or other
  misc_feature (228)..(228): n is a, c, g, or t
  modified_base (344)..(344): a, c, t, g, unknown or other
  misc_feature (344)..(344): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccatattttanacacctccaacaataagattaacttagcttggtaccagacaaaaaccaggaccagcctacctgagctgacctctatttacgtgggtcgtccgtaccgggaactcgtacgggtcccngaccgattcgattggaacgcgggtctggggacagtactttcacttcgcacagtcagacagcctggcaggntagaancgtgtgctagtttnttcngtcatacaatcttgtactttccgcttcgtacgtttcgggcgggtaccggtacccgtaggggttagacgtaactaacccggaaacggtaccggttcggtcgggaccttaccgggacctaaccgtagttaccgtgttaccccttcgttaaccg

SEQ ID NO: 188874 - DNA, 603 bp, Homo sapiens
  misc_feature: GYAE6OF02F6MDA.53.1.A01.1.454.CMB.1.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccaactattttacacacctccaaacaataagattaacttagcttggtaccagacaaaaaccnggacagcctcctgagctgctctatttacgngggcgtcgtacccgggaatcgtcggggtccctggaccgtattcagttggaagtcgggtctgggacagtattcactcacaccatcagcagcctgcaggctagaagagtgtaggcttagtttacttcgtgtacagtacaagttacttcgttacgttttcccgcttacctacggtttccgggccgggtaacgggacccgtagggtacggtacgtacgtaccgtaaaacggtacgttcgggtacggtaccgtacggaccctaccgtaacgttaccttacggttacccttaccgtaccg

SEQ ID NO: 188875 - DNA, 689 bp, Homo sapiens
  misc_feature: GYAE6OF02GSJ62.53.1.A01.1.454.CMB.1.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggcccaccatcaactgcaagtccagccactattttanaccacctccaacaataagattaacttagcttggtaccagacaaaaaccaggacagccctctgagctgctcatttacgngggctaccgtacccgggaattccgtacggggtccctggaccgtatttcgacgtttaggaaggtccggggtctaggggacctagtacttttcacttctaccaccacttcagccagcccgtgccgaagggcttaggaagtagtggtcggtacttaggtttttaactttccgtacgttcgaagtaccttaacgttaccctttacgttacggtttttccccgactttaccgtttaccggttttaccggggaacccggggttaaccggaccccggtaaggggttcggggaacgttaacgttaaccgaaaaccgggttaacgttgggtaccgggtccgttaccgtaccgtaacccgttagttcccgtagtttcccgttataccccgg

SEQ ID NO: 188876 - DNA, 586 bp, Homo sapiens
  misc_feature: GYAE6OF02G37NF.53.1.A01.1.454.CMB.1.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccanattttanacacctccaacaataagattaacttagcttggtaccagacaaaaaccaggacagcctctgagctgctctattacnggctcgtaccggatcgtcgggccctgacctatcagttggaagtcgggtctgggacagtacttcgactctcactatcagcagcctgacgaggcgtagaaagtgtggtcggacttagtttactttctagtacagtacctaagttccttacgtacgttttcccgacttaccgttaccggtttccggggaccggtacgggtaaccctggggttacgacgtactaccgaaacggtaccgttgggcgtaccgtacgacctaacctagttcctagttaccctacttaccg

SEQ ID NO: 188877 - DNA, 593 bp, Homo sapiens
  misc_feature: GYAE6OF02HU1D9.53.1.A01.1.454.CMB.1.raw
  modified_base (234)..(234): a, c, t, g, unknown or other
  misc_feature (234)..(234): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (460)..(460): a, c, t, g, unknown or other
  misc_feature (460)..(460): n is a, c, g, or t
  modified_base (536)..(536): a, c, t, g, unknown or other
  misc_feature (536)..(536): n is a, c, g, or t
  modified_base (572)..(572): a, c, t, g, unknown or other
  misc_feature (572)..(572): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtctcccgactccctggctgtgtctcgtgggcgaggagggccaaccatcaaactgcaagtccagccactattttanaccacctccaaacaataaagattaacttagcttggtaaccaagacaaaaaaccaggacacgcctcctgagctgcctactatttacgnggggtcgtccgtaacccggggaatccgtcggggtccctgaccgnttcagttggaagtcgggtctagggctaggtatttccactctacaccatcagcacgctgcaggctaagaacgagtgtaggactagttttactttcngttcaagcctaaattctttacttagtttcccgacttcgtaaccgtttcgggacgggacggaccgtagggtgagtanaccggaaaagtacgtggtaggtactgacctaacgtnttacgtcgttacctctaaccg

SEQ ID NO: 188878 - DNA, 595 bp, Homo sapiens
  misc_feature: GYAE6OF02G4YBO.53.1.A01.1.454.CMB.1.raw
  modified_base (229)..(229): a, c, t, g, unknown or other
  misc_feature (229)..(229): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactcctggctgtgtctctgggcgaggagggccaccatcaactgcaagtccagccactattttanaccacctccaacaataagattaacttagcttggtaccagacaaaaaccaggacagcctcctgagctgctctatttacgtgggccgtccgtacccgggtaatcgtcggggtccctggaccgtattcagttggaaggcgggtctgggacagtnttcactctcaccatcagcacgcctagcgtaggctaggaangtggtgacttagttttattcgtgtacagtactaattaccgttcttacggttttcccgacttaccgttacgtttccgggaaccgggtacggtacccgtagggtcggaacgtacgtacgaaacggtacttgggtacgtacgtcgaccctaacgtacttcgtacgttccttactaccg

SEQ ID NO: 188879 - DNA, 622 bp, Homo sapiens
  misc_feature: GYAE6OF02IMDHK.53.1.A01.1.454.CMB.1.raw
  modified_base (234)..(234): a, c, t, g, unknown or other
  misc_feature (234)..(234): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtcctcccgacctccctggctgtgtctcgtgggcgagagggccaccatcaactgcaagtccagccactattttanaccacctaccaacaataagtattaacttagtcttaggtaccagacaaaaacaggacagcctctgacgctgctctatttacgtggcctccgtaccgggaatccgtcgggtccctgaccgtattcagttacggaaggtcggtactagggacagtactttccacttctaccgaaccatacgacggccacgccctacggcgtaggtcctaggaacgtagtcggtaggtacgttaagtttattttcgtcgtacctagtactaacgttacttaccgttacgtttaccgtaccttaccttacgtttccgggacgggtacggacccgtaggcggagtacgtacgaaacggtactggtacgtcgtacgccaccgtacgttctacgttcttactaccg

SEQ ID NO: 188880 - DNA, 834 bp, Homo sapiens
  misc_feature: GYAE6OF02JYBPW.53.1.A01.1.454.CMB.1.raw
tcagcgcgtatacacacgaccggtgctcgatttagacgtctcatcagggggagctacaacaggcaggcaggggcagcaagatggtgttgcagaccaggtcttctattctctgttgctctgatctctggtgcctggccgggacgttcgttttcgacccagtcctcccgactccctggcctgtcgtctcgtgggacaggaggcccacgatcaactgcaagtccagccatattttacaccaccctacccaaagtaaataacgtatttaaaaccgtatacgttacggtaaccaagtaaccaaaaaccgaggaaccacgtaccctaccgttaggaccgtcgtacgtacctacttaacgttttaccgtacggggtccgttaaccccggttaacccggggtaaacgttccggttacgggggttaccccgtcggtaaccggtacttacgtaggttacgggaacggtccggggttacgtcgggtaacgtaagttacgttttaccgaaccgtttcctaccgaaacccttcgtaaccgtaaggccctaacgggtccctggaccacggggtaccttaagggaacgtaacggttgggtaccggttaacgttcctttttaaaggtttccgtaaggttaccaaacggttctaaactttaccgttacttttaccggtttaccctaccgggttacttaccgggtttccgggggaaaccggtacccgggaaacccgggtttggttaaacggggtccgtaacttaaaccggtaaaacccgggtatttccgggaagggttaccccgtaggtacccctacggttaacttcgtttaaccgttctaacccgtttcgg

SEQ ID NO: 188881 - DNA, 850 bp, Homo sapiens
  misc_feature: GYAE6OF02J3BKQ.53.1.A01.1.454.CMB.1.raw
  modified_base (293)..(293): a, c, t, g, unknown or other
  misc_feature (293)..(293): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggtacgttcgttttcgacccagtcctcccgactccctggctgtcgtctcgtgggcgagacgggccacatcaactgacaagtccagccatattttacaccacctaccaaacaactaagtatttaacttaggcttaggtaccaagacaaaaaccgnggaaccacgcccttcctaggacgtcctacgcttacctaagttttaccgcggggttaccgtaccgtaaccccggggtaaattcccgggttcgggggttacccccctaggtaaccccggttagtttaccgtaacggtttacggggaaccggggttcccggggttaccgtagggggtaaacctacgggtttaacttttaccccgaactttcccgtacccgaaccccgtaacgtttacccgaacggttaccgaaccggtccccgtagggaacccgtaacgggtaccttaagggaaaacggttacgtttcggggtaccggtacgttttaacgtttttacctttacggtacggtaacctacggaaccctttaactttaacccggtttaccgtaccggtttttcccgccgttacgttaacccggtttaccggggacgggtaaacccgggtaaccgtaggggttaaccggaatacccgttaaaccggtaaacggttaacggtcgggtaaccggccgtaacgtaccgtaccgttagttcccttacgtttaccgtaaccgttacccg

SEQ ID NO: 188882 - DNA, 559 bp, Homo sapiens
  misc_feature: GYAE6OF02IECXB.53.1.A01.1.454.CMB.1.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
tcagcgcgtatacacacgaccggtgctcgatttagacgtctcatcagggggagctacaacaggcaggcagggcagcaagatggtgttgcagacccaggtcttcatttctctgttgctctggatctctggtgcctgcgggacgtcgttttgacccagtctcccgactccctggctgtgtctctgggcgagaggccaccatcaactgcaagtccagccactattttanacacctccaacaataagattaacttagcttggtaccagacaaaaaccnggacagcctcctgagctcgctcatttaccgtgggccgtcgtacccgggaatcgtacggggtccctgaccgtattcagttggaacgcgggtcngggacagtatttcactctacaccatccagcacgccctgcagctagaagntgtggacttagtttattactgtcagacattacttcgtacgttttcncttcgttacgttccggcggacggtacccgtagggtgacgtacgtacgaacgtaacgttggtcgacgtcgccaacctcgttcgtcgttacctcctaccg

SEQ ID NO: 188883 - DNA, 580 bp, Homo sapiens
  misc_feature: GYAE6OF02JGOTX.53.1.A01.1.454.CMB.1.raw
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccaccatcaactgcaagtccagccatattttacacacctccaaacaataagattaacttagcttggtaccagacaaaaaccngacagcctcngagctgctctatttacgngggcgtccgtaccgggaatccgtcgggtccctgaccgattcattaggaagcgggtacgtggacngtacttcactctacactatcagcacgtctgcgaggctagagtacgtggtcgtacgttagttttacttcgtgtacgacgtataactttcttacgtacgtttccgaccttacgttacgttcgggaccggtacgggaccgtagggtacgacaacgtaccgtaaacggtcgttggtacggtactacggacctacgtattcgtacgttctacctccg

SEQ ID NO: 188884 - DNA, 560 bp, Homo sapiens
  misc_feature: GYAE6OF02ISZX9.53.1.A01.1.454.CMB.1.raw
  modified_base (231)..(231): a, c, t, g, unknown or other
  misc_feature (231)..(231): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagcgcgtatacacacgaccggtgctcgatttagacgtctcatcaggggggagctacaacaggcaggcaggggcagcaagatggtgttgcagacccaggtcttcatttctctgttgctctggatctctggtgcctggcggggacgtcgttttgacccagtctcccgactccctggctgtgtctctgggcgagagggccaccgatcaactgcaagtccagccacattttanacacctcaaacaataagattaacttagcttggtaccagaccaaaaaaccaggacagcctcctgagctgctctatttacgtggggccgtacgtaacccgggaatcgtcggggtccctggaccgattcagttggaaagtcggggtntcgggactagatttcactctcacatcagcagcctgcaggctgaaacgntgtgactagttttacttngtacagactaatacttctagttttccgacttctacgttcgggacggacgggaaccagggtgacgtatacgaaaacgtactggtggaccttagctaaccgctacgtagttcctcgtaacc

SEQ ID NO: 188885 - DNA, 772 bp, Homo sapiens
  misc_feature: GYAE6OF02JUJAH.53.1.A01.1.454.CMB.1.raw
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtcctcccgacctccctggctgtgtctcgtggcgagaggccaccatcaactgcaagtccagccatattttacacacctccaacaataagtattaactagcttaggtacagtacaaaacngacagcctctagacnctcgctctattacgtgggctaccgtaaccggatcgtcggggtaccctggacctatctagtacggacggtccggtacgtacggggtaacacggttactttaccgaccgttaccctaccgtaaaccctacgtttaaccgaacgtacccgtaaccggtccccgtacggtaccggttaaaccgggtcgttaaacgggaaaacggtaagttacggggttaccggttacgttaacggtttttaattttccgttacggttacgtacgtaaaccttaacgttacctttaccggtttaaccgtttcccgttaccgtttacgttcccggtttaccgggaccggggtaaccggtaacccgggttaacgggtacggtaacgtacgtaaacccggtaaaaccggttaccgttacgggtaccggttaccggttacggtaccccgttaaaccggttccttaccggttttacggttaccctttacccgttaacccgg

SEQ ID NO: 188886 - DNA, 685 bp, Homo sapiens
  misc_feature: GYAE6OF02IBUOY.53.1.A01.1.454.CMB.1.raw
  modified_base (237)..(237): a, c, t, g, unknown or other
  misc_feature (237)..(237): n is a, c, g, or t
  modified_base (330)..(330): a, c, t, g, unknown or other
  misc_feature (330)..(330): n is a, c, g, or t
  modified_base (424)..(424): a, c, t, g, unknown or other
  misc_feature (424)..(424): n is a, c, g, or t
tcagcgcgtatacacacgaccggtgctcgatttagacgtctcatcagggggagctacaacaggcaggcagggggcagcaagatggtgttgcagacccaggtcttcatttctctgttgctctggatctctggtgcctggcggggacgttcgttttgacccagtcctcccgactccctggctgtgtctcgtgggcgaggagggcccaccatccaactgacaagtccagccatattttanaccacctaccaacaataagattaaccttagtcttcggtaaccagaccaaaaaccaggacacgcctcgtagagtctcgcttactacgtttacgngggtccgtccgtaaccgggtacttccggtcggggtccctacggaccgtattcctagttacggaacggtcgggtacgtagggacagttacttacncctactaccacctactacgacgcacgtccctggcgaggtcgtaggaagtagtcggtaggtacgtttaagtttacttttcgtacgtacgagtacctaatttaccgtttccgtacggttttccgacctttaccgttccggtttaccggggaccgggtaaccgggtacccggttagggtacgtacggtaacgtaccggtaaacggaaccgttgggtaccggtcgtacgaccgtacctacgttaccgtcgtttaccctactaccc

SEQ ID NO: 188887 - DNA, 699 bp, Homo sapiens
  misc_feature: GYAE6OF02FHFO2.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcgggacgttcgtttgacccagtctcccgactccctggctgtgtctcgtgggcgagacgggccaccatcaactgcaacgtccagccactatttacacacctaccaaacaactaagacttaacttagcttaggtaccagtaccaaaaaccaggacacgccctccgtgactctgctacatttacgcggcgtctaaccgggatccgtggggtcccctgacccgtattcgagttcggaaggtcgggtctacggggacaaggtactttcacttcgtaccaccgtatccagccagtcctggacaggtctaggaaacgtagttacgggtcggaccttaaggttttaactttcgtacgttaccaagtaacctaacgtttacccgttacggtaaccgtttttcccgacgttaccgttaaccggttttaccggggaccggtaaaccggggtccccgtaaagggttcgggaacgttaaccgtacccgtaaaaaccggtaccgttacgggtaccggtaccgttacgaaccgtaacccgtaacgtttccgtacgtttacccgttaccgttaaccccg

SEQ ID NO: 188888 - DNA, 671 bp, Homo sapiens
  misc_feature: GYAE6OF02GVEDJ.53.1.A01.1.454.CMB.1.raw
  modified_base (228)..(228): a, c, t, g, unknown or other
  misc_feature (228)..(228): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccatattttanaccacctaccaacaataagtattaacttagcttggtaccagacaaaaaccaggacagcctcctgacgctgctctatttacgtgggcgtaccgtacccgggatccgtcggggtcccctggaccgtattacgagttcggaacggtccggggttactaggggactagtactttaccacgtcctccaaccctatccacgcacgccctggccgaggtctagaaagtagtggtcggacttagttttactttcgtgtacgtagtactaattacgtttccgttaacggttttcccgacctttaccgttaccggttttaccggggaccggggtaaccgggtaccccgtaagggggttacgtacgtacgtaacccgtaaaacggtaaccgttgggtaccggtcctacggtaccctaaccgttacttcccgttacgtttcccgttacttacccg

SEQ ID NO: 188889 - DNA, 595 bp, Homo sapiens
  misc_feature: GYAE6OF02IDGBW.53.1.A01.1.454.CMB.1.raw
  modified_base (229)..(229): a, c, t, g, unknown or other
  misc_feature (229)..(229): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (588)..(588): a, c, t, g, unknown or other
  misc_feature (588)..(588): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactattttanaccacctccaacaataagattaacttagcttggtaccagacaaaaaccaggacagcctctgagctgctctatttactgggcgtactacccgggaatccgtcggggtccctgaccgtattcagttaggacgtcgggtctgggactagtattcactctcaccatcagcagcctgcagctagaagntgngtactagtttactttcgtagtcagtactaaattacttcgtacgttttcccgacgttactacgtttcgggaccggtacgggacccgtagggttaggacgtaacttaacgaaaaccggtaacgttcgggtcggtaccgttaggaccctaaccgtagttccgttcgttacccgttntaacccg

SEQ ID NO: 188890 - DNA, 667 bp, Homo sapiens
  misc_feature: GYAE6OF02HMNM5.53.1.A01.1.454.CMB.1.raw
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagacgggccaccatcaactgacaagtccagccactattttacaccacctaccaaacaataagtaattaacttagcttaggtaaccaagaccaaaaaaccaggaaccacgccctccgtgacgctgcctctacgtttacgcgggtcctaccgtaccgggtaattcggtcgggtccctaggacccgtnttacagttaggaacggtcgggtcgtggacagtacttcactctaccacancacgcgacnccgtgacgacggcgttaagaacgtgttcggtacggtctttaacggttttatttccgtacgttacaacgtacttaactttactttcgttacgttttccgccttacgttaccgttcgggacggaacggtcccgtagggttacggacgtaacgttaaccgtaaacggtacgttaggacggttccgtacggtaccctaaccgcgtttacccgtttcgtttacccgtaccctttacccg

SEQ ID NO: 188891 - DNA, 779 bp, Homo sapiens
  misc_feature: GYAE6OF02HP3SA.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgtcgttttgacccagtcctcccgactccctggctgtgtctcgtgggcgagaggccaccatcaactgacaagtccagccatatttatacacctaccaacaaataagtattaaacttagacttaggtaaccaagaaccaaaaaaaccgagggaacaagccctacctaggaacgccttaggccttactaagttttaaccgtggggtccgttaccgtaaccccggggaaattccgtacgggggtcccctacggtaacccgtaattaccgaagtttcgggaaacggtccggggttacgtacggggaacctaggtacttttcaaccgttcctacccaaccgtaatccgaacggacctaacgtcccgttacggaccgtagggtacctagggtaaaaggtaacgttacgggtacggtacgttaaagtttttacgttttcgtacgttacaacgtacttaaacgttactttaccgttaacgtttttcccgaccgtttaccgtaccgttttaccggggaccgggtaaacggtaacccgtaaggggtacggtaacggtaaccttaaccggaaaacggttaaccgttaggtaccgggtacttacgaccgtaaacctcgtttaccttcggtttaccgttacttaacccg

SEQ ID NO: 188892 - DNA, 589 bp, Homo sapiens
  misc_feature: GYAE6OF02INQQ6.53.1.A01.1.454.CMB.1.raw
  modified_base (227)..(227): a, c, t, g, unknown or other
  misc_feature (227)..(227): n is a, c, g, or t
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactcctggctgtgtctctgggcgagaggccaccatcaactgcaagtccagccactattttanacacctccaaacaataagattaacttagcttaggtaccagacaaaaaccaggacagcctcctgagctgctactatttacgtgggctacgtacccgggaatcgtcggggtccctggaccgtattacagttggaacgtcgggtctgggacagtatttcactctcaaccatcagcacgcctgcgaggctagaaagntgtggctagttttattctagtcagtactaaattacttctacgttttcccgnttacgtacgtttcgggaccggtacgggacccgtagggtggacgtaacgtaacgaaaccggtaacgttggtcggtcctagaacccgacctaaggtcctacgtttccgttaccttacccg

SEQ ID NO: 188893 - DNA, 587 bp, Homo sapiens
  misc_feature: GYAE6OF02GZ39T.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttacaccacctccaacaataagattaacttagcttaggtaccagacaaaaaccaggacagcctctgagctgctcatttacgtgggcgtcgtaccgggaatcgtcgggtccctgaccgattcagttggaacgtcgggtcgtgggacagtatttcactctcacctatcagcagcctgacgaggctagaagtcgtggtacggtcttagttttacttcgtgtcacgtactaattcttcgtacgttttccacttcgtaccgtttcgggacggtaccggaccgtagggtacgacgtacgtaccgaaacggtacgtggtacggtactacggacctaccgtacgttaccgttcgttaccgttactacccg

SEQ ID NO: 188894 - DNA, 701 bp, Homo sapiens
  misc_feature: GYAE6OF02H59WG.53.1.A01.1.454.CMB.1.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagagggccaccatcaactgcaagtccagccactatttanaccacctccaacaataagattaacttagcttggtaccagacaaaaacnggacagcctctgagctgctctatttacgngggcgttctaaccggtacgtacgtcgggtcccgtccgacgtacgtactacgttaggtacggacgggtcggtcggtacggacgtagttacctacgtactcgacctactacgtacgacgcgaccgtcgcgacggcgtagaaacgagttcggttacggtcgttaagttttacgttttacttcgtaccgtaacgtacgtaaaccttaacgttttaccttaaccggttttacccgtccgttaccgttacccgttttacggggtccggggaaccgggtaacccggtagggttacgggtacgaacgttaacggaaaaccgtaaccggttacgggttacgggtaccttacgtaccgtaacccgtaccgttaccgtttacggtttacccttacctttaacccgg

SEQ ID NO: 188895 - DNA, 904 bp, Homo sapiens
  misc_feature: GYAE6OF02JY3E8.53.1.A01.1.454.CMB.1.raw
  modified_base (236)..(236): a, c, t, g, unknown or other
  misc_feature (236)..(236): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttgacccagtcctcccgactccctggctgtgtctcgtgggcgaggagggccaccagtcaacgtgacaacgtccagccactatttanaccacctaccaaacaataagaacttaacttacgacgtttacggtaccaagtaaccaaaaaaccgaggaaccaacggtacccttacccgtaggagtaccgttacggaccttacgttaacttttaaccgtcgggggttacccgttaacccgggttaacccccggggtaaagtttacccgggttcggggggttaccccccgttacgggttaaccccggttaatttacccggtaaggttttacggggaaaacggggttcccggggggtttacgtttaacggggggaaaccgtacggtttaacggttttacctaaacccgtttcctaccctaaaacccgtcgttaacccgacggtacgaaaccggtcccgttaggaccggaacgggttcgtaaggtaaaccgtagttacgggtaacgttacggtttacgtttttaacggtttccgttaggttaaccgaacgttaaccgttaaaccgttaactttttaccggtttaaccgtttttacccgtaccgtttaaccgttaccggggttttaccgggaaccggggttaaaccggggaacccggttaccggggtaggtaaccgtacgtaaacggtaaacggtacgttacgggtcggtaccgtcggtaaccgtaccgtaacggtttccgtcggttaccgttacttacccgg

SEQ ID NO: 188896 - DNA, 604 bp, Homo sapiens
  misc_feature: GYAE6OF02G9UWG.53.1.A01.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (413)..(413): a, c, t, g, unknown or other
  misc_feature (413)..(413): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttacaccacctccaaacaataagattaacttagcttggtaccagacaaaaaccnggacagcctctgagctgctcatttacgngggctcgtaccgggatcgtcgggtccctgaccgtattcagttggaagtcgggtcgtagggacagtatttcactctacacctatcacgcagcctgcaggctagaagntggtcgcttagttttacttcgtcgtacagtactaattcttacgtaccgttttccgacgttcctacggttttccgggaccgggtaaccggtacccgtagggtacggacgtactaaccggtaaaacgtaccgttgggtacggtaccgttacgaccgtaaccgtacgttaccgttcgtttaccttacctaaccg

SEQ ID NO: 188897 - DNA, 704 bp, Homo sapiens
  misc_feature: GYAE6OF02GTGMZ.53.1.A01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtcctcccgactcctggctgtgtctctgggcgagagggtccaccagtcaactgacaacgtccagccatatttanaccacctcaaanaataagacttaacttagcgttagtaccagaccaaaaaccnggacacgcctcctgacnctgctntattacgnggctacgtaccggatcgtcggggtcctagaccgtattcgagtttaggaacggtccggggtacgtcgggaactacgtacgttttccacttctaccgaaccctaattccgaacggtacctacggtccccgtaggaccgtaaacgggtccgttaaaggaaaggtacgttgggtacgggtactttaacggtttttacgtttccgttaggttacaacggttaccttaaactttaccgttttccggttaacgtttttcccgacgtttaccgttacggttttaccgggacggggtaaccggtaacccggtagggttacggacgtataaccggaaacgttaccgttagggtcggtactacgacctaccgtagttcgttacgttaccgttacctacccg

SEQ ID NO: 188898 - DNA, 543 bp, Homo sapiens
  misc_feature: GYAE6OF02F2Z7V.53.1.A01.1.454.CMB.1.raw
  modified_base (227)..(227): a, c, t, g, unknown or other
  misc_feature (227)..(227): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccacatcaactgcaagtccagccactattttanacacctccaacaataagattaacttagcttggtaccagacaaaaaccaggacagcctcctgagctgctctatttacgtcgggctctacccgggaatcgtcggggtccctgaccgtattcagttggaagcgggtctgggacagtatttcactctcaccatcagcacgtcctgcaggctggaagtgtgtggcttagttttatctgtcagtactaattcttcgtacgtttcccgcttctacgtttcgggacggacggtaccagggtacgagtactacgaaacggtacttggtcgctacgcacctgtcctgttctctacg

SEQ ID NO: 188899 - DNA, 757 bp, Homo sapiens
  misc_feature: GYAE6OF02G5H69.53.1.A01.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttanaccacctccaaacaataagattaacttagcttggtaccagacaaaaaccngacagcctcctgagctgctacatttacgcgggcgtacgtacccgggaattcgtggggtccctggacccgtattcgattcgggaaggtccggggttacgtaggggacctaagggtacttttaccgaacctttccgtacctaacccgtaacgtccgaacgaccgtaacggtcccttagggaccaacggggtccttaaggaaacggtacgttacgggtacgggtacctttaacgggttttttaacttttaccgttacggttaccagggtaacctaaacgtttaccgttttacccgttaacggttttttccccgcgtttaccctttaaccgggttttcccggggaaccggggtacgggtaaaccccgttaggggtacgggtaacgtccgttaaaccggtaaaacggtaccgttagggtaccgggttacctaggaccctaacccggttatttacccggtcgttttacccgttacgttaccccg

SEQ ID NO: 188900 - DNA, 601 bp, Homo sapiens
  misc_feature: GYAE6OF02FGLES.53.1.A01.1.454.CMB.1.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccacatcaactgcaagtccagccacatttanacacctccaacaataagattaacttagcttggtacagacaaaaaccaggacagcctcctgagctgctcatttacnggcgtctaccgggaatcgtgggtccctgaccgtattcattggaagtcgggtctgggacagtactttcacgtctcacatcagcacgctgcaggctagaagtatggtggacttagtttacttcgtagtcagtctaagttacttcgtagtttccgattccgtacgtttcgggaccggtacgggacccgtagggttacggagtaacgtaaccgtaaaccggtaacggttggtaccgggtaccgttacggtaacccgtaacccgttaacgttcccgtttacggttaccgtttacccgttaacccg

SEQ ID NO: 188901 - DNA, 679 bp, Homo sapiens
  misc_feature: GYAE6OF02JXR0U.53.1.A01.1.454.CMB.1.raw
  modified_base (230)..(230): a, c, t, g, unknown or other
  misc_feature (230)..(230): n is a, c, g, or t
  modified_base (316)..(316): a, c, t, g, unknown or other
  misc_feature (316)..(316): n is a, c, g, or t
  modified_base (643)..(643): a, c, t, g, unknown or other
  misc_feature (643)..(643): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtctcccgactccctggctgtgtctctgggcgaggaggccaccatcaactgcaagtccagccactattttanaccacctccaaacaaataagattaacttaggcttaggtaccagacaaaaaccaggacagcctcctagacgctgctcgtatttacgngggcctactaacccgggaattccgtcggggtcccctaggaccgtacttacagttacggaaggtccggggttctaggggtaacacggtacgtttaccacgtcttcccaaccgtatccgtagccgtaacgcccgttagccaagggtccctaagggaaacggtacgttggtacgggtactttaaggttttactttccgttacgtacgacgtacttaaacgttactttaccgttaacgtttcccgtattacccgttaacgtttccggggacgggtaaccgggtacccaagggttcgacggtaactaccggaaagtaaccggtggtaaccgngtacgtaccacgtaatccgtacgttctaacccgtcg

SEQ ID NO: 188902 - DNA, 797 bp, Homo sapiens
  misc_feature: GYAE6OF02INDO8.53.1.A01.1.454.CMB.1.raw
tcagcgcgtatacacacgaccggtgctcgatttagacgtctcatcaaaggaaggaagggcacgaccggtgctcgatttagacgtctcatcaaggaaggaaggggtgggtccaggaggcagaactctgggtgtctcaccatggcctggatccctctacttcctccccctctcactctctgcacaggctctgacggcctcctatgagctagacacagtcaccgtcggtctctgtgtcctcgaggaccaggaccgcaaggactcacctgctctggacgatcgctattgaaccaaaaataagtatcgtactttaacgtcggtaaccgaagaccgaaggcggacccgacggtacccgaacgggtccccttggttacgttagggttaacgttaacgttttaaacgtaaaacgttaccgttttaggaacggtaacggtccccgttaacgaaccgggtaaccccgtggaccggtaccgtttaacgtttcgtaccggttacggacccttaccgaacgtcccgtaaccgggtaacgggaaacctaaacgaaccggttaccaaacccgtttacgaaccccttaagttaccgaaacggtcgggtaaaccgttcccgggaaccggaagggtacggggaaccggagggtaccttacggtaacctttaaacgtttaaccggttcggttaccgaccgttaccggaacggtaacggaacccggtaacgggttaccgaacggggttcggtaaccgttaacgggttttaagtttaacccgggtacgggtttaacggttaccccgggggaacggggg

SEQ ID NO: 188903 - DNA, 638 bp, Homo sapiens
  misc_feature: GYAE6OF02G5IIV.53.1.A01.1.454.CMB.1.raw
  modified_base (310)..(310): a, c, t, g, unknown or other
  misc_feature (310)..(310): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtctcccgactccctggctgtgtctctgggcgagagggctaccatcaactgcaagtccagccactattttacaccacctccaaacaataagattaacttagcttggtaccagacaaaaaccaggacagcctcctagagctgctcatttacgnggctactaccgggaatcgtcgggtccctgaccgtattcgagttaggaaggtccgggtgtacgggactagtacttttcacttccgtaccaacctagtcgaacgtccaacgtccctggccgaagggtctaacggaaagtacgttacggtcgggtaccttaagtttttaactttcgttacgtacgacgtacctaatttaacgttccgttaacgttttcccgcttaccgttaccgtttcgggaccgggtacggtaacccggtaggtacggagtacgtaccgaaacgtacgtggtacgtctcgacctaccgagttcgtcgttctacgtacccg

SEQ ID NO: 188904 - DNA, 649 bp, Homo sapiens
  misc_feature: GYAE6OF02HTI0P.53.1.A01.1.454.CMB.1.raw
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagagggccaccgatcaactgcaagtccagccactatttanaccacctcaacaataagattaacttagcttggtaccagacaaaaaccngacagcctctgagctgctctatttacgngggtcgtacgtacccgggtaattccggtacggggttccctcggaccgtacttcgagttacgggaacggtcggggttcgtacggggacctaaggtacttttaccgactccttaccgaacctataccgagaccacggccctaggcagggctaggaaagtacgtggtcggtactagttttacttcgtgtacacgtactacttacttccttagttttcccgactcgttacgttcggaccgggtacggtacccgtgggtacggtacgtaacgtaaccggaaacgttacggttacggtcggaccttcggacctaaccttcgtttaccgttaggttaccctttctaccgg

SEQ ID NO: 188905 - DNA, 555 bp, Homo sapiens
  misc_feature: GYAE6OF02G5MW4.53.1.A01.1.454.CMB.1.raw
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
  modified_base (529)..(529): a, c, t, g, unknown or other
  misc_feature (529)..(529): n is a, c, g, or t
tcagcgcgtatacacacgaccggtgctcgatttagacgtctcatcagggggagctacaacaggcaggcagggcagcaagatggtgttgcagacccaggtcttcatttctctgttgctctggatctctggtgcctgcggggacgtcgttttgacccagtctcccgactccctggctgtgtctcgtgggcagaggccacatcaactgcaagtccagccatatttanacacctacaacaataagattaactagcttggtaccagacaaaaaccnggacagcctcnganctgctcattacgnggctctaccgggatcgtgggtcctgaccgtatcagttggaagcgggtctgggactagactttcactctacaccatcagcagccctgcnggctgaagntggtgcttagtttattcgntccagtcaagttctcgtacgtttccgnttccgtacgtttcggcgggtacggacccgagggtcgacgtacgtaaccgtaaacggtactgggtacgtaccgttacgacctaaccgtnttaccgttgttacccttacgtacccg

SEQ ID NO: 188906 - DNA, 592 bp, Homo sapiens
  misc_feature: GYAE6OF02I7PY0.53.1.A01.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (375)..(375): a, c, t, g, unknown or other
  misc_feature (375)..(375): n is a, c, g, or t
  modified_base (490)..(490): a, c, t, g, unknown or other
  misc_feature (490)..(490): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtctcccgactccctggctgtgtctctgggcgagngggccaccatcaactgcaagtccagccatattttanaccacctccaaacaataagattaacttagcttggtaccagacaaaaaccnggacacgcctctgagctgctctatttacgtcgggcgtccgtaaccgggtaatcgtcggggtccctggaccgtattcacgttggaacgcggggttcngggactagtacttctactctcaccatccagtcacgtcctgaccaggtctacgaaaggtgttggtacggtcttagttttacttctgacgtatacaacttcgtttctacgttttccncgttacttacggtttcgggaccgggtacggtaacccgtaggtcgagtacgtaaccgaacggtacttggcgtcacggtacaccgtatcgtactttctctaccg

SEQ ID NO: 188907 - DNA, 617 bp, Homo sapiens
  misc_feature: GYAE6OF02GPONM.53.1.A01.1.454.CMB.1.raw
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccacatcaactgcaagtccagccatattttanacacctccaaacaataagattaacttagcttggtaccagacaaaaaccaggacagcctctganctgctctatttacgtgggcgtcgtacccgggaatccgtcggggtccctgaccgattcagttggaagtcgggtactgggacagtatttcactctcacctatcagcacgcctggcaggtctaggaagtagtggtggtacttaggttttacttcgttgtactacgtacctaaatttcctttacgttaccgttttcccgagttccgttaccggtttccgggaccgggtaaccgggtaacccgtagggtacgggtagtaaccgtaaccgtaaacggtaaccgttggtacggtccgtacgacccacgttaagtccgttagttccttactacccg

SEQ ID NO: 188908 - DNA, 626 bp, Homo sapiens
  misc_feature: GYAE6OF02GQF8R.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgcaagtccagccactatttacacacctccaaacaataagattaacttagtcttggtaccagacaaaaaccaggacagcctcctgagctgctcatttaccgtgggcgtccgtacccgggaattcgtcggggtccctgaccgtattcagttggaaggtcgggtcgtaggggacaagtactttcactctaccacctatcagcagccctgcagggctaggaaagtagtggtacggtcttaggttttactttccgtgttacgagtactaaacgttccttacgttaccgtttttcccgacttaccgttacggttttccgggaccgggtaacgggtacccgtaggggtacggaggtacgttaaccgaaaacggtaacgttcgggtaggcttcggacctaccgtattccgttcgttaccttctaccg

SEQ ID NO: 188909 - DNA, 728 bp, Homo sapiens
  misc_feature: GYAE6OF02GKAP7.53.1.A01.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (569)..(569): a, c, t, g, unknown or other
  misc_feature (569)..(569): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcgggtacgtcgttttgacccagtctcccgatccctggctgtgtctctgggcgagacgggccacatcaactgcaagtccagccatattttanaccacctaccaaanaataagattaacttagcttggtaccagacaaaaaccnggacacgcctccngagctgctctattacgngggcctacgtaccgggaatcgtacggggtccctagacccgtattcgagtttaggaacgggtccgggttcgtacgggaactaaggttacttttccgaaaccgtttcgttacccaacccgtagtaccgacgtaccgtaacggtccttacggaccgaggtccgttaagaaggttcgtaggtacggacgtttaaggttttaacgtttccgttaggtaaccgtacgtaccttaaacgtttcttaaccgttacggtttttaccccgngtttaaccctaacgggttttaccgggacgggttaaccggtaacccggtaggggttacgtaacgtaaccgttaaccggtaaaaaccggttctttacggggtacggtaccttacggtaacccgtacttaccgttacgtttcggtttcccttacgttacccg

SEQ ID NO: 188910 - DNA, 613 bp, Homo sapiens
  misc_feature: GYAE6OF02I211V.53.1.A01.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgtttgacccagtcctcccgactccctggctgtgtctctgggcgagacgggccaccatcaactgcaagtccagccactatttanaccacctaccaacaataanattaacttagcttaggaccagacaaaaccagaccacgcctccgtgagctgcctactatttacgtcgggtccgttaccgtacccgggtatccggtcggggtcccctgaccgtattcgagttaggaacgtcggggtcgtagggactagtactttccactctccacatcagccagcctgacgagctagagtatggtagtccttagttttacttctggtactacgtactaattccttacgttacgtttcccgctttacgtaccggtttccggggaccggtaccgggtacccgtagggtcggacgtaactaacgaaacggtactgggtacggtctacgcctaacgtatcgtacgtttaccttgtacccg

SEQ ID NO: 188911 - DNA, 674 bp, Homo sapiens
  misc_feature: GYAE6OF02F0M12.53.1.A01.1.454.CMB.1.raw
  modified_base (156)..(156): a, c, t, g, unknown or other
  misc_feature (156)..(156): n is a, c, g, or t
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
tcagcgcgtatacacacgaccggtgctcgatttagacgtctcatcaagggaagggaagggcacgaccggtgctcgatttagacgtctcatcaaaggaaggaagggggtggtccaggaggcagaactctgggtgtctcaccatggcctggatccctntacttctccccctctcactctctgcacaggctctgacggcctctatgagctgacacagtccacccgtggtgtctagtcgtccngaggacaggaccggcctaggactcacctgctcgtggactatgctattcgaaccaaaacaatntcgccttagtacggaccagccaggacgccgaggaccncggcccctgttacgttggtactaatttacgaaacgttntttacggaacggcggtaccctcggaaccggggtacccctaggacgtcgtacttcgtcgtcggtcctccgagtccgttacgaacggtaaccaagtacgtcctaacctttacgaccttactcgacggttcggaccggtaccggcccgaagggtacgggaaccggtacgacgttaacggtaaccttacggtttaacgtaggtaccttacgggtcccgaacgttaaggaaccggtaccgtggtaacggtccggtacgttacggtttaacgtggtttaccggttacggtaccggggtaacggg

SEQ ID NO: 188912 - DNA, 656 bp, Homo sapiens
  misc_feature: GYAE6OF02GKS4B.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttgacccagtctcccgactccctggctgtgtctcgtgggcgaggacgggccaccatcaactgcaagtccagccactatttacaccacctaccaaacaaataagtaattaacttagtacttacggtaccagaaccaaaaaaccgaggaacacgtccctctagacgctgcctctatttacgcgggtaccgtaccgtaacccgggatccggtcgggggtaccctggtaccgtattcgtagttcggaacggtcggggtcgtagggactaggtactttcacttctaccaactactcagccgacgtcctgacgtaggtactaaggaagtacgtggtcggtacttaggttttactttcgttcgtacacgtactaacgtttaccttcgttacggttttacctcttaccgttacggtttccgggaccggtacggtaccgtgggtacggagtacgtaaccgaaacggtacgtggtacggtctacggacctacgtattcgtacgttcttacgtacc

SEQ ID NO: 188913 - DNA, 619 bp, Homo sapiens
  misc_feature: GYAE6OF02GUZ08.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtcctcccgactccctggctgtgtctctgggcgagagggccaccatcaactgacaagtccagccactattttacaccacctaccaaacaataagattaactagcttggtacagacaaaaaccaggacacgcctctagagctgctactatttacgtgggcctaccgtaccgggatcgtacggggtccctagaccgtattcagttaggaacggtcgggtactcgggaactagtactttcacttcacaacatcagcagcctagacaggtctagaagtgtgacggtacttagttttacttctggttacaacgtactaaacttcctttacgtaaccgtttttccgacttacgtacggtttaccggggaacggtaaccgggacccgtagggtagggtaacacgttaacgaaacggtacgttacggtacggtactacgacctacgtatcgtacggttacctactaccg

SEQ ID NO: 188914 - DNA, 706 bp, Homo sapiens
  misc_feature: GYAE6OF02G3V0U.53.1.A01.1.454.CMB.1.raw
  modified_base (321)..(321): a, c, t, g, unknown or other
  misc_feature (321)..(321): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttgacccagtcctcccgactccctggctgtgtctcgtgggcgaggaggcccaccatcaactgcaagtccagccactattttacaccacctccaaacaataagacttaacttagcttggtaaccagaaccaaaaaccaggacacgcctactagagctgctactactttacgngggtccgtaccgtacccgggatccgtcggggtccctaggaccgtattacgtagttagggaacggtccggggtacgttaggggaactagttaacgttttaccaccttccgtacctaacccgattaccgaacgaccgtacggtcccttaggaccggtaacgggacttaacgggaaaacgtaggttacggtacgggttaccgtttaaggtttttaactttcgttacggtacctacgtaactaacttaccgtttcggttaaccgttttccgacctttaccgtaccggtttacgggtaccgggtacggtaaccgtaggggttacggacgtacgtaaccggaaacgtacgtggtaccgctacgccgtactcgttcgtctacgttactaccg

SEQ ID NO: 188915 - DNA, 652 bp, Homo sapiens
  misc_feature: GYAE6OF02HNECG.53.1.A01.1.454.CMB.1.raw
  modified_base (230)..(230): a, c, t, g, unknown or other
  misc_feature (230)..(230): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctcgtgggcgagaggccaccatcaactgacaagtccagccactattttanaccaccctccaacaataagattaacttagcttagtaccagacaaaaaccnggacacgcctctgagctgctctatttacgngggtcgtacctacccgggtaatccgtcggggtccctgaccgtattcgagttggaaggtcgggtctgggacagtactttcactctcaccatcagcacgcctgcgaggctagaagtacgtggtcgtacttagttttactttcgtcgtactacgactaacttaccgttactttacgttttacccgcctttaccgttaccgtttaccggggaccgggtaacgggtaccccgtaagggtaccgggtacgtaaccggttacccgtaaaacggtaccggttacgggtacggttaccggacgtaccgaacccttacgtttacggtttccgtttacccttacgtaaccccg

SEQ ID NO: 188916 - DNA, 703 bp, Homo sapiens
  misc_feature: GYAE6OF02FFDDG.53.1.A01.1.454.CMB.1.raw
tcagcgcgtatacacacgaccggtgctcgatttagacgtctcatcaaggaggaagggcacgaccggtgctcgatttagacgtctcatcaaggaaggaagggggtggtccaggaggcagaactctgggtgtctcaccatggcctggatccctctacttcctccccctcctcactctctgcacaggctctgaggcctcctatgagctgacacacgtcaccccgttggtgtctgtcgtcctcgaggacaggccggccaggtatccaccgtgcctcgtcggacgtagtcgactagttacgacctaaaactaatagtcgtaccttaacgtcggtaccacgacacggacgccgaacggccgaccggtccccttgtcgttggtacgtactttaagaaacgttacgtttagaacggtacggtccctacggaaccgggtacccctagaccggacgtacgttccgtcgtacggtcctacacggtaccgtaccggaaacgggtaacctaaccgtacgtaccgtacccttacgaaccctacgttaccgaagggttcggaccggtacccgggaccgaaggggtaacgaccgggtaagtccgttagtaaccttacgtttaccgtacgtaccgtaccggtcccgagaaacggacgtacggtacgtacggtcggaacttaggttagttaccggtacggttaccggtccgggtaacgggg

SEQ ID NO: 188917 - DNA, 812 bp, Homo sapiens
  misc_feature: GYAE6OF02JDNET.53.1.A01.1.454.CMB.1.raw
  modified_base (697)..(697): a, c, t, g, unknown or other
  misc_feature (697)..(697): n is a, c, g, or t
tcagcgcgtatacacacgaccggtgctcgatttagacgtctcatcagggggagctacaacaggcaggcaggggcagcaagatggtgttgcagacccaggtcttcatttctctggttgctctggatctctgggtgcctggcggggacgttcgttttgacccagtcctcccgactccctggctgtgtctctgggcgaggagggccaccatcaactgcaagtccagccactatttactacaccctaccaaacaataagatttaaccttagctttcggaaccaagaccaaaaaccaggaacagcctccgtagactccgtgactctactttacgtcgggtacgtaccgtacccgggaattcgtacggggttccctacggtaacccgtacttacgtaagttacgggtaaaggtccggggttaccgtagggggaccgtagtaacgttttaccgtaacctccgttaaccacccacgtttcaacggtaccgaaccgtcccggttacggaccgtaacggggtccttaacggaaagggtacgttacgggtcgggtaccgttttaaggttttaacgttttcccgtttaggtacccgtaaacgtaaccgtaaacctttaccgttttacccgttaacgttttttcccggaccttttaaccccgttaccggttttaacccggggggagggtaaaccccgggggttaaccccncgggggttttaagggaaccctaacggtttaaacccgaaaacccgggttaacggttcgggtaaccggtccgtacgacccgtaaccgtccttacgggttccttacgttaccctaccg

SEQ ID NO: 188918 - DNA, 682 bp, Homo sapiens
  misc_feature: GYAE6OF02HEKK7.53.1.A01.1.454.CMB.1.raw
  modified_base (246)..(246): a, c, t, g, unknown or other
  misc_feature (246)..(246): n is a, c, g, or t
tcagcgcgtatacacacgaccggtgctcgatttagacgtctcatcgaaggaaggaagggggtgggtccaggaggcagaactctgggtgtctcaccatggcctggatccctctacttctcccctcctcactctctgcacaggctctgaggtcctcctatgagctgacacagtcaccctcggtgtctgtgtcctcgagggacagacggccaggactcgacctgctctggccatgcattcgaccaaaanagtactgtacttacgtgtaccagacaggacgcaggccgacggtcccctgtcgttggtagtagttagtaaacgtacgtttaggacggtacgtcctcgacggacccctggacgacgtactcctcgtcggtcctccgagtccgtacgaggacaacgtacgtccgaactttcgacctactacgagtgggaaccggtcccggaaccgaaggacgggtacggaggtacctacggtaacttacgttaacgtcgttaaccgagtacccgagtacgacgacgtacggacgtacgggacttaaggttactcggttttacggtacgttccggggcggggtaacggtacccggtacggttaccggtaccggtaccccggttaaccggttaggttacccggaccgggtacccggtaaacgggtccgtccccggtaccccggttcccggg

SEQ ID NO: 188919 - DNA, 883 bp, Homo sapiens
  misc_feature: GYAE6OF02HEFIQ.53.1.A01.1.454.CMB.1.raw
  modified_base (230)..(230): a, c, t, g, unknown or other
  misc_feature (230)..(230): n is a, c, g, or t
tcagcgcgtatacacacgaccggtgctcgatttagacgtctcatcagggggagctacaacaggcaggcagggcagcaagatggtgttgcagacccaggtcttcatttctctgttgctctggatctctggtgcctgccgggacgtcgttttgacccagtctcccgactccctggctgtgtctcgtgggcgagacggccaccgatcaactgcaagtccagccactattttanaccacctaccaaacaataagattaacttagcttacggtaccaagaccaaaaaaccgtaggaaccacggtaccccttacccgtagggaacgtaccgttggaccttaccgttaaactttttaaccggtcgggggtacccggtttacccgttaaaccccccgggggaaatttcccgggttacggggggttacccccttacgggtaaccccggtaacgttttaccgaaacggttttacggggaaacgggtcccggggggtttccgttacggggggaaacctaaggttaacgttttaccaaccgtttcctaacctaaccccgtaacttaccgaacggtaccgaacggtaccctttgggaaccgtaacgggtactttaacggggaaaacgtaacgggttcgggtacgggttacgttaaaggtttttttaccgtttacgtttacggttaccgaacggttaacctaaacgtttaacccgtttacgtttaaccggtttttcccgaaccgttccgtttaacccgttttaccggggacgggtaacccgggtaacccgtaggggttcggaacgtaacgttaaccgaaaaccgggttacgtcgggttacggaccgtttacgaccttaaccgtacggttaccgtttcggtttccttaaccgtacccg

SEQ ID NO: 188920 - DNA, 566 bp, Homo sapiens
  misc_feature: GYAE6OF02HG5HQ.53.1.A01.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagagggccaccatcaactgcaagtccagccactattttanacacctccaacaataagattaacttagcttggtaccagacaaaaaccaggacagcctctgagctgctcatttacgngggctctaccgggaatcgtggggtccctgaccgtattcgattcggaagcgggtntgggacagtatttcactctcaccatcagcagcctgcaggctagaagactgtggctagttttatttctagtcaagactaattcgttcttacgttttccgctccgttacgtttccgggacggtacgggaacccgtagggtacggagtacgtaccgaaacgtaccgtggtcggactagacctacgtacttcgttacgttccttactaccg

SEQ ID NO: 188921 - DNA, 855 bp, Homo sapiens
  misc_feature: GYAE6OF02I4NI1.53.1.A01.1.454.CMB.1.raw
  modified_base (223)..(223): a, c, t, g, unknown or other
  misc_feature (223)..(223): n is a, c, g, or t
tcagcgcgtatacacacgaccggtgctcgatttagacgtctcatcaggggagctacaacaggcaggcaggggcagcaagatggtgttgcagacccaggtcttcatttctctgttgctctggatctctggtgcctgcggggacgtcgttttgacccagtctcccgacttccctggctgtgtctcgtgggcgagagggccaccatcaactgcaagtccaggccanattttacaccacctccaaacaataagattaacttagtcttaggtaaccagacaaaaaccaggaacagccctcctgaacgctgacctctagtttacgtcggggccgttacgtaaccccggggtaaatccggttacgggggtcccctggtaaccgattttaccgaagtttcgggaaacgggtcggggttacctacgggggaaacctaggttaacttttccgaacgtttaccgtccgtaaaccctagttacccgtaacggaacctaccggtacccgtacggaaccggtaacgggtaaccggttaaggaaaaccggttacttagggggttaccgggttaacccgtttaaagggtttttttaacttttacccggttacggtttaccgtaaacggtaccctttaaaacggtttaaccctttttacccggttaaacggttttttacccccggactttacccgttaacccggttttcccggggtaacgggtaaaccccggggtaacccggtaaggggtttaacggaacggttaacccgtacgggtaaaaaacccggttccgttaacgggtacggtaacccgtttaggaacccttaaccggtaccgtttaccggtttccgttaccggtttcccttaaccgg

SEQ ID NO: 188922 - DNA, 739 bp, Homo sapiens
  misc_feature: GYAE6OF02F8OHS.53.1.A01.1.454.CMB.1.raw
tcagcgcgtatacacacgaccggtgctcgatttagacgtctcatcaaggaagggaagggggtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggactcacctgcctcgtggcgagtgctattcgaccaaaaacaatatgtacttactacggtaccagcaggacggccgacggccgacggccctcggttcgtttcggtagttaacttttaagtaaaacgttacgtttaggaacggtacgggtccccgtacggaaccgggtaccccctggaacgtcgtatttaccgtcgtcggtccgtaccgacgtccgtacgtaacgggaaccgaaaccgtacgttaccgtaacccgttacgaaaccgtacgtacgtaacgggtacggggtccggtacccggggtaccgaaggggtaacggggaaccggtacgggtccgtacggtaacctttaacgttaaccgttcgggttacctaccgggtccgtaaccgacggtaaccgacggacgtaacggtacgggtacttaagggttacttcggttacgggttacgttcggggacggtacgggtacgtcggtcgtacggtcccgtacgtacggctaccggacccgtacggtccgtccgccccgtaccgg

SEQ ID NO: 188923 - DNA, 655 bp, Homo sapiens
  misc_feature: GYAE6OF02H2NN6.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctctgggcgagaggccaccatcaactgcaagtccagccactatttatacacctcaacaataagattaacttagcttggtaccagacaaaaaccaggacagcctctgagctgctcattacgtgggctcgtacccgggatcgtcggggtccctgaccgtattcagttggaacggtcggggtctacggggactagtacgtttacactcctacgaccatccaggccacgcctagcgaggtcgtagaagtagttcggtaggtacttaagttttacgtttcgtgtacctaagtacctaattacccgttactttaccggttttaccgaccctttacgttaccggttttaccgggaccggggtaaaccggggttaccccgaggggttaccggacgtacgttaccggtaaaacggtacccgttaggtacgggtactaccgaccgtaacccgtagttaccctttcggttacctttccgtaacccg

SEQ ID NO: 188924 - DNA, 803 bp, Homo sapiens
  misc_feature: GYAE6OF02IN0B1.53.1.A01.1.454.CMB.1.raw
  modified_base (226)..(226): a, c, t, g, unknown or other
  misc_feature (226)..(226): n is a, c, g, or t
tcagcgcgtatacacacgaccggtgctcgatttagacgtctcatcaaaggaaggaagggcacgaccggtgctcgatttagacgtctcatcaaggaaggaagggggtgggtccaggaggcagaactctgggtgtctcaccatggcctggatccctctacttctccccctctcactctctgcacaggctctgaggcctctatgagctgacacagtccacccgtcggtntctgtgtcctcgaggacaggaccggccaggactccacctgcctcgtcggcgatgctattacgaaccaaaaacgtaatagtcgtactttaacgtacggtaccgagacgaaggacggaccgacgggacccgtacggtcccccgttggttcgttacgggtacgttaaacttttaaagttaaaacggttaccgttttaggaacggtaccggtcccctacggaacccggggtaccccttggaacggtccggttaactttccgtaccggtcgggtacccttaccgacgtaccgttaccggaaacggggaaccctaaaccgtaacggttcccaaacccgtttacggaaccctaacggtccgtaacgggggtcggaaccggttcccgggaaccgtaaggggaaccgggtaaccggtacgggttcctaacggttaaaccttacgtttaaccgtcgggtaaccgtacccgggttacccgaaccggtaacgtaaccgggtcgtaaccggtagggttacgggtaacgtttacggttttaacggttccgggttaacccgggttttacgggttccggggaaacccgggggg

SEQ ID NO: 188925 - DNA, 574 bp, Homo sapiens
  misc_feature: GYAE6OF02F45IW.53.1.A01.1.454.CMB.1.raw
  modified_base (314)..(314): a, c, t, g, unknown or other
  misc_feature (314)..(314): n is a, c, g, or t
  modified_base (562)..(562): a, c, t, g, unknown or other
  misc_feature (562)..(562): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttcgacccagtctcccgactccctggctgtgtctctgggcgagacggccaccatcaactgacaagtccagccactatttacacacctccaaacaataagattaacttagcttaggtaccagacaaaaaccaggacagcctacctgagctagctactatttacgngggtccgtaccgtaacccggggtaatccggtcggggtcccctagaccgtattcagttggaagtcgggtctgggacagtactttcactctcaactatcacgcagcccgtgcaggtctaggaaacgtgtggtgtacttagttttacttctgtacagtactaattacttcgtagtttcccgcttcgtacttcgggacggtacgggtaccaggtggactactaacgaaacgtactggcgtcgtacgctactntactgtctcgtc

SEQ ID NO: 188926 - DNA, 625 bp, Homo sapiens
  misc_feature: GYAE6OF02GXWSX.53.1.A01.1.454.CMB.1.raw
  modified_base (320)..(320): a, c, t, g, unknown or other
  misc_feature (320)..(320): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagaggccaccatcaactgcaagtccagccactattttacaccacctaccaaacaataagtattaaacttagtcttaggtaccagaaccaaaaaccaggaacacgtcctcctgacgctgcctctatttacgngggccgtaccgtacccgggatccgtcggggtccctgaccgtattcgattggaaggtccgggtgtacgggaactaggtacttttcgacttctacaccatccaagcacgtcctagcgtaggcgtagaagtgtggtacggtcttaagttttcttacgtacggtactacggtactaagttacctttcgttaacgttttccccagttccgttaaccgtttccgggacgggtaccggtaccgtagggtgacgtacgaacgaacgtacgtcgtacggccgtagacctactacgtcttcgtcttacgtacccg

SEQ ID NO: 188927 - DNA, 795 bp, Homo sapiens
  misc_feature: GYAE6OF02HMC4A.53.1.A01.1.454.CMB.1.raw
  modified_base (611)..(611): a, c, t, g, unknown or other
  misc_feature (611)..(611): n is a, c, g, or t
tcagcgcgtatacacacgaccggtgctcgatttagacgtctcatcagggggagctacaacaggcaggcaggggcagcaagatggtgttgcagaccaggtcttcattctctgttgctctggatctcgtggtgcctcggccgggtacgttcgttttacgacccagtccgtacccgctcccgtggctgtcgtctcgtgggcgaggacgggaccaacctataccaactcggactaaacgtccacgccacttatttaactacaccctaccgaaactaataaagaattaactagtcttacggtaccaagacaaaaaaccgaggaacacgtaccctaccgtagacgtactcgtaccttactacgtttaacgcggggtaccttccggttaaacccccgggaaagttccggttaccgggggtccccgttacgggaaccccgttaagtttaccgtaaagttaacgggtacggggtaacggggtaccgttacggggaacgtaagttacgtttaacgtaccttacgtaccaacctaagttccgaacgtccgaactcccgtacggcgtacgacgtaggaagtaacggtcggtacgtacgtttaactttagttttacgccgttanaacggtacaaccgtttattacccgttaagtttcccctacgtaaccttcgtttaccgggacgggtaaccggtaaacccggtggtaaacggtacgaaacggtacgtaaaacccggaatcgggttaccgaaccgttccgaacccgtccggtaacctaccggtttcggttaccttacggttaaccccg

SEQ ID NO: 188928 - DNA, 652 bp, Homo sapiens
  misc_feature: GYAE6OF02GPDYU.53.1.A01.1.454.CMB.1.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggactcgttttgacccagtctcccgactccctggctgtgtctctgggcgagagggccaccatcaactgcaagtccagccactattttanacacctcaacaataagattaactagcttggtaccagacaaaaaccnggacacgcctctgagctgctctatttacgtgggcgtccgtaaccgggaatcgtcggggtaccctgaccgattcagttacggaacggtcgggttcgtaggggaacctaggttactttaccgacttcctaccaacctatccgaagtccaacgtcctggacgacggacgtagaagagtcggtacggtacttagttttactttcgttcgtacaagtacctaaagtttcctttacgttaccggttttccgtaccgttaccttaccggtttacgggaccgggtacgggtaacccgtagggtacgggacgtacgtaaccggtaaacggtacgttagggtacgtacgtacgaccgttacgacttacgttcgttacttcgtaacccg

SEQ ID NO: 188929 - DNA, 610 bp, Homo sapiens
  misc_feature: GYAE6OF02HGFP2.53.1.A01.1.454.CMB.1.raw
  modified_base (579)..(579): a, c, t, g, unknown or other
  misc_feature (579)..(579): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtctcccgactccctggctgtgtctctgggcgagagggccaccatcaactgacaagtcccagccaactattttaatacacccttaccaaacaaataaagacttaaacttagcttacggtaccagaccaaaaaccgaggacagcctcctgagctgctctattcgtggctcgtaccgggatcgtcgggtcctgaccgtatcagttggaaggtcggtacgtggggaactagtactttcgactctaccacactcgacgcacgcctgcgaggtctaggaagacgttggtaggcttagtttatttccgtgttaccagtacctaattaccttacgttaccttttcggacctttcgttaccgtttcgggacggaaccggtacccgagggtaggacgtaacgtaacgtaaaccgtaacgttggtaccggtntcggacctacgtctactcgttcttactaccg

SEQ ID NO: 188930 - DNA, 710 bp, Homo sapiens
  misc_feature: GYAE6OF02HQHCD.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtcctcccgactccctggctgtgtctcgtgggcgagcgggccaccatccaacttgactaacgtccagaccatattttacaccacctacaaacaataacgtaacttaaacttagactttacggtaaccaagaaccaaaaaaccgaggtaccacgtccctacgtaggacgtctcgtacttactacgtttacgtcggggtccgttaccgtaacccgggtattccgtcgggggttccctacggaccgtacttacgtagttagggaacggtcgggttacgtaggggacctaggttactttcacttcctaccaacacgtcacgacgacgtcccgtagacgagggctaaggaagtgtcggtaggtacttagttttacgtttctacggtacaaggtactaaacttttcgttaccgtttacgtttaccgcttaccggttacggtttccgggaccgggtacggtacccggtaggtacggactaaccgtaaaccggtaaaggttccggttacgggtacggtcctacgtaccctaactcgttcgttacgtttctacccttccccg

SEQ ID NO: 188931 - DNA, 830 bp, Homo sapiens
  misc_feature: GYAE6OF02INAP3.53.1.A01.1.454.CMB.1.raw
tcagcgcgtatacacacgaccggtgctcgatttagacgtctcatcaaggaagaaggggtgggtccaggaggcagaactctgggtgtctcaccatggcctggatccctctaacttctccccctcctcactctctgcacaggctctgaggcctcctatgacgctgacacagtccaaccgtggtgtctgtgtcctcgaggacacggacggccaagggactccgacctcgccttctggacgtatcgactacgttcgaacctaaaactactacgtcgtaccttacgtcggtaccagacgaggacgccacggccacgcccctgtcgttggtcgtagtttacgtaacgtacgtttggacgtacgtccctacgacggtaccctgacgtcgtattccgtcgtacgtcctaccgacgtccgtacgaacgggaacctaacgtacggtacctaacccgtttcgaacccgtacttaccgtaacgggtaccggtaaccgggttaccccgggaccgtaacgggaaccggggtaaaccggtacggggttaccctaaacgggtaaccgttttaaacgtttaaacccggttcgggtaaacccgttaccgggttaacccggacccgtaaacggttaaccccggaaacgggtcccgttaaagggtacccggggtactttaaaccgttttaacggtccgtttacccgggttaaagttccccggggtagggtaaccggggttacccttaacgggtacccggtacggttaaaccccggttaccgttaacgggtacccgaaacccggttcccgggaaacggtccccggttacccggtaccccccggttaaccgg

SEQ ID NO: 188932 - DNA, 819 bp, Homo sapiens
  misc_feature: GYAE6OF02HU6YU.53.1.A01.1.454.CMB.1.raw
tcagcgcgtatacacacgaccggtgctcgatttagacgtctcatcaaggaagggaagggggtgggtccaggaggcagaactctgggtgtctcaccatggcctggatccctctacttcctccccctcctcactctctgcacaggctctggacggcctcctatgagctagacacagtccacccgtggtgtcgtgtcgtcctcgaggacacggaccggaccgaggtactccgaccgtgtccttcgtcggacgtatcgactagttacgaaaccaaaaactaagttacgtacgtaccgtttaccgtacggtaacccgacggacgaacggtacggacccggacgggacccgtaccggtccccgtttcggttacggtttacgggttagtttaacgttttaaacgttaaaggttaccgtttacggaacggtaccggtaccccgtaaccgggaaccgggtaccccgtaggtacggtacgtactttccgtccgtcggtacctaccgtacgtaccgtacggaacgggaacctaaccgtacgtaccgtaacccgttacgaaccacgttttttttttttttttttttttttttacgacggtacggtacggtaccggacgtacggaacgggtacggacggtacgtacgtaacgttaacgttacgttacgtaccgtaccgtaccgacgacgacgacgtacgtacggtacggtacgttagttacgttacgtacgttacggtacgggtacgggtacggtaccggtaccggtaccggtacggtaccggtaccgtacgtacgtaccggaccgtaccggtaccgtcccgtcccggtccg

SEQ ID NO: 188933 - DNA, 945 bp, Homo sapiens
  misc_feature: GYAE6OF02I2N0Z.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggtacgtcgtttcgacccagtcctcccgacctcccgtgtctgtcgtctcgtgggacgaggacgggcccaccataccgaacctaggaccaacggtcccacgacccaacttaactttttaactacccaaccctacccaaaactaaacttaaacgtaacttttaacgttacgttaccgtttacggtaaccaaccggtaaaccaaaaaaacccgaacgggaacctaaccgtaccccttacccgtacggtacggccgttcgtaccgttaccttaacggttttaccggttaccgggggtccgttaaccccgggttaaaccccccggggtaaatttccccgggttacccgggggggtttaccccccgttaccggtaaaccccggttaacgttttaccggttaaacggtttaaccggggtaaacggggttacccgggggtttccggtttaaacgggggtaacgttaaaaccggtttaacgtttttacccttaaacccgttccgttaacccgtaaaccctacgtaccgaaccgtacccgggtacgtaccccggttcggacgtaaaccgggtcgttaaaggggaacgtacggggttcggttacgggttactttaagggttttaacctttgttacggttacaacgttactaacgtttacgtttccgtttaccgtttccaccgtttaccgttacgggttaacccgcggggtaaccggtacgtagggtactacggactaaacccgtaagtaccggttagtccgggtaccgtacggtaacctacccgttacgttccgttcgttaccttaccggtaccccg

SEQ ID NO: 188934 - DNA, 992 bp, Homo sapiens
  misc_feature: GYAE6OF02GKEMC.53.1.A01.1.454.CMB.1.raw
tcagcgcgtatacacacgaccggtgctcgatttagacgtctcatcagggggagctacaacaggcaggcaggggcagcaagataggtgttgcagacccaggtcttcatttctctgttgctctggatctctggtgcctggcggggacgttcgttttgaccctagtcctcccgactcccgtggctgtgtctcgtgggcgagacggccacataccaactgacagtccagaccactatttacaccacctaccaaactaaataagtacttaacgttagtactttacggtaaccaaggtaaccaaaaaaccgacgggaaccaacggtccccttaccgtaggtaacggcccttacggaccttacgttaacttttaaccggttccggggggtaccgtttaccccggttaaacccccgggggtaaactttcccggggtttacccggggggttacccccttacgggtaaaccccgtttacgtttaccggtaacggtttagggggtaaaccggggttcccggggggtttacggttacgggggtaaaccttaacgggtttaaccttttacccggtaaaccctttcccgtttacccaacccggttaaccttacccggaaccggtaccgtaaccgggtacccgtaccgggtaacccgggtaaggggtacccgttaaggggtaaacggttacggtttacgggtaccggggttaccgttttaacgggttttttacgttttaccggtttcggttaaccgtacgggttaaacctttaaacggtttaccccgttttcgggtttaacccgtttttacccggccgttttaccggttaacccgggttttaccggggaacccgggtaaaccggggttacccgtaacggggttacgggtaaccgttaaccgtaaccggtaaaccggttacggtaccgggttacgggtacccgtacggtacccgttaaccggttcttacccgggttttaccgtttacccgttacccgtttaaccccgg

SEQ ID NO: 188935 - DNA, 814 bp, Homo sapiens
  misc_feature: GYAE6OF02JVC3C.53.1.A01.1.454.CMB.1.raw
tcagcgcgtatacacacgaccggtgctcgatttagacgtctcatcaaggaatgaagggcacgaccggtgctcgatttagacgtctcatcaaggaaggaagggggtgggtccaggaggcagaactctgggtgtctcaccatggcctggatccctctacttcctccccctctcactctctgcacaggctctgacggctctatgacgctgacacgacgttccaccgttggtcgttctgtcgtcctgacggaccaggaccgccaggactctaccgtgtcctcgaggtcgatgtctagttacgaacctaaaacagttatacgttacgttacgtacggacctagacggacgacggtcccgaacgggtaccccgtaaccggggtccccttgggttaccgtttggtaacgttaacttttaaaaggtaaagttaccgttttacggaacggtaaccggttaccccgtaaccggggtaacccggggtaacccgttggaaaccggtaccgttacgtttcccgttaccggtcggtacccgtacccgtacggtaccgtacggaaacggaacctaacgtacccgtaccgttaacccgaccggttaacctaacgttccgtaggtaccggtaacccggtaccggaccgggtaacggacggggtaaaccgggacggttaccgttaaccgtaaacgtttaccgttacggttacggtaccgtacggtaccccgggtaacaacggttaaccgtacggtaaccggtttagggtaacccggttaacggttaccggttttagggtacggtttacccgggtaccgggtttaaccggggg

SEQ ID NO: 188936 - DNA, 721 bp, Homo sapiens
  misc_feature: GYAE6OF02GY2D6.53.1.A01.1.454.CMB.1.raw
  modified_base (188)..(188): a, c, t, g, unknown or other
  misc_feature (188)..(188): n is a, c, g, or t
  modified_base (343)..(343): a, c, t, g, unknown or other
  misc_feature (343)..(343): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcgggacgtcgttttgacccagtctcccgactccctggcctgtgtctctgggnagacgggccaccatcaactgcaagtccagccactatttacacacctccaacaataagattaactagtcttagtacagacaaaacaggacagcctctgagctgctctattacgtggacgtcgtacccggatccgtcggggtccctggaccgattcngttaggaacgtcgggtcgtgggactaggtactttcgaactcgtaccaccgtattcacgaccgtacgcccgttagaccggtacgggtacgtaaggtaaacgtagttccggttaggggccttttaaggttttacgttttacccgtaggtttacccaacgggttaaccctaaacggttttaccctttacggttaaccccgtttttttccgaccgttttaccggttacccgggtttttaccggggacccggggttaaacccggggacccgggttagggtaccgggacgttaaccgtaaaccgggtaaccgttacgggttacgggtaccgtcgtaaccggtacccgtacgttacgttaccgtcctttaccgtacttcccccgg

SEQ ID NO: 188937 - DNA, 830 bp, Homo sapiens
  misc_feature: GYAE6OF02H22CM.53.1.A01.1.454.CMB.1.raw
  modified_base (378)..(378): a, c, t, g, unknown or other
  misc_feature (378)..(378): n is a, c, g, or t
tcagcgcgtatacacacgaccggtgctcgatttagacgtctcatcagggggagctacaacaggcaggcaggggcagcaagatggtgttgcagacccaggtcttcatttctctgttgctcgtggatctcgtgtgcctggcggggacgttcgtttgaccctagtcctcccgactcccgtggctgtcgtctcgtgggcgaggacgggccaccgatccaacgtgacaacgtccacgacctaactattttacaaccacctaccaaacgtaataacgtaactttaacttagtcgtttacggtaaccaaggaacctaaaaaaccgacggaaccacggtaccccttaccgtacggaacgtctcggtacttacgtacgtttaccggngggtccgttaccgtaaccgggtacttcgggtaccggggtcccctacggtaaccgtacgttacgtacgtacgggaacggtccggggtacgtacgggactaacgttacgtttaccaaccgttcctaacccgtaaccgtagtaccgaacggtccgtaacggtcccgtacggaccggtacgggtaccgttaaggaaacggttacggtacgggttacgggtacccgttttaaggtttttaccgtttaccggtcgttaccgttaacgggtaaccttaaaccgtttaccgtttaccgtttacccggttttacccgtccgttaaccggttaccgggtttacccgggaccggggtaaccggtacccggtaagggttacggacgttacctaaccgggtaaacgtcggttacggaccgtacgtccgacctacgtaccgtttaccgtcgttaccttacgtcccg

SEQ ID NO: 188938 - DNA, 957 bp, Homo sapiens
  misc_feature: GYAE6OF02JGHS5.53.1.A01.1.454.CMB.1.raw
  modified_base (132)..(132): a, c, t, g, unknown or other
  misc_feature (132)..(132): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtncctgccggacgttcgtttgacccagtctcccgtactcccgtggctgtcgtctcgtgggcgaggtacggccaccgatccaactgacaagtccagccctatattttaactaccaccctaccaaactaaagtaaagtaactttaacttacgtccgtttaaggtaaccaacggaaccaaaaaacccgacggtaaaccacggtaccccttaccgtggaacgtcctacggtccttaaccgttaacttttaaccggtcggggtacccgttaccggtaacccccggggttaaagttcccggttaccggggggttcccctaacgggtaacccgttaacgttaccgtaacggttacgggaacggggtaccggggtttacggtaccggggtaaaccgtaacggttaacttttacccgaaaccgtttcccgtaacccgtaaaccccgttaacgtttacccgtaacggacccgtaaacccggtccccgtacggttaccggaaaccggggtacgttaaacgggtaaaccgtagggttacgggttacggttaccgtttaaccggtttttaacttttccggttaacgttaaccgtaaccggttaaacgtaacgttttaaccctttacggttaacccggtttttacccgtaaacccgttaccgtttaaccggggtttcccgggtaacccgggtaaccggggtaaccccgtaggggttaacggttaacggtaaccgtaacccggtaaaaccggtacggttacggtacccggttaacccgttaaccggtacccgtaaacccggttccgttaaccggtttccgttaccgttaacccgttacccgg

SEQ ID NO: 188939 - DNA, 755 bp, Homo sapiens
  misc_feature: GYAE6OF02F0WRF.53.1.A01.1.454.CMB.1.raw
  modified_base (276)..(276): a, c, t, g, unknown or other
  misc_feature (276)..(276): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgtttgacccagtctcccgactccctggctgtgtctcgtgggcgagagggccaccatcaactgcaagtccagccactatttacacacctccaacaataagacttaacttagcttggtacagacaaaaaccnggacagcctcctgacgctgctcatttacgtggggctacgtaaccgggattccgtaggggtccctggacccgatttccgagttacggaacggtccgggtactaggggaaccagtaactttaccgactcgttaccaaccctaatccgaagcctaacggtccctaggacctagggtcctagggaaaaggtacgttgggtacgggtaccgttaaggtttttactttccgttacgtaacgtacggtaacctaaactttcgtttaaccgttacggtttttccccgaacttttcccgttaaccggttttaccggggggacccggtaacggggttaaccccggtagggggttaacggtaaccgggtaaccttaaacccggaaaacggtaacccggttttcgggaaccgggtttaccgttaacccgggtacctaaaccggttacggtttacccggtttaccgggttttaccgtaccctttaccccggg

SEQ ID NO: 188940 - DNA, 764 bp, Homo sapiens
  misc_feature: GYAE6OF02GNRSF.53.1.A01.1.454.CMB.1.raw
  modified_base (713)..(713): a, c, t, g, unknown or other
  misc_feature (713)..(713): n is a, c, g, or t
  modified_base (757)..(757): a, c, t, g, unknown or other
  misc_feature (757)..(757): n is a, c, g, or t
tcagcgcgtatacacacgaccggtgctcgatttagacgtctcatcagggggtagctacgaacaggcaggcaggggcagcaagatggtgttgcagacccaggtcttcgatttcctctgttgctctggatctctggtgcctgcgggacgtcgtttagacccagtctcccgactcctggctgtgtctactgggcagtagggccaccagtcaacttgaccaacgtccagccgactacttttaacaccaaccttccaaacaacttaagtactttaaacgttagcttacggtaccctaggccaaaaaacccgtcgggaccaaggtacccttccttacgaacgtacctttcgaccttaccgaattttaaccgtcggggtccgttaccggttaccccgggtaaattccgtacgggggttcccctacggtaaccgggtactttacgaactttcggaaacggtccggggttacttacgggggtaccctaaggtactttttcccgaaacgttccgttacccaacccgtagttacccaaaggtccctaaacgggtcccttaggccccgttaaaggcccgttaagtaacggtacttcggttacgggaccttaggttttaacttccggtattccgaagtccaaatttccgttcaacggtttttcccgcttaccgaacgttttcggaaccggtcgggtaacccagggttggactactacggaaaaccngttacgggtccaggttccacgtaaccacgttcgtacgtaccttntacccgg

SEQ ID NO: 188941 - DNA, 761 bp, Homo sapiens
  misc_feature: GYAE6OF02FJW1J.53.1.A01.1.454.CMB.1.raw
  modified_base (193)..(193): a, c, t, g, unknown or other
  misc_feature (193)..(193): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgtttgacccagtctccccgactccctggctgtgtctctgggcgagnggccacatcaactgcaagtccagccactatttacacacctaccaacaaataagtattaacttagcttaggtaccacgacaaaaaccgacggacacgtccctaccgtgacgtacctgacctactaactttaccggtgggtccgttaccgtaaccccggggtaacttccgggttcggggggttaccccctacgggtaaccccggtatttaccggtaagtttacgggaacgggttcgggggttacgtcggggtaaactacggttaacttttccgaactttcccgtaccaaccgtaacgtccgaacggtaccgtacggtacccgtacggtccgaacgggtcgttacggtaaacgtaggttacggtacggtcgtttaaggttttactttacccggttgtaccgagtaccgtaacgtttaccttcggtaaccgtttttccgccgttaccgttaccggtttaccgggaccgggtacgggtaccgtagggtacggtacgtacgtaaccgtaaacggcgttaaccgggtcgtaccgtacggtaccctacgtagttccgtacgttacttaccgtaccg

SEQ ID NO: 188942 - DNA, 720 bp, Homo sapiens
  misc_feature: GYAE6OF02IF9FK.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttagaccctagtcctcccgactccctggctgtcgtctcgtgggcgaggacgggccacatcaactgacagtccacgccactatttacaccacctccaaacaataagtattaacttagcttagtaccagacaaaacagacagcctcagacgtctagctctaacgtttacgtgggaccgttaccgtacccgggtaatccggtacggggtcccctggaacccgtatttaccaaggttcggaacgggttcgggttcgtacggggaacaggttacttcgaccgttcctaccgaacctacgtccacggacctaacgtcccgtacggaccgtacgggtaacctagggtaaagcgttacgggtcggttacgttagttttttaacgttcgttcggttaccgaggtactaaacgtttcctttacgggttaacttttcccgcctttaccgttacccgggtttcgggaccgggtaccggggacccgtaagggggttcgaacggtaactaaccggaaacgttaacggtgtaccggtcgttaccgaccgtaaccctagttcccgttaggtttccctaggtaccc

SEQ ID NO: 188943 - DNA, 644 bp, Homo sapiens
  misc_feature: GYAE6OF02GA6YX.53.1.A01.1.454.CMB.1.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgactccctggctgtgtctcgtgggcgagnggccaccatcaactgacaagtccagccactattttacaccacctaccaaacaataagattaacttagcttggtaccagacaaaaaccagacagccnctgaagctcgctactatttacgnggtaccgtcgtaacccgggaactcggtcgggtccctagacctagttcgagttaggtaacgtccggggttacgtgggaactagtactttacgacctctacccacctatccaagctacgccgtgaccgaggtctaggaatagtggtaggtcttagttttacttcgtacgtcaagtaccttaacgttactttacgttacgttttcccacgtttaccgttaccgtttaccggggaccggtaccgggacccgttaagggtcggtagtacgtaaccgaaacgggtaccgtaggtaccgtcgtacggactaccgtacgtcgttacttcgtaccttcccg

SEQ ID NO: 188944 - DNA, 796 bp, Homo sapiens
  misc_feature: GYAE6OF02G5R5A.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggtacgttcgttttacgaccctagtcctcccgactcccgtggctgtgtctcgtgggcgaggacggccaccatacaactgacaacgtccagccaattattttacaccaaccctacaaacaataaagtactttaaacgttagtcgttacggtaaccaagaaaccaaaaaaccgacggaaccacggtcccttaccgtagtacgccttgccttacttaacgttttacgacgggtccgttacccgtaaccgggtagtttccggtaccgggggttccctacggtaccgtacgtttacgaggttacgggaacggtccggggttacgtacgggtaaactacggttaactttacaccttacccgtaccctaaacctagtaccgtaagacccacggtcctacgggtaccgtacgggtactacgggtaaagttacgtacggtacggtactttaaacggtttttacgtttcgttaacttaccgtaagtaccttaaacgtttaacgtttaccgttttaaccgttttcccgtaccttaccggtttacccgttacggggtaaccgggtacgggtaacccgtaggggtacgtaacgtacgtaaccggtaaacggttacggtcggtacggtctacgtaccgtacgtcgtacggttcttacgttaccttacccg

SEQ ID NO: 188945 - DNA, 882 bp, Homo sapiens
  misc_feature: GYAE6OF02GSBFV.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgttcgttttcgacccagtcctcccgactccctggctgtgtctcgtgggcgagagggccaccatcaactgacaagtccagccactattttacaccacctaccaaacaaataagtattaaacttagcttacggtaaccaagaaccaaaaaaccgaggaacacgccctccgtgacgctagaccttactaagttttacgtcggggtaccgttaccgtaacccggggtaacttccggttccggggttacccctacggaacccgtactttaccgtaaggtttacgggaacgggtccggggttacgtacgggggaactaacggttaacttttaccgaaccttcccgttaaccctaaacccgtaacttacccgaacgggtacctaaccggtaccccgttacggaacccgggtaacggggtaccgttaacgggaaaacggttaagggttcgggttaccgggtaacgttttaacgggttttttacttttaccggtaggtttaacccgaaaggttaaccctttaaaaggttttcccgtttaaacccggttttaaccggttttttcccccgtaccgttttaccgttaacccggggttttaccggggaacccgggggttaaccgggtaacccggtagggggttaacggaccgttaacgtaaaccggtaaacggttaccggttacggtacggtacccgttacgaaccctaaccgttacgttacggtttacctttacccgttacgttaaccccg

SEQ ID NO: 188946 - DNA, 647 bp, Homo sapiens
  misc_feature: GYAE6OF02G8XON.53.1.A01.1.454.CMB.1.raw
  modified_base (133)..(133): a, c, t, g, unknown or other
  misc_feature (133)..(133): n is a, c, g, or t
  modified_base (445)..(445): a, c, t, g, unknown or other
  misc_feature (445)..(445): n is a, c, g, or t
  modified_base (581)..(581): a, c, t, g, unknown or other
  misc_feature (581)..(581): n is a, c, g, or t
  modified_base (633)..(633): a, c, t, g, unknown or other
  misc_feature (633)..(633): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctgggtncctggccgggacgttcgttttgacccagtcctcccgactccctggctgtgtctcgtggggcaggacgggtcccaccatcaactgcaagtccagccatattttacacgacctcaaactaataagtattaacttagcttacggtaccagaaccaaaaaccgaggacacgcctcctaggacgctcgactctattttacgcgggtcgtaccgtaacccgggtatccgtcgggggtcccctggacccgtagttccaagttcggaacgggtccgggtcgtaggggacctaaggttacttccgtaactcctaccaactntacgacggtcacgtccgtacgcgacggtctaggaacgtagtcggtggtacttagtttaactttcgtgttcgaagtacaacgttcttcgttacgttccgtccttctacggtttcggacgggaaccggtccgtacggnggtacagttaaccgaaacgtactggtcgtactagtccaccgttacttccgtnttactaccttaccg

SEQ ID NO: 188947 - DNA, 590 bp, Homo sapiens
  misc_feature: GYAE6OF02FV0MZ.53.1.A01.1.454.CMB.1.raw
  modified_base (192)..(192): a, c, t, g, unknown or other
  misc_feature (192)..(192): n is a, c, g, or t
  modified_base (297)..(297): a, c, t, g, unknown or other
  misc_feature (297)..(297): n is a, c, g, or t
tcagcgcgtatacacacgaccggtgctcgatttagacgtctcatcaagggaaggaagggggtgggtccaggaggcagaactctgggtgtctcaccatggcctggatccctctacttctccccctctcactctctgcacaggctctgaggcctcctatgagctgacacagtcaccctcggtgtctgtgtcctnaggacagacggcagatcacctgctcgtggcgtatgctattcgaaccaaaaactatatgacttacgtcggtaccagcagacggccaggccacggccctgtctggtntattataagtacttgagcgtcctagacgggaccctagagcgtacttctcgtcggcctacgagtccgtacgaacgggaaccaacgacgtacctaccgttacgacctatacgtaggtacgggacgtaccgggacaaggaacgggacggacggtacgtagtaacttaacttactgtaccgacgtccgactacgagacgacgtaggtcgagttacgttagtcgtacgtagttcgggcggaggtacgtcgccgtacggtaccgtcgtagcacgacccgaaggcctaccgtcccgtcgg

SEQ ID NO: 188948 - DNA, 766 bp, Homo sapiens
  misc_feature: GYAE6OF02HQDVG.53.1.A01.1.454.CMB.1.raw
  modified_base (154)..(154): a, c, t, g, unknown or other
  misc_feature (154)..(154): n is a, c, g, or t
  modified_base (742)..(742): a, c, t, g, unknown or other
  misc_feature (742)..(742): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctgccgggacgttcgttttnacccagtcctcccgactccctgggctgtcgtctcgtgggccgaggaccggccaacgataccaacgtgactaacgtccagcctactattttacaccacctacaactaatagtaattaacttagtcttacgggtaccaacgtaccaaaaaaccgggaccacgtccctcgtagaccgtactcgaccttctaacgtttacgtcgggtccgttaaccggtacccgggtaattccggtaccggggtccctacggtaacctcgttacgacgttacgggaacggttccgggtcggtacggaacgtacgtacgtttacctacttaccgacctaaccgtacgtcgtaacgtcgaccggtaacctcggtacggtagggaccgttaggtaacgtaacgggttccgggacggttaccgttaaggttttaaccgttttcgtacgggttaccaacgggtacctaaacgtttaccgttacggttttaaaccgtttcccggtacttaccggtttaccggttacccgggtaacgggtacggtaaccgggtacgtcgggtaacgtacgtaaacgaacggtaccgtcggttcgacgtcgtacggtacnccgttgttccgttactcgtacccg

SEQ ID NO: 188949 - DNA, 769 bp, Homo sapiens
  misc_feature: GYAE6OF02GCN0X.53.1.A01.1.454.CMB.1.raw
  modified_base (240)..(240): a, c, t, g, unknown or other
  misc_feature (240)..(240): n is a, c, g, or t
tcagcgcgtatacacacgaccggtgctcgatttagacgtctcatcagggggagctacaacaggcaggcaggggcagcaagatggtgttgcagacccaagtcttcatttctctgttgctctggatctctggtgcctgccgggtacgtcgttttgacccagtcctcccgacctcccgtggcttgtgtctcgtgggcgagacgggccaaccatacaaactgacaagtccacgccatattttanaccacctaccaaacgaaataagtaacttaacttacgtcttacggtaccaacgaaaccaaaaacccgaggaaccacgtacccgtcctgacgtctcgactacttaacgttttacgtcgggtaccgtaccgtaaccccgggtaacttccgggtccggggtacccttacgtacccggtaattcgtagttagggaacggtcgggtcgtacgggactagtacgtttcacttcctaccaaccactacacgctacgcctaggacgtaggactaggaagtagtggtacggtacgtttagttttactttccgtagtactaacggtaccttaacgtttaaccgtttccttaacgttttcccgtacgtttaccggttaaccggttttccggggaaccgggtaaccgggtaacccggtagggggttaaccggtacgaacgttaaacccggaaaaccgggtactttaccgggggtaaccttaccggttaccggtaccctaaccggttcttacgggttcccgttttacgtaacccttaccccgg

SEQ ID NO: 188950 - DNA, 852 bp, Homo sapiens
  misc_feature: GYAE6OF02HJZ4I.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctcgtggtcgcctcggccgggtacgttcgtttacgaccctagtcctcccgaccttcccgtggtctagtcgtctcgtgggcgaggaccgggaccctaaccactacctaacgtcgaccgtaagtccacgacctactattttaacacctacctaccaaactaataaacgtaacttaacgttacgtaccgttacggtaaccaacggaaaccaaaaaccgtaggaacctacgtaccccttaccgaggaccgtctacgtaccttacttaacgtttacggtacgggtacccggttaccgtaacccgggtaacttccgggttaccggggtacccgtaccggtaaccggttacttacggtacggttaacgggacggggttccggggtacggaacggggtacttaaacggttactttccgtacctacctaaccgaacctacgtacgacggacctagtacccgtggaccgtacggtaacggtaacggaaagtacggttacgggtttacggaactttttggttttaacccgtttcgtaaccgggttaccaaacggtttaaccctaaacgtttcctttaacccggtttaccgttttcccgacccgtttaccggttacccgggtttacggggacccgggtaaccggtaccggtaagggttacggactaaccggtaacgtaacggtacgtacgtcggtaccgtacgaccttccgtaacttcgttacgtaccgttccttaaccg

SEQ ID NO: 188951 - DNA, 735 bp, Homo sapiens
  misc_feature: GYAE6OF02HZN1Y.53.1.A01.1.454.CMB.1.raw
  modified_base (189)..(189): a, c, t, g, unknown or other
  misc_feature (189)..(189): n is a, c, g, or t
  modified_base (230)..(230): a, c, t, g, unknown or other
  misc_feature (230)..(230): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgtcgttttgacccagtctcccgacctccctggctgtgtctctgggngagacgggccaccatcaactgacaagtcagccactatttanaccacctaccaaacaataaagattaacttagcttaggtaaccagaccaaaaaaccaggaacacgacctcctagacgtctcgactactaagtttacgtcggggtccgtaccgtaaccccgggtaaattccggtcgggggtacccctgacccgtaattcagttaggacggtcgggtctaggggaacagtacgtttaccacttacctaccaacctataccgacgaccgtaacggtccctagggaccgtagggtacctagggaaagtacgttgggtacgggttacgtaagttttttacgtttccgttacggttaacgagtacctaaacttccgttttacgttacggtttttccccgactttaccgttaccgtttccggggaaccgggtaaacgggtaacccgtaggggttagaacgttaactaacccggtaaaacgtaacggttcggttaacggaccgttacggaccctaaccctagttacccgtttacggttcccttaaccgtacccg

SEQ ID NO: 188952 - DNA, 587 bp, Homo sapiens
  misc_feature: GYAE6OF02JAWGY.53.1.A01.1.454.CMB.1.raw
  modified_base (228)..(228): a, c, t, g, unknown or other
  misc_feature (228)..(228): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (480)..(480): a, c, t, g, unknown or other
  misc_feature (480)..(480): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtcctcccgactccctggctgtgtctcgtgggcgagcggccaccatcaactgcaagtccagccatatttanaccacctaccaacaataagtattaacttagtcttcggtaccagacaaaaaccagacacgcctcctgagctgctctatttacgnggtcgtccgtaccggtaatcgtcgggtcctcgacgtattnagttaggacggcgggtctggacagtattcactcacactactcgacgcncgcctgacgngtcgagacgtntgtcgacgtttagtttactttcgtgttcgacgtactaattacttacgtaccgttttaccncttacgttcggtttccgggaacgggtaccggaccgtagggttcgagtacgtaaccgtaacgacgttggcggtacncgttacaccgtntaccggtcttacctcgtacg

SEQ ID NO: 188953 - DNA, 852 bp, Homo sapiens
  misc_feature: GYAE6OF02H9KZE.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctggccgggacgttcgttttgacccagtcctcccgactccctggctgtgtctcgtgggcgaggacggccaccagtccaactgaccaacgtccacgacctacttaacttttaacaccaccctaccaaacaaataagtaactttaacgttacgtacgtttacggtaaccaacggaaccaaaaaaccgaggaaacctacgacccttacctagacgtctacgacttactaacgtttacggtacgggtccgttaacccggtaacccgggtacttccgggttccgggggtaccccgtacggtaaccgtactttaacgtacggttaacgggaacggtcggggttacggtacgggtaaccgtaggttacgtttacccgtaccgttacctaccgaacccgtacttaccgaccgtacgtaacgtcccgttacgaccggtaacggtcgtaaaggtacggtacgttcggtacgggttactttaacgtttttacgtttttaccgaggttacccgtaaggttaaccctaacgttttacgtttacctttacgggttttcccctacgtttaccggttaccggttttcggggaacccggacgggttacccggtaacgggtacgtaacggtaaccgttaaaccggaaacggtttaccgggttaggtacccggtaccgtaacgggcccctttaacggtactttccggtttacgttacccgtttaccttaacccccgg

SEQ ID NO: 188954 - DNA, 719 bp, Homo sapiens
  misc_feature: GYAE6OF02IBHKT.53.1.A01.1.454.CMB.1.raw
  modified_base (707)..(707): a, c, t, g, unknown or other
  misc_feature (707)..(707): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcggttttcgacccgagtcctcccgactcccgtggctgtgtcgtcgtgggcgaggcgggccacatcaactgacaacgtccagccactattttacacacctacaacaaatagattaacttagcttaggtaccaagacaaaaaccgcggaacacgtcctcctagacgtctcgccttactaacgtttacgtcgggtccgtttaccgtaacccggggtaactttccggtccgggggtccccttacggaaccgttagttaccgttaaggtacgggtaacggtccggggtacggtacggggtaacctaaggttacttttaccacgttaccttacctaaccgtaacgttacgacggtactaaccggtcctacggtacgtacggtacgtaggaacgtaggtcgtacggtactttaggttttacttcgtacgtacgacgtactaaaccttcgtttaccgtttaacgtttcccgccgtcgttaaccggtttcgggaacgggtacggtaccgtagggtacgtacgtacgtaacgtaaacggtacgtggtacgtcgtcgactctacttcggtntcctcttacccg

SEQ ID NO: 188955 - DNA, 843 bp, Homo sapiens
  misc_feature: GYAE6OF02GIFKJ.53.1.A01.1.454.CMB.1.raw
tcagcgcgtatacacacgaccggtgctcgatttagacgtctcatcagggggagctacaacaggcaggcaggggcagcaagatgggtgttgcagacccaggtcttcatttctctgttgctctggatctctggtgccgtggccggggtacgttcgttttcgaccctagtcctcccgactcccgtggtctgtcgtctcgtgggcgaggacggccacataccaacgtgacaacgtccgagacctacttattttacacctaccctaccgaaataataaagtacttaacgttagtcgttacggaaccaacgaacctaaaaaaccgacggaacctacggtaccctccgtaggacgtcctcggtccttacgttacgtttaccggcggggtccgtaccgtaaccgggattccggtcgggtcctacgaccgtattacgtaggtcggaaggtcggtcgtagggtactagtactttacgaccttctaccacctagtactacgccacgttccgtcgacggtacggcctaaggtaacgttacggttcgggtacgttaccgttttaaagggttttccttaccgggttacggtaaccgttaacgtaaacccgtttaaaccggttttaaccgtttacccggttttaccggttttaccccgttccgttaacccgggttttacccgggtttaacccgggggaacccgggtaacccgggttaaacccgggtaaggggttaccggtacgttaaaccgtaaacccggttaaacgggtacgttaccggggttacggtaccgttaaccgggaaccctttaccgttacggttaccccgtttacggtttacccttacccgttacccccg

SEQ ID NO: 188956 - DNA, 741 bp, Homo sapiens
  misc_feature: GYAE6OF02JDNFW.53.1.A01.1.454.CMB.1.raw
  modified_base (194)..(194): a, c, t, g, unknown or other
  misc_feature (194)..(194): n is a, c, g, or t
  modified_base (698)..(698): a, c, t, g, unknown or other
  misc_feature (698)..(698): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggtacgttcgttttgacccagtcctcccgactcccgtggctgtgtctcgtgggngaggaggcccaccatcaactgacaagtccagccaacttagtttactaccacctaccaaacaaacgtaagactttaaacgttgtaccgttaggtaacccaagtaaaccaaaaaccgtcggaacacgtaccctcctaggacgtctagtcctactaagtttacggtgggtcccgtaccggtaacccgggtattccgggttccggggtaccccaggtacccgttactttacgtaggtacggaacgggtccggggttacgtacgggaactagtactttaccacttcccgtacaacctagtaccgagtcccgtaacgccgtacgacggtacgggtaccttaagggacgtagttaccggcgtttacgtttaacgtttcgtttcacggtacaagtaccttaactttcttcggttaccgtttacccgtctaccggtttaccgttccggggaacgtaccgggtaccgtgggtaacgtacgtaacctacccggtaaagtaccggttgtacccggngttaccaccggtacttcgtccggttacttcgttacccttccgg

SEQ ID NO: 188957 - DNA, 837 bp, Homo sapiens
  misc_feature: GYAE6OF02IB3Q3.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctcgtgttgctcgtggatctcgtggtcgaccctggcggggacgttcgttttgacccgtaggtcctcccgactcccgtggtctgtcgtcgtacgtggggccaggacgggcccaaccataccgaacttgaccaagtccaagtccctaacttagttttaacaccaacccgttacaaacgtaaataacgtaattaacgttagtacgtttaggaaccagtaacaaaaaccgagaccgtacgtcctccgttagacgtcgtacgtcgtacttaacgtttacggtcgggtaccggttaccgttaacccgggtaacttccgggttccgggtaacccgttcggaacccgttagttaccgtaaggttacgggaaacgggtccgggttcgtacgggtacgtaacgttacgtttacaccgttccgtaacctaaccgtacgtacgacgtccgtacgtacccgttaggccgtaacggttacgtaagtacggttagtcggttacggttaagttaaccgttttacgttccgttagttaccgtaacgtacgtaaacgtttaccgttaccgttaccgtttcccgttacgtaccggtttaccggttaccgggtacggggtaccgtaaccggtagggtaacggtaccgtaacgttaacccggtaaacgttaaccggtttaggaccggttacgttaccggtaacccgtacggtacctttacgggtttacccttcgttaacccgtttacccg

SEQ ID NO: 188958 - DNA, 778 bp, Homo sapiens
  misc_feature: GYAE6OF02G341H.53.1.A01.1.454.CMB.1.raw
tcagcgcgtatacacacgaccggtgctcgatttagacgtctcatcgagggggagctacaacaggcaggcaggggcagcaagatgtgtgcagaccaggtcttctatttctctgttgactctggatctcgtggtcgccgtggcggggtacgttcggttttcgacctagtcctcccgactccgtaggcttgtgtctcgtcgggcgtagacggtccaccatacaacgtgacgaacgtccagcctaactagtttacaaccgtacctaccgaaactaaagtaacgttaacttaacttaggtaccgttaacggtaaccaacgtaaaaccaaaaaccggtagaccgtaaccgccttaccgtacgtacgtcctacgtacctacgttacgtttacggacgggtaccgttaacccgggtaacccgggtaattcccgggtaccggttacccgtacggtaacccgttagtacgtaggttaacgggacgggttcgggtacgtacggtatagttacgttcctaaccgtcgtactaacccgtagtaccgacgctacgaccgtaggtacggtagaacggtaagtctggtacgtcgtttaagttagttacgtagtacgtacgacttaacttacgttacgtacgtttacccgtacgtttaccgtaaccgggttccggaacgggttccgaacggttaaggtacggtaacgtacgtaaccgaaggttaaccggtgtacgggtaccttaacggtcctaaagttccgtagtttaccgtaccgttaccgttaaccgttcccg

SEQ ID NO: 188959 - DNA, 830 bp, Homo sapiens
  misc_feature: GYAE6OF02GRBTU.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgccgtggcggggtacgttcgttttcgaccctagttcctccccgacctcccgtggccttgtgtctcgtgggcgaggacgggacccaccactacgaactcgactaacgtccacgacctaattacttttaacacctaccctaccaaacgtaaataaagtaactttaaacttagtaccgttacggtaaccgaacgaaaccgtaaaaaaccgaacggaaccgacggtaccccttaccgtaggacgtcctacgtccttacgttatttaccggtcgggtaccggttaccggtaacccgggtacgtccggtacccgggtacccgtacgaccgttaacttcgtaggttaacggaacggtcgggttaccgtacgggtacgtaacgttactttacctaccgttacctaaccgaacctacgtaccaggtaccgtaccgtccgtgaccggttaacggcggtacggaaagtcggttaggtacggttaacctttaggtttttaacttccgtacgtaccgtaacgtaacttaaacgttccgtttacgttttacccgtttccgtaccgtttaccgttaccgggtttcgggacccggggtaacggttaccggtagggttacggacgtaacgtaacggtaaaccggtaggttcggtaacggccgtttagaaccccgtacgttaccggttacccttacggtttacctaccgttaccccg

SEQ ID NO: 188960 - DNA, 714 bp, Homo sapiens
  misc_feature: GYAE6OF02F735G.53.1.A01.1.454.CMB.1.raw
  modified_base (235)..(235): a, c, t, g, unknown or other
  misc_feature (235)..(235): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgcggggacgttcgttttgacccagtcctcccgactcccgtggctgtcgtctcgtgggcgagagggcccaccatcaactgcaagtccagccactattttanaccacctccaaactaataagtacttaaacttagtacttcggtaccagaaccaaaaaccaggacacgcctaccgtaggagtcctgacctcctaactttacggtcggggccgtcggttaacccgggaacttcggtccggggttccccgtacggacccgtatttccgaacgttagggtaacggtccggggttcgtacggggactacggttattttaccacgttacctcccgtaaaccctacgtacccgtaagccgtaaccggcccttcgggaccacggggaccttaaggaaacgtacgttgggtcggtagttaggtttttactttcgttacgtcgtacgtacttaacgttaactttaccggtacgttttcccgacttccgttacgttcgggaccggacggtaccgaggtcggagtataccggaaacgtacggttgtacggtcctagggacccttaccgtattaccgtcttaccttgtacccg

SEQ ID NO: 188961 - DNA, 801 bp, Homo sapiens
  misc_feature: GYAE6OF02JXFYH.53.1.A01.1.454.CMB.1.raw
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
tcagcgcgtatacacacgaccggtgctcgatttagacgtctcatcaagggaaggaagggggtgggtccaggaggcagaactctgggtgtctcaccatggcctggatcccctctacttcctccccctctccactcctctagctacaggcctcgtgacggtccctccgttanggtagtcctaggacactacgtccacccgtcggtntcgtggttcgtccgtcgaggaaccaggccggacgtaaggtcctaccaccgttcggccttccgtacgggacgtaagttcgaccttaccggtagaaacccttaaaaagtaaggttntacggttaccgttaccgtccggtaacncggtaccgaacgtacggaccacggtccgaccggtccctcggttacgttacggtattacgtttaaataaacggttacgtttggacgggtaacccgttcccgtacggtaacccgggacccttgggtaacgtccttacgttcctacggtccgtaaccgtcggtaaacgtccgttacggaaccggtaactaaccgcgttacggcccttacggtaacgtacctcgacggttagccgttcccgggaactagggaccgaggtcgtacgtagtacgttaccttaagtccggtaagtcgaccgtaccaaaggaccgttcgaaccgttagaccggttcttaacggttcgttaacgtaccggggtttctacggggtacgttaacggtcccgtaacgccggtaccgggtaaccttcggtaacccgtggttacccgaccggtaccgtccgttacccccgtcgtacccgg

SEQ ID NO: 188962 - DNA, 758 bp, Homo sapiens
  misc_feature: GYAE6OF02J0RHO.53.1.A01.1.454.CMB.1.raw
  modified_base (566)..(566): a, c, t, g, unknown or other
  misc_feature (566)..(566): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctggccgggtacgttcgtttgacccagtcctcccgactccctggtctgtcgtcgtcgtgggcgacggacggtcccaccgactcgaacgtgaccaacgtccacgaccctaacttactttaaccgtaacctaccctacctaaaactaaagtaacgtaacttaaacttcgtcgttacggtaacctagaaaccaaaaaccgaggaacctacgtaccttaccgtagagccgttgcctacgtaactttacggtcgggtcctaccggtaaccggtaacgtcggtccgggtcccacgtaccgtatctaggtacggaacggtccggtcgtacgggtaactacggtactttaccgactccgtacctaactacgtacgacgtacaccgtcgtcgtacgagtaccgtagacgttagtacggttagtcgttacttttattcgttntacgtacgttataaccgttcttaccgttacgttccgttacgttaccgttcggttaccgggaccgggtaccgggtaaccggtacgggtagaacgttaacggtaaccgtaaccggttacggtacggtacccggtaccgttacggtcccgttaaccgtccggttaaccgttctttacccggtccctttaccccgg

SEQ ID NO: 188963 - DNA, 759 bp, Homo sapiens
  misc_feature: GYAE6OF02FN2LP.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgcctggcggggacgttcgttttcgaccctagtccgtccccgactccccgtggctggtcgtctcgtgggcgaggacgggccaccatacaactgaccaacgtccagcccaacttattttaactacctacctaccaaacaaataagtactttaaacttagtacgttacggtaaccaagtaaccaaaaaccgacggtaaccacggtccctactacggacgcctacggaccttacgtaacgtttaccgtcggggtaccgtaccggtaacccgggtaacttccggttacggggtcccttacggaccgtattcgtagttcgggaacggtcgggtacgtagggactagtcttacgcctctaccacctatacgacggtacgaccgtccgtcggacgacggtacgtaggtacggtacgtacgggtcggtacgtttacgtttacgtttacgtcgttacgtacgtactacttaccgtttaccgttacgtttcccgtacgttaccgttaccggttacgggtaccccccggtagggtacccgtacgggtacggtacgaacggtaaccgtaaacggtacggtacgggtacggttaccgtacgtccgtaccgtacgttccgttacgtttacctaccgttacccg

SEQ ID NO: 188964 - DNA, 717 bp, Homo sapiens
  misc_feature: GYAE6OF02I56II.53.1.A01.1.454.CMB.1.raw
  modified_base (133)..(133): a, c, t, g, unknown or other
  misc_feature (133)..(133): n is a, c, g, or t
  modified_base (582)..(582): a, c, t, g, unknown or other
  misc_feature (582)..(582): n is a, c, g, or t
  modified_base (683)..(683): a, c, t, g, unknown or other
  misc_feature (683)..(683): n is a, c, g, or t
tcagcgcgtatacacacgaccggtgctcgatttagacgtctcatcagggggagctacaacaggcaggcaggggcagcaagatggtgttgcagacccaggtcttcatttctcttgttgctctagatctctggtncctggcggggtacgttgttttcgacccagtcctaccccgactcctgggctgtgtctgtggcgacggacggccacctatcaactcggacaacgtccagaccctactaatttacacctaaccctaccgtaaacaagttaagactttaacttacgtaccttaccggtaaccagtaaaacccgtaaaaccgcggtaaccgaccgccgttaccgtgacccctagtcgaccttacttaacgttcgtcgggtacctacccgttaaccgggtaacgttaccgggttcccgggtaccttacgaaccggttacttaccggtaatttacggggaacgttccggggttacggtacggggaacctagttaaccgttactccgtaccctacgactacgtaccgaacgactcggaccttccggagtagtacagtaacgtgtcggtcggtacgttacttttagtntcgtacgtacgtaataccgtttaactcggtttaaccttccgtacttacgttacgtacgtaacggtcggaacgtagggtgacgtacgtaacgaacgttaagnggtacagtcgaacgctagtcgtctaccgtgtacc

SEQ ID NO: 188965 - DNA, 715 bp, Homo sapiens
  misc_feature: GYAE6OF02IUP3R.53.1.A01.1.454.CMB.1.raw
  modified_base (160)..(160): a, c, t, g, unknown or other
  misc_feature (160)..(160): n is a, c, g, or t
  modified_base (338)..(338): a, c, t, g, unknown or other
  misc_feature (338)..(338): n is a, c, g, or t
  modified_base (579)..(579): a, c, t, g, unknown or other
  misc_feature (579)..(579): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtcgcctggccgggacgttcgtttcgacccngtcctcccgactccctggctgtgtctcgtgggcgaggacggccacactacaactgacgagtccagccacttaacttttacacctacctaccaaactaaactaagtactttaaacttagaccgtttacggtaaccaagaaaccaaaaaccgaggaaccacgtccctacctgacgtcctntcctacttacgtttacggtacggggtccgtacccgtaaccgggtaacttccgggttacgggggtacccctaggacccgttattaccgtaggttacgggaacggttcgggtccggtaggacgtaagttacttactaacctcgtaccaacctacgacgcgtaccgacgtccgtagaccggtacggtactaaggtaacggtgtacggtcggttaacgtttacgttttaacgtttcgtacgttanacgtactaacgttcttacgttacgtttccgacttcggtaacgttccgggaacgggtaccgtacgggtaggtcgacgtaactaaccggtaaacggtcgtaggtccgcgtacgcctactccgttgtctagtacctccg

SEQ ID NO: 188966 - DNA, 756 bp, Homo sapiens
  misc_feature: GYAE6OF02HWKC6.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtcgcctggcggggacgttcgttttcgacccagtcctcccgactccctggctgtcgtctcgtgggcgaggacgggccaccatccaactgacaacgtccagaccactatttacaccacctaccaaacaataagtaattaacttagtacgttacggtaaccagaaccaaaaaccgaggaaccacgaccctaccgtagacgtccgtacgcttacctacgtttacgtcgggtccgtaccgtaaccgggtaacttccggttaccggggtccctacggtaccgtacttacgtaggttacggacgggtccgggtcgtagggactaagttacttaccgtacttacctaccgtaacctacgtacgacgtacgtacgccgtacgacgacggaccgtaaggaacgtacggtacggtacggtacttaaggttttctttacgacgttacctacgtactaacgtttaccgttccgttaccgtttaccgaccgtttccgttaacgggtttcccgggacgggtaacccggacccggtaagggttacgaacggtaacttaaccggaaacggttaccggttcgggacgttacccgtacggtacctaaccgtacgtttaccggtacgtttaccctacgttaccccg

SEQ ID NO: 188967 - DNA, 898 bp, Homo sapiens
  misc_feature: GYAE6OF02FZUI0.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgccgtggcgggacgttcgtttgacccgagtctacccgactcccgtggctgtgtcgtcgtgggcgagcgggccaaccatccaactcgacaacgtcccaagaccctacttagttttacacctaccctacccaaaactaaagttaaacgtaactttaaacgtttacgccgtttaacgggtaaaccctaaaggaaccctaaaaaaacccggtaacggaacctaaccgggtaaccccttacccgttaggaacgtaccgttaccgtaccttacgtaaaccgttttacgggacggggttaccgttacccggtaacccgggtaaacgtccgggttaccggggttaccctacggtaacccgtaagtttccgtaaggttacgggtaacggggtccggggtacgttacgggggaacctaggttaaccgttttaccaacctttcccggtaccctaaaccgtaactttccgggaaacgtccgtaacgttccccgtaaggacccgtaacgggtaccggtaaacggtaaaggtaacgttggggtcggtaaccgtttaagttttacgttacggttacgtaccgtaaatacgttaaacttaaccgtttccgtttaacccggtttacccgtcctttaaccgggttacccgttccggggtaacgggtaaccgggtcccgtaggggttacggtaagttaaccgtaaccggtaaacgtaaccgttgggtacccgtcggttaaccgcgttaaccgtttccggtaccttacggtaccttaccgttacccg

SEQ ID NO: 188968 - DNA, 724 bp, Homo sapiens
  misc_feature: GYAE6OF02JVM9U.53.1.A01.1.454.CMB.1.raw
  modified_base (575)..(575): a, c, t, g, unknown or other
  misc_feature (575)..(575): n is a, c, g, or t
tcagcgcgtatacacacgaccggtgctcgatttagacgtctcatcagggggagctacaacaggcaggcaggggcagcaagatggtgttgcagacccaggtctcattctctgttgctctggatctctggtgcctggcggggacgttgttttgacccagtctcccgactcccgtggctgtgtctcgtgggcgagacggccacactcaactgcaacgtccaagccaactagttttacaccacctaccaaactaataaataactttaaccgttagtaccgttacggtaccctaagaaacctaaaaaaccgacggaacgacgtccccgttcctaggacgactcgtacctctaacgtttaacggtcgggttccgtaaccgtaacccggggtaatccgggttccggggtacccctacggaccgttacttacggtaaggttaggaacgggtcggtcggtaggacgtacgttacttccgtactctaccgtactaatccgagtaccgacgtccgtcgaacgggtcgaggaccgtaagtacgtcgggttaggttactacggttttattcgttacgtcgtaaacgtntaaacttccggttaacttcgttttaccgactttaccggtaccggtttacgggacggggaccgtaccgtagggtacgaacgtaccgtagaacgttggtacgtccggtcgtactaaccctgtaccgttctaacggttcttaaccgttcccg

SEQ ID NO: 188969 - DNA, 762 bp, Homo sapiens
  misc_feature: GYAE6OF02FLSG0.53.1.A01.1.454.CMB.1.raw
  modified_base (541)..(541): a, c, t, g, unknown or other
  misc_feature (541)..(541): n is a, c, g, or t
  modified_base (751)..(751): a, c, t, g, unknown or other
  misc_feature (751)..(751): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctggaccgggtacgttcgttttcgacccagtcctacccgactcccgtgtcgtgtcgtctcgtgggcgacggacggccaaccgtatacctaaccgtgactaacgtccgacgtacctaacttaagttttaacaaccaccccttaacaaaactaaaagtaacgttaaacttaacgttacgtacgttaccggtaaccaaacgaaccaaaaaaccggagaacgaccgtccttaccgtacggtagtccgtagaccttacgtaagttaccggttcggggtacctaccggttaaccgggaacttccgggacgggttaccagtaaccgtagttcgtaagttacggaacggtccgggtagtaccgggactaggttacttaccaccttacgccaactactcaacgtccacgtccggtncggtaaccgggtatagggaaacgtcgttcggggtacgtagtttacgttttaacgttcgttagaccgtagtaactactttacgttcttaacccggtttctaacctcggtttccgttacgggacggtacggtacggacgggtaagcgtaaactaacggtaaacggtagtaccggggtctaacgaccgtaccaacgtttcctcggtaaccttnttacccaccgg

SEQ ID NO: 188970 - DNA, 825 bp, Homo sapiens
  misc_feature: GYAE6OF02IFXRM.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtcacctggcgggtacgttcgttttagacccagtcctcccgactcccgtggtctgtgtctcgtgggcgaggacggaccaccgtactcaacctcgacaacgtccgacgaccacttacttttaacacctaccctaccaaactaaataacgtaactttaacgttacgttcgttacggttaacccaagtaaacccgaaaaaaccgtacggaaccgtaccgtcccgtaccttaggaccgtcgtcgtaccttacttaagttttaccggtcggggtaccgtcccggttaacccgggacgttcggttaccggggtccctacggtaccgttacgttacgtaggttacgggtaacggtcgggttacggtagggactacgttacgtttacctactaccgtaccaccgtactccgacgtccgacgtcccggtagacgacggtctaaggtaacgtgttacgggttcggtacttttaggtttacgttttccgacgtaagtccttaaacttaccgtttacttaccggttttcccgttttccctaccgttacggtttccgggtttacccgggaacgggggttacccgtaacgggttcgggtaacggaccgttaccgttaaacccggtaacgggttaccggttcgggtaccgttacgtaccggttaaccctattaccggtttcgtacccgttttacctaccggtttaaccccg

SEQ ID NO: 188971 - DNA, 611 bp, Homo sapiens
  misc_feature: GYAE6OF02FHLG2.53.1.A01.1.454.CMB.1.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (495)..(495): a, c, t, g, unknown or other
  misc_feature (495)..(495): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctctggtgcctgccgggacgtcgttttgacccagtcctcccgactccctggctgtgtctctgggcgagacgggccaccatcaactgcaagtccagccactattttacacacctaccaacaataagacttaacttagcttggtaccagacaaaaaccgnggaacacgccctcctgacnctgctcatttacgnggtccgtcgtacccgggaatcgtcggggtccctgaccgtnttcatggagtcgggtctgggacagtacttcactcgtcacatcgagcacgtcctgcgaggcctaggaacgtagttggtacggtacttaggttttaactttcgtagtacagtacctaatttactttaccgttagttttcccncgtttaccgtaccgttttacgggcggtaacgggtacccgtaggtacggtagacttaccgaaaccgtcgttacggtggacctcgacctacctacgttcgtccgtcttaccgttaccc

SEQ ID NO: 188972 - DNA, 923 bp, Homo sapiens
  misc_feature: GYAE6OF02ID2S2.53.1.A01.1.454.CMB.1.raw
  modified_base (87)..(87): a, c, t, g, unknown or other
  misc_feature (87)..(87): n is a, c, g, or t
tcagcgcgtatacacacgaccggtgctcgatttagacgtctcatcagggggagctacaacaggcaggcaggggcagcaaggatggtnttgcagacccaggtcttcatttctctgttagctctggatctctggtgccgtggccgggacttcgttttacgaccctacgtctacccggacttcccgtggtcctagttgtctacgtcgggcgaagggacgggacccaaccgaattacccgaaacgttcggaccgtaaaacggtccccaaacggtaccctaaacttaagtttttaaccaaccctaaccctaaccaaaaaccgtaaaaggtaaacggttaacttttaaaaccgtttagtaccgtttaggggtaaacccaaacggtaaaccctaaaaaaaccggtacggaaccgtaacggcccttaccgtaacggtaagttacctacggtacttaacgtaaacgttttaccgtacgggtccgttaacccggtaaccgggtaacttccggttaccgggtaccccgtggaacccgttattacgaagtttacgggaacggttcggggtacgtacggaacgttagttaaactttccgaacttccaaccgtaccgtaacgtacccgaaagcccgtaacggtccgtacgtaacgaacgggtaacctaagggaaaaccggtagtaagggttacggtaccgtttaaggtttttaacctttcggttaaaccgtcggtaaacccgttataaaccgtttaccgttaaaccgttttacccgggtttacctaccgtttaccgttaaccggtttaccggggaaccgggtaccgggttaaccgtaggggtaacggacgtaaccgtaaccgtaaaccggtaccttaaggaccggtacgttacggacctaccgtaacgttccggttacttacccgttacgttaaccg

SEQ ID NO: 188973 - DNA, 779 bp, Homo sapiens
  misc_feature: GYAE6OF02IOCAF.53.1.A01.1.454.CMB.1.raw
tcagcgcgtatacacacgaccggtgctcgatttagacgtctcatcaggggggagctacaacaggcaggcaggggcagcaagatggtgttgcagacccaggtcttcatttctctgttgctctggatctctggtcgcctggcggggtacgttcgtttttacgaccctagtcctccccgtacctccccgtggccttggttgtccgttcggtaggggacgacggacgggcccaaccgtactaccaactcgacaacggtccacgacctacttaacttttaacaccctaaccctaccaaactaaataacgtactttaaacgttagtcgtttacggaccaacgaaaccaaaaaccgaggaaccacgtcctcgtagacgtctacgtcttacttacgtttacggcgggtacctaccggtaaccgggtatccggttccgggtcctacggaccgttacttacgagttacgggaacggtcgggtacgtacggtactacgttactttactacgttcctacctaaccgtattaccgaacgccgtaacgtcccgtacggaaccgtggacgtaagaaccgtggtacgggttgtacgttacgttttacgtacttcggtactataacttaccttcgtttacgttaccgtttccgtacgtttccgttacgggttacccgggaggggtaccggtaccgggttagtaacggacgttaaactaccggtaaacggttacggtcggtaccggtaccgacgtaccctaacggttccgttagttacccgtttacgtccttacccg

SEQ ID NO: 188974 - DNA, 803 bp, Homo sapiens
  misc_feature: GYAE6OF02J1ODQ.53.1.A01.1.454.CMB.1.raw
tcagcgcgtatacacacgaccggtgctcgatttagacgtctcatcagggggagctacaacaggcaggcaggggcagcaagatggtgttgcagaccaggtcttcatttctctgttgctctggatctctggtgcctggcggggtacgttcgttttgaccagtcctcccgactccctggctgtcgtctcgtgggcgagacgggccacatcaactgacaacgtccacgccatatttacaccaccccaaatactaagattaacgttacgtcttcggtacacgaaccaaaaacgcgtacacgtcctaccgtgacgctgacctacttacgtttacgtgggtaccgttaccgtaaccggggtaattccgggttaccgggggtccctacgggtaacccggtactttacgtaacggtttacggggaaacgggtccggggggtttaccgacggggtaaccgtaaggtttaacccttttccgacccgtttaccttacccgtaacctaacggtcccgaacgtacgtacgtaccgttcgacggtacggaacgttacggaaacgtacgttcgggtcgtaaccgtttagttttacgtttacccgtcgggttaactacgtaccttaaacgtttacccgttttacggtttaccgtttttacccgaccgttttaaccgggtttacccggtttacccgggggaacgggtaacccgggtacccggttaaggggtacgttaaccggtcgttaaaaccggtaactaaccgggttgtacgtaccgacgtacctacgtaccgtcttacggtcgttacgtaccttcccg

SEQ ID NO: 188975 - DNA, 814 bp, Homo sapiens
  misc_feature: GYAE6OF02GZOBQ.53.1.A01.1.454.CMB.1.raw
tcagcgcgtatacacacgaccggtgctcgatttagacgtctcatcagggggagctacaacaggcaggcaggggcagcaagatggtgttgcagacccaggtcttcatttctctgttgctctggatctctggtgccgtcggccgggtacgttcggttttcgacccgtagtccctccccgtacctcccgttgggtcttcggttcgtcctcgtcggggcgacggacgggcccaacctataccgaactgacgtaacgtccacgccaattaacttttacgacctacctaaccaaacaaataacgtaacttaacttacgtcgttacggtaaccacggaaaccaaaaaccgaggacaccgtacctccgtaggactccgtcgaccttacgttaacggtttaccggtcggggttaccttacccggaaacccggggttacgtccgggtttacccggggtccctacggtaccgtacttacgtagtacgggacgggtcggttcgggtagggactacggttacttaccgtactaccgtaccacctacgtccgtaacgtccgccgtaccgtacgacggtacggtacgtaggtaacgtggttacggtacggttacgtttaaggttcgtttcggtcgttaccgcgtacttaaacgtttccgtttaccgtttaaccgtttccgtaccgttccgtttaccgggttccggggtaacgggttacccggtaccgggtagggttacgggaacgttacggtaaccggtaaacggttacggtcggtacgtaccgttcgtacgtaccgttcgttcgtttacgttcccgttacgttacccg

SEQ ID NO: 188976 - DNA, 658 bp, Homo sapiens
  misc_feature: GYAE6OF02JU52T.53.1.A01.1.454.CMB.1.raw
  modified_base (120)..(120): a, c, t, g, unknown or other
  misc_feature (120)..(120): n is a, c, g, or t
  modified_base (126)..(126): a, c, t, g, unknown or other
  misc_feature (126)..(126): n is a, c, g, or t
  modified_base (132)..(132): a, c, t, g, unknown or other
  misc_feature (132)..(132): n is a, c, g, or t
  modified_base (173)..(173): a, c, t, g, unknown or other
  misc_feature (173)..(173): n is a, c, g, or t
  modified_base (308)..(308): a, c, t, g, unknown or other
  misc_feature (308)..(308): n is a, c, g, or t
  modified_base (500)..(500): a, c, t, g, unknown or other
  misc_feature (500)..(500): n is a, c, g, or t
tcagcgcgtatacacacgaccggtgctcgatttagacgtctcatcagggggagctacaacaggcaggcaggggcagcaagatggtgttgcagacccaggtcttcatttctctgttgctcngatctntggtcncgtcggcggggacttcgttttgacccagtctccgacctccnggctgtcgtctcgtgggcgaagtcgggcccacattacgaacgtcgacgaacgtccacgacctacttattttacaccaccttaccaaaacgtaacgttaagtactttaaacccgtgttacttacgggaaccctaanaaaaccgaaaaccgtagggacctacggtcccctaggtaagccgtactcggacttcctaagtttcggacggtcctccgaccggtatccgtacgggctcgaacgtctacgagttcggacggtgggtctaggacacggttctacgactcttaccacgatacgactacacgtctacggcgaacggtcacgtaacgnggttacgtgtactttaggttacttcgactacgatacgtaacttacgttccgtacgtttccgacttacgtcgtagggaccacggtaccgagttgacttaagtaccgtaacgtgtacgtacgtctaagcccgcgttacttccgtagttacctattcccgg

SEQ ID NO: 188977 - DNA, 660 bp, Homo sapiens
  misc_feature: GYAE6OF02IET2X.53.1.A01.1.454.CMB.1.raw
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
tcagcgcgtatacacacgaccggtgctcgatttagacgtctcatcagggggagctacaacaggcaggcaggggcagcaagatggtgttgcagacccaggtcttcatttctctgttgctctggatctcgtggtgcctggcggggacgttcgttttcgacccagtcctccgactcccgtggctgtgtctcgtaggcgagacggccaacatcaactgacagtccagccatatttanaccactacaaacaataatattaacttagacttagaacctaagaacaaaaaccngaactacgaccctacctagaacgtctacgtccgttactacgttttaacgccggggtccgtaaccgtacccgggtaaagttccggtaccgggtccctacggtaccgtattacgtacgttaacggacggtcgggtctagggactagtcttacgactcgtaccacgactacgaggctacggactacggcgaaggtctaggaaacgtagtacggtgacttaagtttcgttacgtgtacaacgtactaacgttacgttcttaccgttacgccttacgttcgttaccgggacggaccggtaccgaggtcggtaacgaagtaccgaaaccgtaggttcgcggaactcggaccacgtacgttcggtatcccgtattaccccg

SEQ ID NO: 188978 - DNA, 703 bp, Homo sapiens
  misc_feature: GYAE6OF02H6GI7.53.1.A01.1.454.CMB.1.raw
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagcgcgtatacacacgaccggtgctcgatttagacgtctcatcaggggggagctacaacaggcaggcaggggcagcaagactggtgttgcagacccaggtcttcatttctctgttgctctggatctctggtcgccgttggcgggggtacgttcgttttcgacccagtcctacccgtacctcccgtggcttagtcgtctcgtgggacgngacggaccaccatcactganagtccagcctatatttacaccgcctaccaacaataagtattaacctagtcgttacggtaccagaaaccaaaaccgaggaacctacgacccttcgngtacgtctcnccgttactactttacgtacgggtccgtacccgtaccgggtattcggtccggggtacctacgggtaccgtacgttctacggttggaacggtcggtcgtacgggactagtacgtttcacttcacactactacgacgcacggtcctacgacgtaggactagggaacgttcgtgggttacggtctttaacggttttacttccgttaagcgttaacgtactacttaccttacgttttaccgtttccgtcttccggttaccgggtttccgaccgggtacggtaaccgtggggttaacgacgtaacgttacggaacctacggttagggtcgttacgccttaccaccggttcttaggttcctttaccgtcttcccg

SEQ ID NO: 188979 - DNA, 519 bp, Homo sapiens
  misc_feature: GYAE6OF01DR1O9.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcaacagttacaggtgtccaggcccaggcccacctggtgcaatctggggctgtggtggagaagcctgggtcctcggtgagggtctcctgcaggtcttctggcggctccatcagcagatacactttcaactgggtgcgacaggcccctgggcaaggccttgagtggctgggaagggtcatccctctccttggagtctcaacctacgcacaacacttccaggcagggtcactattaccgcggacaaatccacgaggacagtgaacatggaactgagcggcctcagatctaatgacacggtccgtttatactgtacacgacgatcccggcgcacaatgaagaatgattaggacttttatactaccactgtctcgg

SEQ ID NO: 188980 - DNA, 536 bp, Homo sapiens
  misc_feature: GYAE6OF01EIRAM.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttctggcggctccatcagcagatacactttcaactgggtgcgacaggcccctggggcaaggccttgagtggctgggaaggtcatccctctccttggagtctcaacctacgcacaacacttccagggcagggtcactattaccgcggacaaatccaacgaggaaagtgaacagtaggaactgagcggcctcagatctaatgacacggtcctttattactgtacacgacgactcccggccgcaccaagtagaagaatgaattaggtactttttatactaccactacggtctacggg

SEQ ID NO: 188981 - DNA, 560 bp, Homo sapiens
  misc_feature: GYAE6OF01C7WZQ.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttcgtggcggctcatcagcagatacactttcaacgtgggtgcgacacggccccgtgggccaaggccttggagtggcgtgggaagggtcacgtccctctccgttggacgtctcaacctacgccacaactacttccgagggcagggtcactacttaccgacgacaactccaacgaaggaaagtgaacagtacggaactgagcggcctacgagtactactaagtcgacgacggtccgtttatactagtacacgacggactcccggcgaccacaagtagaagaatgagttagtacttttactactaccacttcgtcgtacgg

SEQ ID NO: 188982 - DNA, 660 bp, Homo sapiens
  misc_feature: GYAE6OF01C2XC4.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctggtggtggagaagcctgggtcctcggtgagggtctcctgcaggtcttcgtggcggctccatcagcagactactactttcaacgtgggtgcgacgacggccccgtgggaccaagggtcctttggaggtcggcgtggggaagggtcacgttccctcgtccgttggagttcctaccaacctacgcctacaactaccttccgagggctacgggtacacgttacgttaccgacggaacaaactccgaacggacgacagtacgaaacgtagtacggaactggacgtccggcctagacgtatacgtaagtcgaaccgtacggttccgtttaatacgtacgtaacgacggtaaccggtaccgtccccgggaccgaccgaaccgtaacaaggaaaacgtaaacgttaggtaactttaacggttaaccttttttaactaacccttaaacccgtacgttaaccgggtaccgg

SEQ ID NO: 188983 - DNA, 547 bp, Homo sapiens
  misc_feature: GYAE6OF01BRNMO.23.13.B02.1.454.CMB.1.raw
  modified_base (197)..(197): a, c, t, g, unknown or other
  misc_feature (197)..(197): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggntccgtggtggagaagcctgggtcctcggtgagggtctcctgcaggtcttctggcggctccatcagcagatacactttcaacgtgggtcgcgacaggcccctggggcaaggccttgagtggcgtgggaagggtcatccctctcttggctctcaacctacgcacacacttcaggcaggtcactattaccgcgacaactccgacgaggaagtagaacagtaggaactgacgcggtcctacagatctaagtgacgacggtcgtttattacgtacgtacacggacgactcccggccgacaccaagcgaaagatagacttaagttacttttactactacctacttacgtcgtacgg

SEQ ID NO: 188984 - DNA, 603 bp, Homo sapiens
  misc_feature: GYAE6OF01B33MA.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttctggcgctccatcagcagatacactttcaactgggtgcgacacggcccctgggcaaggccttggagtggcgtagggaagggtcatccctctccgttggacgtctcaacctacgcaacaacacttccgagggcagggtcacgtagtaccgcggaacaatccgaacgaggacagtagaacagtaggaactgacgccggcctacaagatactaagtgaactaccggtacgtttattacttagaaccgtacggaaccggacgtccccggaccgtaccaacccgtaagtaggaaacgtaaagtaggtaacgtttaagggttaacctttttaactaacccttaaccgtaaccgtacggttaccgg

SEQ ID NO: 188985 - DNA, 736 bp, Homo sapiens
  misc_feature: GYAE6OF01ANFE5.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctgtggtggagaagcctgggtcctcggtgagggtctcctgcaggtcttcgtggcgctccatcagcagactactactttcaacgtgggtgcgacacggccccgtgggaccaaggccttggaggtggcgtggggaagggtcacgtccctcgttccgttgggacgttcctaccaaccgtacgaccaaccaacctaccgttcccggaacggggccgtaacggggttccaacgttaaccgttaccccggacgggaacctaaacgtcccgaacggaggaccagtacgaaactagtacggaactggacggccggtaccctacgaagtacttaccgtaagtcgaaccgtaccgggttaccgttttaactaaccgttacggtaacccgaaccgggtaaccgggtacccgtcccccggggacccgtaacccgtaaacccgtaaagtaacggtaaaacggtaaagttacggttaaacgttttaacggttttaaaccctttttttaaacgttaaacccttaacccggttaacgtttaacccgggttaccgg

SEQ ID NO: 188986 - DNA, 560 bp, Homo sapiens
  misc_feature: GYAE6OF01B0CIT.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttctggcgctccatcagcagatacactttcaacgtgggtgcgacacggcccctgggcaaggccttgagtggcgtgggaagggtcatccctctccgttggactctcaacctacgacacaacacttccgagggcagggtcactacgttaccgcgaacaactccaacgaggacagtagaacatacggaactgagccgctcgagatactaagtcgactacggtccgtttattacgttacgtacacggaacggacgtcccggccgaccaccgaagtagaagaaatgtattaggttactttttatactacctacgttcggtacg

SEQ ID NO: 188987 - DNA, 722 bp, Homo sapiens
  misc_feature: GYAE6OF01BVYZK.23.13.B02.1.454.CMB.1.raw
  modified_base (239)..(239): a, c, t, g, unknown or other
  misc_feature (239)..(239): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctgtggtggagagccgtgggtcctcggtgagggtctcgtgcnggttctcgtggcgctcatcagcagatactactttcaacgtggtacgcgtacgacggccccgtggactaggcctttaggaggtcggacgtaggggtaacggtctacgttcctcgttcgtaggtcgttctaaccgaaccgtacgaacctaacgtaccttaccgagggtactacgggtacaacgttactaccggacggtaactagtaccgagacggtacaggttagaaactaggtacggtaactggtaacggcgttaccgacaaggtactacgttaacgacggtaaccgaaccggtttaccgttttaagtacccgttagtaaacgtaacccggaacgggttaacccctccccggggttaaccgaccgaaacccgttaaacgggtactaaaacgggaacgttaaccgttaaacggttttacgtttaaaaccgttttaaccttaacccggttaaaccgttacggttaaacgggtttcccgtacggggg

SEQ ID NO: 188988 - DNA, 758 bp, Homo sapiens
  misc_feature: GYAE6OF01DDSE3.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctggtggtggagaagccgtgggtcctcgggtgagggtctcctgcaggtctcgtggcggctccatcagcagatactactttacgacgtgggtgcgacgaccggccccgtggctaacggtccgttgacggtggcgtaggggaacgggttcacgttccccgttcgttcccgttagggtacgttaccctaccgaaacccgttaccgacctaaaccaaccttaccgtttacccggaagggggtccgtaacggggttacctaaccgtttaacgttacccgggaacggaacctaaacgtacccgaacggaacggtaaccgtaacggttaacggaaacctaggttaacgggaacgttacggaaccgggtccggtaccctacgtaacgtacttaaccgtaacgttcggaaacccgtaccgggtttacccggttttaaacttaccgtaggttaaccgaaccggtaaccgggtactcccccgggacacccgtaaccgtaaacgtagaaacgtatacggtaagtttaacggttactttttaactaaccctacgtaacccgtacgggttaccgg

SEQ ID NO: 188989 - DNA, 590 bp, Homo sapiens
  misc_feature: GYAE6OF01BTNKQ.23.13.B02.1.454.CMB.1.raw
  modified_base (569)..(569): a, c, t, g, unknown or other
  misc_feature (569)..(569): n is a, c, g, or t
tcagacgcgagtatcacgaccggtgctcgatttagtctagcgacttccgcggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttcgtggcggctccatcagcagatacactttcaacgtgggtgcgacacggcccctgggcaaggccttggagtggcgtggggaacggtcacttcccctcgtccttggacgtctaccaacctacgaccaacaactaccttccgagggcagggtcactacgttaccgcggaacaactcccgacgaggacagtagaacagtacggactggagccggccgtagacgacgtacgtaagtcgacgtacggtaccgtttatacgtagtactacggaaccgtacgcccggccgacgaaccgaatagaaacgaagtagaacgtttacgttacttttanaaccttacctacgttcggtcg

SEQ ID NO: 188990 - DNA, 635 bp, Homo sapiens
  misc_feature: GYAE6OF01ASK7F.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctgtggtggagaagccgtgggtccgtcggtggagggtctccgtgcgaggtcttcgtggcgctccatcagcagatactactttcaacgtgggtcgcgacgacggccccgtgggacaacggtccttggagtggcgtagggaaggtcactcccgtctccgttggagtctacaaccgtcgcacacgtactccgagggcacgggtcactacgtccgacgaacaactccgaacggaggaaacgtcgaaactagtagaacgtagacggccgactacgagtactacaacgtacgaacgtacggttaccgtttagtaccgtagtaacgtaccggaacggtacccgtaccgggaccaccgtaacgtaagtacgaaggaaacgttcggtaaacgtttacggttaactttttaactaacccttaacgtaccgttaacgggttctaacggg

SEQ ID NO: 188991 - DNA, 764 bp, Homo sapiens
  misc_feature: GYAE6OF01A17P2.23.13.B02.1.454.CMB.1.raw
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacgaggtcgtccgaggcccaggccccaccgtggtgcaagttcgtggggctgtggtggagacgcctgggtcctggtgaggtctccgtgcgtggtcttgcggcgtctccntcgacgngagtactacgtactttacaacgtcgggttgacgtacgacggcccccgtgggtaccgaggcccgttaggaggtggtcggtaggggtacgggtcctaacgtccccgttccgttaccgttggtacggttacctaccgtaaacccgtacgaccctaacgaaaccccgttacgttcccggaacggggtccgtaacgggtaacccgtactttaacggtacccgggtaccgaacgtaaactcccgaacgtacggaacgtaagtacggaactaggtacggaacgtggacggccgtccgtacgaagtctaacgtaatcgtaacccgtaacggttcgttttaaacgttaccgtaggttaacccgaacgggtaaccgtacccggttacccggaccgtaccctaaacggtactaaggtaaaaccggtaagttacggttaaacgttaacgggtttttactttaaacgtttaaccccgtaacccgttaacggtttcgggtaacccgg

SEQ ID NO: 188992 - DNA, 737 bp, Homo sapiens
  misc_feature: GYAE6OF01EANVQ.23.13.B02.1.454.CMB.1.raw
tcagacgcgagtatcacgaccggtgctcgatttagtctagcgactttagggtttagggggtccaaacgagagcttctagcaacgcatagtgggaatctgcaccatggcccgggctctgctcctcctgaccctctcactcactctgcagtgtcagtggtccaggcaggcctgactcacgccccctgatgtaccaaggacatgacgacacgaccgaccacactccaccgtgaccacgacgggaaccaccaaacaagttgttacggaccaaaccgaaggacgacgtaaggtcctttagggttacgcgaacgccgacgccgaaccgaccggggcccctaaccccgtacccaccgtaccgttcccgtacgtaccctaacgaacggtaaactaacccggaacccggtcccgtacgaacggtactaccgtacgaggacgttagttactttcgacgtctaacgtccgaacggtacgaacggaccgtacgaccgtaccttacccgtactaccgtacgttacgacggtaccctaccgtacgtcggtaacggacgtaaccggtggtaccttacgtaactttaagtttcgtttacgttacgtcgtaacggtcggtaccaacgtcgtaacctcggtacgttacggtcgttagggttccgggtacgggaccggtaacgggtactaccgggttcgtaccggtacccgttacgggtacgttaccgacccgaaccgtacggtcccgtaccccgg

SEQ ID NO: 188993 - DNA, 840 bp, Homo sapiens
  misc_feature: GYAE6OF01C9FBN.23.13.B02.1.454.CMB.1.raw
tcagacgcgagtatcacgaccggtgctcgatttagtctagcgacttccggcgggggcatcacataacaaccagattcctcctctaaagaaggccccgtgggagcacagctcatcaccatggactggacctggaggtgccttctttggtggtggcagtcagttacgaggtgtccacggcccgacggcccaccgtggtgctaagttccggtggggcttgggtggtgggaagtaacggtccgttgggtcccgttcgggtcggtacgggttcctccgtcggacgtggttccgttcggtcgggccggtcctccgtaactcgacgtaccgtaagtaaccttaccgttacctttaccggtaacggttcggggtacgaccgaccggtaccggtcccccgggtagggaccgtacggtccgttaggtgggtcgggtacgggtaacgggggtaccgttactacccgtttccccgttcgtccggttagggtaccttcccgttaaaccccgtaaaccgtaccctaaccaaaccgtaaccctacgggtccgaacgggtccgtacggtaacctacgtttaccggaaccggtaccgtaacgtaacgtcccggaacgggtaacgactaacggtaacgtaacgaggttaaccggaacgtaccggacggtccggaccttagaagtaaccagtaacgtccgaacggtttaccggtttaatttacggttaacctacggtaacggtacgggaacccgtccggtacccgacccgtaaccgtaacgtaaggaacgttaaagaacgttagtttaaacggttacgtttaacgtttaaccactttaccggtaaccgttgggtaaccg

SEQ ID NO: 188994 - DNA, 859 bp, Homo sapiens
  misc_feature: GYAE6OF01AD1EG.23.13.B02.1.454.CMB.1.raw
  modified_base (235)..(235): a, c, t, g, unknown or other
  misc_feature (235)..(235): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcaacagttacaggtgtccaggcccaggcccacctggtgcaatcgtgggctgtggtggagagcgtgggtcctcggtgaggtcctctgngaggttcttcgtggcggtctccatccgagcagactactactttacaacgtgggtcgccgacgccggccccgtggggacaacggccgtttaggaggtgggacggtagggggaacggtctacccgtccccgttcgttccgttgggtacctccgtaaccgtaacccgtaccgacctaaccgtaaaccgtacccgtttacccggaaggggtaccggtaaccggggttacctaaacccggttaccgtttaaacccggggaccggtaaaaccgtaaacccgttcccggaaaccgggtaaccgggtaacgtaacgggttaaacggaaaccgtaagggttaccgggtaaaaccgttgggaacccgggtcccggtacccgttaacggaacgttaccgtaaccgttaaacgtaccggaaccggttaacccggttaccgtttttaacgttaccgtaaccggttaccgaacccgggtaaccggtacccgtccccgggacccgtaacccgtaacccgtaaaggtaaccggtaaaagtaacgttacggttaaaacggttttaacggttttaaacctttttttaacccgtaacccgttaaacccgtaccggtttaaccgggttccggtttaaccggggg

SEQ ID NO: 188995 - DNA, 690 bp, Homo sapiens
  misc_feature: GYAE6OF01BZNLT.23.13.B02.1.454.CMB.1.raw
  modified_base (254)..(254): a, c, t, g, unknown or other
  misc_feature (254)..(254): n is a, c, g, or t
  modified_base (334)..(334): a, c, t, g, unknown or other
  misc_feature (334)..(334): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctggtgggtggacgaagccgtgggtcctgggtgagggtctcctgcgaggttcttcgnggcgctcatcgagcgagatactactttcaacgtgggtcgacgtacgacggccccgtggacaacggtccttgagtcggcgngggtaaggtcacttcccgtccgttcgtggacgtcctacgtaacctcgacaaccactaccgttaccgaggggtactagggtactacgttacgttaccggacgaactaaacgccgaacggaggtacctaggtaacgtaacgagttaacggaactggaaacggccgtcctacgaaggatacctaagtccgaacgtaccgggttacctttaagttaacgtacgtaaaccgtacccggaaaccgggcgttccccggaccgaacctaacccgtaagaacgtaaacgtaaacttaagtaaaggttttaccggtttaaactttttaccgtaaacccttaccctaaccggttacggttacccggg

SEQ ID NO: 188996 - DNA, 655 bp, Homo sapiens
  misc_feature: GYAE6OF01DDNEM.23.13.B02.1.454.CMB.1.raw
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctggtggtggagagccgtgggtcctcggtgagggtctcctgcgngtcttcgnggcgctcatcagcagatactactttacaacgtggggtgacgacgacgggtcccgtgggacgaacgggtcctaggaggtcgggcgtaggggaagggttccacgtcccctcgttccgttggagttcctaccaacccgtacgaccaccgaaactaccgttccggacgggcgtacgggtactacgtaacgtacccggacgtaactaactcccgaagaacgacagtagaactagcggaactggacgccgtctacgagtactacaagtacgacgttaccggttacgtttaatactacggttaaccacggtaacgggacccgtcccggaccgtacaacccgtaagaagaaacgttaaagtggtaaacgtttagttaacttttaaccgtacttaccgtacggttacggtaccgg

SEQ ID NO: 188997 - DNA, 953 bp, Homo sapiens
  misc_feature: GYAE6OF01BXMVO.23.13.B02.1.454.CMB.1.raw
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccaccgtgggtncaatcgnggggctggtggtggagaagccgtgggtcctcgggtgacgggtctccgtgcgtaggttcttcgtcggcggctccagtcgagcagatactactttacaacgtggggtcgacggacgacggtccccgtagggaccaacggtccgttagacgggtagggccggtagggggtaacgggtcctacttccccgtcgtttacccggttaggtaccggtccgttaaccctaaacccggtaaccgaccgtaaccctaaacgtacccgtttacccggaaggggtccgtaacggggtacctaaccgtttaacggttaccccgggaaccggtaaaccgtaaaccgttacccggaaacgggtaaacggggtaaaacgggtaacgaaaccgttaacggtaaacgggaaaccggttacgggtaacggtaccccgggaccgttaaccggtaaggtaaccgtttaaccgtaaacgttaccgggtaaacccggttaacccggggtttaacccgttttttaaacgtttaacccgggttaacggtttaaacccggaaacccggggtaaacccgggtaacccggttacccccggggtaacccggaaaccccgtaaaacccgttaaacgggttaaacggaaaacgggtaaacggtttaaccgggtttaaacggtttttaaaacccgggtttttaaaccgttttttttaaaccttaaaaccccggtttaaaccccgtttaaaccgggtttaaacccggggtttaccgggttaacccgggggg

SEQ ID NO: 188998 - DNA, 731 bp, Homo sapiens
  misc_feature: GYAE6OF01BNK38.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccaccgtggtgcaatcgtggggctggtggtggagaagccgtgggtcctcgggtgagggtctcctgcgtaggtcttcgtggcggctccatcagcagatactactttcaacgttgggtcgcgacgacggtccccgtgggaccgaacggtccttggaggtcggcgtaggggtaacgggtcacgttcccctcgttccgttggacgttcctactaaccgtcgaccaacaacgtaccttacgacgggacgtagggtaccaacgttacgttaccggacggtaaccaaacgttacccgaacggaacggtaaagtacgaaacgtacggtaacgggaactacgggaacggcccgggtacctacgaacgtacttacgtaagtacggtaaccgtacccggttaccgtttaacgttaaccgttacgtaaccgaacggaaccggtacccggtccccggaccgaccctaaacccgtaagtaacggtaaaacgtaagttacggttaacgtttaacggtttaacttttttaacgtaaccttacccgtaacggttacccggttggtacccggg

SEQ ID NO: 188999 - DNA, 860 bp, Homo sapiens
  misc_feature: GYAE6OF01A7BOM.23.13.B02.1.454.CMB.1.raw
  modified_base (638)..(638): a, c, t, g, unknown or other
  misc_feature (638)..(638): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtcgcctcgtttgtgggtggcaggcagttacgaggttgtccgacggccccaggccccaccgttgggtcgaccaagtcggtggggcgtggtgggtcggaaggtaacgtccgttcggggttccgtacgggtagggtacggggttcctccgtggtcgtacgggttcttcggtcgggccgtcctccagtcgagcgaagtacttactaaccttttcgaaggttcgggtggacccgtacggacccggtcccccgggtaggggaacgtaacggtccgttgggtacggtgggtcgggtacgggggaacgggttctaccgttccccgtacgttccgttgggtacctcctaccgtaaaccctacgactaaaccaccgtaccgtaccggacggggtacgtaccgggtactacgttaaccgtaaccgggacgtaacctaacctacccggaaacggacggtaacgtacggtaacgtaaacgaggtacggtaactacggggtaacggtccggtacccgtanaacggtagttaaccgtaagtccggaacggttaaccggtttccgtttaaagttaccggtaacgttaaccccgaagggtaaacccgtcccgggtacccgggtacccaaaccggtaaccgtaaaggttaacggaaaaaggtttaaccggaaggtttaaaccgtttacggttttaaaccttttacctttaaccgttaacccttacccggggttaacgggttaccgg

SEQ ID NO: 189000 - DNA, 944 bp, Homo sapiens
  misc_feature: GYAE6OF01EBF6V.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggagggtgtcctctttggtggtgcagcagttacaggtgtccacggcccacggccccaccgtggtgacaatcgtgggtctggtggtaggagacgtccgtgggtccgttacgggtggtacgggtcctccgtcgacgtcggttccgttcgtcgggtccggtccttccgtaacgtccgaacgacgtaacggtaacttaaccgttacctttacgtaaacggttcggggttaccgaccggtaaccggtacccgggtacccccggtcgggggaacccggtaaacggggttcccggtttcggggtaacgggttcggggtaccggggttaacgggggtaaccgggttcccgttaacccgttcccccgtttccggtttacccggtttcgggtaacccgtttacccgtaacccgtaaaccccgtacccggaaccctaaaacccgttaaacccgtaacccggttaaccgggaacgggtaccggtaaccgggtttacctaaccggtttaccggtaacccgggtaaccgtaaaccgtaaaccgtacccggaacggtacggtaacgtaacggttaacgaaaccgttaacggtaaccgggttaacgtccgggtaacgacccggttactaccgtaacgtaacttacggtaacgtaccgtaaccggtaccggtttaccgtttaacgttacgttaccgtaaccgtaaccggtaacccggtacccgacccggtaccgaaccgtaaacgtaacggtaaggaaacgtaaggtaactttaaggtttaaccgtttaacttttaccctaaaccgttaaccgtaacccggttggttaacccgg

SEQ ID NO: 189001 - DNA, 588 bp, Homo sapiens
  misc_feature: GYAE6OF02GKAX9.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttctggcgctccatcagcagatacactttcaactgggtgcgacacggcccctgggcaaggccttgagtggctgggaagggtcatccctctccttggatctcaacctacgcacaacacttcagggcagggtcactataccgcggacaatccacgagacagtagaacagtaggaactgacgccggcctacgagactactaagtcgacgacggtaccgttttaattacgttagtaaccgacggaaaccggtacgtaccccggaccgaaacctaagtacggaaacgtaaataggtaacgtttaggttacttttttaataaccttaaccgtacgttaccggttcgtacggg

SEQ ID NO: 189002 - DNA, 548 bp, Homo sapiens
  misc_feature: GYAE6OF02HMK63.23.13.B02.1.454.CMB.1.raw
  modified_base (284)..(284): a, c, t, g, unknown or other
  misc_feature (284)..(284): n is a, c, g, or t
  modified_base (390)..(390): a, c, t, g, unknown or other
  misc_feature (390)..(390): n is a, c, g, or t
  modified_base (504)..(504): a, c, t, g, unknown or other
  misc_feature (504)..(504): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcgggtgagggtctcctgcaggtcttctggcggctccatcagcagatacactttcaacgtgggtncgacacggcccctgggcaaggccttgagtggctgggaagggtcatccctctccgttggatctcaacctacgcacaacacttcgagggcagggtcactattacccgngacaaactccaacgaggacagtgaacagtcggaatggagcggcctgagatactaatcgacacgggtcctttaatactgtaacacggaacgactcccggcgacaccgaatagaanaatagaagttacgtaactttttattaactacctacgttagtacg

SEQ ID NO: 189003 - DNA, 585 bp, Homo sapiens
  misc_feature: GYAE6OF02HFL8J.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctgggctgtggtggagaagcctgggtcctcggtgagggtctcctgcaggtcttcgtggcggctccatcagcagatacactttcaacgtgggtgcgacacggcccctgggcaaggccttgagtggcgtgggaaggtcactccctctccgttggagtctcaacctcgcacaacaccttcgaggcaggtcactactaccgacggacaactccaagagacagtacgaacagtacggactggacgccgggcctagagtactacgtaagtcgaccgtacggtccgtttatacgtcgtaacaacggaacgtacgtcccggaccgaccaccgtaagtacggaaagtaacgtgtaagtttacggttaactttttactaacctaaccgtacgttaccggttacgg

SEQ ID NO: 189004 - DNA, 539 bp, Homo sapiens
  misc_feature: GYAE6OF02HI6KD.23.13.B02.1.454.CMB.1.raw
  modified_base (340)..(340): a, c, t, g, unknown or other
  misc_feature (340)..(340): n is a, c, g, or t
  modified_base (498)..(498): a, c, t, g, unknown or other
  misc_feature (498)..(498): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggccccacctggtgcaatctggggctgtggtggagaagctgggtcctcggtgagggtctccgtgcaggtcttctggcggctccatcagcagatacactttcaactgggtgcgacacggcccctgggcaaggccttgagtggctgggaaggtcatccctctccttggntctcaacctacgcacaacacttccgagggcagggtcactacttaccgcgacaaactccacgaggacagtgaacatagaactggagccggctcagatactatacgacgacggtcgttattactcgtaacacgacgactcccgcgaccacgaatacgaanaagtgaacgttagtacttttataacctacctacgtacgtcg

SEQ ID NO: 189005 - DNA, 637 bp, Homo sapiens
  misc_feature: GYAE6OF02HWACP.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtcaggcccaggcccacctgggtgcaatcgtggggctggtggtggagagcctgggtcctcgggtggagggtctccgtgcaggttcttcgtggcggtctcatcagcagatactacttcagtgggtgcgacacggccccgtgggccaaggccttaggacggttcggcgtaggggaagggtcacgtccctctccgttggtacgtctaccaaccgtcgccaacgtaaccctacgttacccgaggggccgtacggggtacaaccgtacgttacccggcggtaacaaacttccgaacgaggacagtacgaatacgtggaactggaacgcggcctacagattactaagacgtaccgacgtccgtttataaccgttacgtaacacggtaacgacgtacccgccgacctaccgaacttacgaagaactacgtagttaacgttacgtttttaagtaaccccttaagtaccccgtaggttacccgg

SEQ ID NO: 189006 - DNA, 600 bp, Homo sapiens
  misc_feature: GYAE6OF02FMAOL.23.13.B02.1.454.CMB.1.raw
  modified_base (451)..(451): a, c, t, g, unknown or other
  misc_feature (451)..(451): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttctggcggctccatccagcagatacactttcaactgggtgcgacacggccccgtgggcaaggccttgagtggctgggaagggtcatccctcgtccgttggacgtctacacctacgcacaacaccttcgaggcagggtcacttacgtaccgacgtacaaactcccgaagagacagtagaacagtacggaactgacgccggtacctcganagtactaaagtcggaacctacgggtccgttttaatacgttagtaacgacgaacggactacccggccgacaacctaagtacgaaacgtaaacgtcgtaagtttaacggttacttttttaacgtaaccttaaccgtaccgtacggttacgg

SEQ ID NO: 189007 - DNA, 865 bp, Homo sapiens
  misc_feature: GYAE6OF02HIC0G.23.13.B02.1.454.CMB.1.raw
tcagacgcgagtatcacgaccggtgctcgatttagtctagcgacttccgcggggggacgatcacataacaaccagattcccttcctcctaaaggaaggtccctagggacgcaccagtcgtcatcaccatggactggcctggaggtgtcctctttgtgggtggcgagccagttacgtacggttgtccacggtcccttaggcccgtaccgtcggttcgcaatcgtgggctggtgggtggagacggtcggtagggtccgtcgggtgggtacggggttccttccgtcggaccgtcggttccgttcgtcgggccggtccttcccgtagtaccgtacggtacctaacgttaccttaccgtaaccttttaccgaacgttcggggtacgtccggaaccgtccgggcccccgtaggggtacccgtaacgggtcccggttaggacggttcgggtcgggtacgggggtaacgggtcctacgttccccgtcgtttaccgttgggtacgttacgtaccgtaaccgttacggtacccaaccgtaaaccctacgttaccggaaacgggtccgtacgggttactaaccggttaaccgttacccggaacgtaaccaaaccgtccgaacgtacggacgtacgtaacaaacgtacttaacggtaacgtaggtacggtccggtaccgtacgaacgtaacgttcgtaaacgtcgtaaccgtaccggtacgtttaacgtaccggttaacgtaaccgtaaccggtaacgttaccggtacccgtactaaccgtaccggtaagtaacggtaaggttaacggttacggtacgttttaacgggtttaccttttaaaccggttaaccgttaccgtaacgtttacccggtccgg

SEQ ID NO: 189008 - DNA, 838 bp, Homo sapiens
  misc_feature: GYAE6OF02HL03A.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtgggctggtggtggagagctgggtcctcggtgagggtctccgtgactaggtcttcgtggcggtctccatcagcagatactacttcaacgtgggtgcgacgacggtccccgtggggaccgaaacggtcccgttggtaggtcgggtcgtagggggtaacgggtctaaccgtccccgttccgttacccgttgggacggttcccttacccgaaacccgttaaccggaccgtaaaccaaacccgttaaccgttacccggacggggtaccgtacgggtacctaaccgttaacgtttacccggacgtaaaccgtaaacgtaccccgaacgggtaacgaaccgtaaggtacgtaaacgtaacgtacggtaaacgttggaaacggtcccggacccgttaccgtaacggtaacttaaccggttaacgtacgaaccggttaacccgggttaaccgttttaacgtttaaccgttacgttaaaacccgtaacggtaaaccgggtacccgttaccccggggtacccgtaaccggtaaacccgaaacggttaacggtaaaacggtaaacggtttaacgttaaacgttttaacggtttaaacccgtttttttaaacgtaaccccgttttaaacccggtaacccgttaacccggttaaccggg

SEQ ID NO: 189009 - DNA, 768 bp, Homo sapiens
  misc_feature: GYAE6OF02FZ9JH.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgccttctttgtggtggcagcagttacaggtgtccaggcccaggcccacctggtgcaatcgtggggctgtggtggagagcctgggtcctggtgaggtctccgtgcaggtcttgtggcgtctcatcagcagatactactttcaacgtgggtgcgacgacggccccgtggggacaacggccttggagtcggcgtagggggaacggtcacttccccttgtccgttgggacgttctaccgaacccgttacgcccgtaacaaccgtacctttacccggaagggaccgtacggggtaccctaacgttaccgtttaacccgggacggtaaccgaaaaccgtccccggaaacggagggtaaccctaagggtacgtaaacaagtacgggaacttacgggaccggtaccggtaccctaacgtaaccgtattaccgttaaagttacggaaacccgcggttttaaccgttttaacttaccgttacgttaaaccgaaacccggtaaacgggtacccgtccccggaccgtaaccctaaccggtaaagggtaacctaaaacggggtaaacttaggtttaaccgtttaacgggttttaaccttttttaaaccggttaaccttaccccggttaacggttacccggtttaacgg

SEQ ID NO: 189010 - DNA, 713 bp, Homo sapiens
  misc_feature: GYAE6OF02IX2YX.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctggtggtggagaagccgtgggtcctcggtgagggtctcctgcaggtcttcgtggcgctccatcagcagatactactttccaacgtgggtgacgacacggcccctgggctaacggccttgagtggcgtgggaaggtcactcccgtctccgtggactcctacaaccgtaccactacgaactacgttccgagggccacgggtccaaccgtagttacccgaggtaaccgaaactacccgaacggaacgggaccaggttacgaaacgaacggttacggaaacctcggaacgccggtaccctcgaacgttactaccgtaagtaccgaaccgtaccggtttaccgtttaagttaccgttacggttaaccgaaccggtaaccggtacgtcccccgggtacccgtaaccgtaaccgtaaacggtaacgtaaacggtaaaacgttacgggtttaactttaacgggttttaacccttttttaaaccgttaaaccctttaacccgttaacggttacccgtttaacgg

SEQ ID NO: 189011 - DNA, 760 bp, Homo sapiens
  misc_feature: GYAE6OF02F8UF2.23.13.B02.1.454.CMB.1.raw
  modified_base (264)..(264): a, c, t, g, unknown or other
  misc_feature (264)..(264): n is a, c, g, or t
tcagacgcgagtatcacgaccggtgctcgatttagtctagcgactttagggtttagggggtccaaacagagcttctagcaagccatagtgggaatctgcaccatgcccggggctctgctcctcctgaccctcctcactcactctaaaaagcagtgtcagtggtccaggcaggcctgactcacgcccccctgatgtccaaggacatgagacagccgccacacctcacctgcacaggaaccacaacaatcgttggacaaccaaagngcagcgttggttgcagcaagccacacgggcccaccctaccaccactcctcggtaccctacgaaggaaactaaccaacccgggccctacgaggggacttccgtacgagaaggtaacgtagtttttcgacgtactaacgtaccgtaacgggttacgaaacggggaaaaccgtccgtaacccggccccttacccgtaacgaaccccgttaagttaacccgtacgggtaccctacccgaacggtacccgttacgggaacgggaaccggtaacgggcgttaacggtaaagtttaagttttaacgtttaacggttttaaggaccgtaacggtacgggtaacccaaccccgtaacggttaccctaccgtaaacgtccgttacgggtttacgggttccgggttaccgggtacggggtacgggaacccgtaaacggtccgtaccgggtacccgttaccgtaccggtaccgtaacccggcccggtaacgggtccgttaccccccgg

SEQ ID NO: 189012 - DNA, 862 bp, Homo sapiens
  misc_feature: GYAE6OF02J0PZ2.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctggtggtggagaacgtccgtgggtccgtcggtgacgggttctccgtgcgtacggttcttcgtggcggtctccgagtcagcagtactactactttacgaacgttcgggtcgccgtaaccgacggtccccgtagggaccgaacgggtccttaggacggttcgggcggtacgggggaaacgggttccaccgttacccccgtcgtttacccggttacgggtaaccgttccgtaacccgtaaacccgttaccggaccgtaaaccgaaacccgttaccgttcccggaacggggtccgtaacggtccctaacgttaaccgttaccgaccggtaaactaaaccgtacccgaaacggaaccgggtaactaaggtaaccgtaaacgtacggttacgggtaaacgtaccgggaacgtacccgggtaccgttaccgtaacgtaccgttaaccggttaacgtacgggtaaacccggtacccggggttttaacccgtttttaaacgtaccggtttaaaccggtaaacccgttaaaccgggaaacccggtaacccggttccccgggacccgtaaccgtaaacccgtaaggttaaaccgtaaacggtaaacgtttacgtaacgttttaacggtttacttttaacccgtaaccgttacccgttacggtaacccggttacgg

SEQ ID NO: 189013 - DNA, 667 bp, Homo sapiens
  misc_feature: GYAE6OF02G0ZAF.23.13.B02.1.454.CMB.1.raw
  modified_base (292)..(292): a, c, t, g, unknown or other
  misc_feature (292)..(292): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggcccacctggtgcaatcgtggggctgtggtggagagccgtgggtcctcgggtgagggtctccgtgcaggtcttcgtggcggctccagtcagcgagataccatttcaaccgttgggtcncgacgtacggccccgtgggacacggtccttggaggtcggcgtaggggaggtccacttccccgttcgttccgtggtctccaccgtaccgacgaccaactactaccgtaccggacggtacgacggtactacgtaccgtaccggaccgaacgttaaccgaccgaacgtaggaaacgttagaacgaagtacgtacgacgtggacggtcccacgtagtaacgttactaaccgttaacgaccggtacggtaacccgttttcgttaacgttctacgggtactacgaaccggacggtacccgtcccgacgacctaacggaataacggaaccgttagtagtaacggtttactttaccgtttaactacgttaccgtaacttcggg

SEQ ID NO: 189014 - DNA, 728 bp, Homo sapiens
  misc_feature: GYAE6OF02HKJS0.23.13.B02.1.454.CMB.1.raw
  modified_base (534)..(534): a, c, t, g, unknown or other
  misc_feature (534)..(534): n is a, c, g, or t
tcagacgcgagtatcacgaccggtgctcgatttagtctagcgacttccgcgggggcatcacataacaaccagattcctcctctaaagaaggccctgggagcacagctcatcaccatggactggacctggaggtcgccttctttggtggtggcagctagttacaggtgtccaggcccaggcccaccgtggtgcaatcgtggggctggtgggtcgagacgccgtgggtcctcggtggagggtcctcgtgcgtcggttctcgtggccgctccagtccagcaagtactactactttaccaaggttgggtagaccgacgtaccgggccccgtgggaccgtaacggccgtttaggacggtcgggtacggtaggggacggttccaccgttccctacgttccggttggtacgtcctaccgaaccgttcgacctaaccacgtacgtccggaggtacgtacggtacctaacgtacgtaccgaacgaactaaccgacgaacgaacgggtaatacgaactaacgcggtaaatcggacgtccggtanacgtaagacttaactagtacgtaacgtaccggttaaccgtttattccgtaacgtaaccgaacggtaacccggtacgtaccccggacgaaccctacgtaaacgtaggaaacgttaacgtaggttaacgtttaacgggtttaactttttaacgtaaacccttaaccggtaaccggtttacggtacgtaacccgggg

SEQ ID NO: 189015 - DNA, 766 bp, Homo sapiens
  misc_feature: GYAE6OF02G1SZI.23.13.B02.1.454.CMB.1.raw
tcagacgcgagtatcacgaccggtgctcgatttagtctagcgactttgggtttaggggtccaaacagagcttcagcaagcatagtgggaatctgcaccatgcccggggctctgctcctcctgaccctcctcactcactctgcagtgtcagtggtccaggcaggcctgactcacgcccccctgatgtaccggaagacatgagacacgaccgcacactcacctgacacgaggacgaccaacgtaatggttacgaccaaccgaaggtacgcaaggtcgtttgggttcgcgagtccaagtccgaaccgacgggccccaacccctacccaactacctccgtcgtacccgtaacgaaggtaaactaaacccgaacccgggccctaacgacggggtactcctacgaagggagtacgttacttttacgacgtactacgttccgaacggtacgaaacggtaaaccgcgtaccgcccttacccgtacgacccgttaaacgttaccgtaccggaacctaccgtacggtaccgtacggaacgggtacggtaacggtccggttaacggtaacctttaacggtttacgttttaggttaacgtaccgtaacggtacgggaaccctaccgtaccggtaccgttacttaccggtcggtttaccgggttgggttaccgggttacgggaaccggggtaacgggtaacccgtaaggtcccgtaccgggtacccgttacggtaccggtaccgacccggaacccggtacggacccggttacccccggg

SEQ ID NO: 189016 - DNA, 853 bp, Homo sapiens
  misc_feature: GYAE6OF02FKSMJ.23.13.B02.1.454.CMB.1.raw
  modified_base (181)..(181): a, c, t, g, unknown or other
  misc_feature (181)..(181): n is a, c, g, or t
tcagacgcgagtatcacgaccggtgctcgatttagtctagcgacttccgcgggggcatcacataacaaccagatcctcctctaaagaaggccctgggagcacagctcatcaccatggactggacctggagtgcctcttgtggtggcagcagttacaggtgtccaggccaggccccactggngcaaatctgggctgtggtggagaagcctgggtccctcgggtgacggggttcctccgtgccagggttctttccgtacgggcgggccttaccaatccgaacgcgaggaactactacctttaccgaaccgttggggtcgtccggaactaccggggtccccgttacggggacgtaaacggggtccctttaggaggttcgggtaccggttaggggtaacggggttccaaccttccccgttcccttaccgttaggggtaacgtccgtactaaccccgtagaaacccgtaaactccgttaacccgtagggcccggaaggggttacctaacccgttacggttaacccgccggaaaccgtaaacttcccggaacgtaacggaacgtaacggtacgtaaaccgtaaggtacgggtaaacctcgggtaacgggcccggtacccgttaacccgtaggttaacgtaccgtttaaacacgggtaaccgtacccggggttaaccggtttttaacttaaacggtttaccgtaaccggttaaccgaaaacccggggtacgtaccccccggggacccgtacccgtaacccgaaacgttaacggtaaacggtaaaacttggtaaacgtttaacggttactttttaaacgtaacccgttaaccctaacccgtacgggtttaccgttaccggg

SEQ ID NO: 189017 - DNA, 796 bp, Homo sapiens
  misc_feature: GYAE6OF02GYS1J.23.13.B02.1.454.CMB.1.raw
  modified_base (138)..(138): a, c, t, g, unknown or other
  misc_feature (138)..(138): n is a, c, g, or t
  modified_base (158)..(158): a, c, t, g, unknown or other
  misc_feature (158)..(158): n is a, c, g, or t
  modified_base (240)..(240): a, c, t, g, unknown or other
  misc_feature (240)..(240): n is a, c, g, or t
  modified_base (390)..(390): a, c, t, g, unknown or other
  misc_feature (390)..(390): n is a, c, g, or t
tcagacgcgagtatcacgaccggtgctcgatttagtctagcgacttccggcgggggcatcacataacaaccagattcctcctctaaagaaggccctgggagcacagctcatcaccatggactggacctggagtgcctnttgtggtggcagcagttacnggtcgtccagggcccaggccccacgtggtgactatcgtggggctgtgggtgagacgccgtgggtcctgggtgagggtctccngcaggtcttcgtcgggacgctccagtccgagcgtacgtacgtacctactttacaacggttgggtcgacccggtacgtaccgggccccccggtaagggcctaaaccgggtcccttaggtacggtgggtacggtacgggggaacgggtaccnccgtttaccccgttcgttacccggttcggggaccttccgtaacccgtaaaccgttccgaaaccaccgtaacctaccgtcccggagggtacctggttacctacgtacctttacgttaacccggcgtaaacctaaccgtcgaacggaaccggataaacgggtaccgtaacgaacggtaacggtaacggttacggacgggttaccggtacttaccggtaaggttataaccgttaaggtaaccgtccggttacgggttaacctttacttaccgtaacgaacgttaaaccgggaccgttaccggacccccggttcaaccgtacccaaacggtaacggtaaacgtaggttaacgttaacggtttaacgttttacctttaacgtaacccttaccggttaaccggttacccggg

SEQ ID NO: 189018 - DNA, 933 bp, Homo sapiens
  misc_feature: GYAE6OF02FZXAQ.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggagggtgccttctttgtggtggcagcagtacaggtgtccaggcccaggcccacctggtgcaatcgtgggctggtggtggagacgccgtgggtccgtcggtggacgggttcctaccgtgacgtaggttccgtttcgtcgggccggtcctaccagtccgagcgtagtactaaccttactttaccaacgttgggtcgaccgtaccgaccggtcccccgtagggtaccgtaccggtcccgtttggacggtcgggtacggttacgggggtaacgggtcctaccgttaccccgttccggttccggtttacgggtacgttacccttaaccgtaacccggttaccgtacctaaaaccgtaaccgtaacccgtttaccggaacggggtaccgtaacggggtacccgttaaacgttaccggtttaacccggaccgggtaaaacctaaacccggtcccggaaaccgggtaaacggggtaaacgttaacggtaaacggtaaccggttaacggtaaaccgtacggtaacgggtacccggtaccgttaacggaaccgttaaacgtttaacggtaaccggtaacggttaacccgttaacggtttacccggttttttaaagttacccggttaacgggtaacccgtaaacccggggtaaccggaaccccgttacccccgggaaccgtacccgtaaccgtaaacggttaacgggaaaaaccgtttaagtacggtttaaaccgttttaaggtttaacccgtttttttaaacgtaaccccgtttaaccggttaccggttaccggggtttaaccgttaacccgggg

SEQ ID NO: 189019 - DNA, 816 bp, Homo sapiens
  misc_feature: GYAE6OF02GSDG8.23.13.B02.1.454.CMB.1.raw
tcagacgcgagtatcacgaccggtgctcgatttagtctagcgacttccgcgggggcatcacataacaaccagattcctcctctaaagaaggccctgggagcacagctcatcaccatggactggacctggaggtgcctctttgtggtggcagcagttacaggtgtccaggcccaggccccacctggtgcaatcgtggggctggtggtggagagcctgggtcctcggtggagggtctccgtgcgtacggtcttcgtgggcgctccatacagcagactacgtactttacaacgttgggtagaccgacgccgggccccgtaggggacctaacgggtccttgggacggtcgggtacgggttagggggtaaacgggtccctaccgttcccccttcgttccggttagggacctttacccgttacccgaaaccgttaccggacctaaacccgtaaaccgttcccgttacccggaacggggtacccgtaaacgggttaccttaaccggtttaaaccggtttaccccgggaaccgggtaaacctaaaccgtccccggaaacgggaacggtaaaccgtaacggtaccgaaacgtacgtaacgggtaaccgtacgggaacggtcccgggtaacctacgaacgttaactaaccgtacgtaccggtaacccgttaccgggtttaacccgttttaagtttaccgtacgttaacccgtaacgggaacccggttccgttacccccggacgtcccgtaaacgtaacgtaacggaaattaacgtagttacgttaacggtttacttttaacgtacctaacgtaccgttagtccggg

SEQ ID NO: 189020 - DNA, 789 bp, Homo sapiens
  misc_feature: GYAE6OF02IV8DM.23.13.B02.1.454.CMB.1.raw
  modified_base (321)..(321): a, c, t, g, unknown or other
  misc_feature (321)..(321): n is a, c, g, or t
tcagacgcgagtatcacgaccggtgctcgatttagtctagcgacttccgcgggggcatcacataaacaaccagattcctcctctaaagaaggccctgggagcacagctcatcaccatggactgacctggaggtgcctctttgtggtggcagcagttacgaggtcgtccaggcccgacggcccgacctcggtgcaacttcggtggggcttggtggggtaggaagaacggcccgtggggtacctcgggtggtacgggtccttaccgtgtccgtaggttcttcgtcgggcgtcctccgatcgacgcaacgaatacgtaccttanacggtcggtacgccggacgtccggaccccgtggggacgtacggtacgtcgggaggtggtccggtacggggaggttccacgttcccctacgttcgttcggacgttccacgtaacccgtaaccacctaacgtaacctcccgtacggtacgggaccgtaaccggtactaccggttaaaccgtccgggacgtaaaaccgtaacctacccgaacggtaccgggtaacctaagggttaccgaaataccggtaacgggaacgttacggacccgggtaccttcccgaacggttaataccgtagttaaccgacgggtacccgttacgggtttacctttaagtccgtacggtaaccctacgggtaacctaccggtacccgaccgtaaccgaacgtaacgtaacggaaacgttaagtacgttaaagtttaccgggtttaactttaacccgttaaccgaaccgtttagttaacccgtcgg

SEQ ID NO: 189021 - DNA, 280 bp, Homo sapiens
  misc_feature: GYAE6OF01B0ZM3.52.10.A10.1.454.CMB.1.raw
  modified_base (275)..(280): a, c, t, g, unknown or other
  misc_feature (275)..(280): n is a, c, g, or t
tcagcgcagtacgacacgaccggtgctcgatttagcgtcgatctcagggatagaagttattcagcaggcacacaacagaggcagttacagacttcactctcacatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcatagnnnnnn

SEQ ID NO: 189022 - DNA, 279 bp, Homo sapiens
  misc_feature: GYAE6OF01ELV1N.52.10.A10.1.454.CMB.1.raw
  modified_base (275)..(279): a, c, t, g, unknown or other
  misc_feature (275)..(279): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcaccatctgtcttcatcttcccgcatctgatatacgatcgctgagcgggctggcaaggcgcatagnnnnn

SEQ ID NO: 189023 - DNA, 279 bp, Homo sapiens
  misc_feature: GYAE6OF01DHJPR.52.10.A10.1.454.CMB.1.raw
  modified_base (276)..(279): a, c, t, g, unknown or other
  misc_feature (276)..(279): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcatagnnnn

SEQ ID NO: 189024 - DNA, 282 bp, Homo sapiens
  misc_feature: GYAE6OF01CJ8OY.52.10.A10.1.454.CMB.1.raw
  modified_base (277)..(282): a, c, t, g, unknown or other
  misc_feature (277)..(282): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatctgatatacgatcgctgagcgggctggcaaggcgcatagnnnnnn

SEQ ID NO: 189025 - DNA, 280 bp, Homo sapiens
  misc_feature: GYAE6OF01D1LX7.52.10.A10.1.454.CMB.1.raw
  modified_base (274)..(280): a, c, t, g, unknown or other
  misc_feature (274)..(280): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagttttattactgtcagcagcgtagtaagtggcgcttcggccaagggacacgactggagttaaacgactgtggctgcaccatctgtcttcatctccgcatctgatatacgatcgctgagcgggctggcaaggcgcatagnnnnnnn

SEQ ID NO: 189026 - DNA, 284 bp, Homo sapiens
  misc_feature: GYAE6OF01A9YS1.52.10.A10.1.454.CMB.1.raw
  modified_base (277)..(284): a, c, t, g, unknown or other
  misc_feature (277)..(284): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagttttattactgtcagcagcgtagtaagtggcgcttcggccaagggacacgactggagttaaacgactgtggctgcaccatctgtcttcatccttcccgcatctgatatacgatcgctggagcgggctggcaaggcgcatagnnnnnnnn

SEQ ID NO: 189027 - DNA, 280 bp, Homo sapiens
  misc_feature: GYAE6OF01D4V4J.52.10.A10.1.454.CMB.1.raw
  modified_base (275)..(280): a, c, t, g, unknown or other
  misc_feature (275)..(280): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcaccatctgtcttcatcttcccgcatctgatatacgatcgctgagcgggctggcaaggcgcatagnnnnnn

SEQ ID NO: 189028 - DNA, 280 bp, Homo sapiens
  misc_feature: GYAE6OF01CHZXM.52.10.A10.1.454.CMB.1.raw
  modified_base (277)..(280): a, c, t, g, unknown or other
  misc_feature (277)..(280): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatctgatatacgatcgctgagcgggctggcaaggcgcatagnnnn

SEQ ID NO: 189029 - DNA, 279 bp, Homo sapiens
  misc_feature: GYAE6OF01AO24C.52.10.A10.1.454.CMB.1.raw
  modified_base (266)..(266): a, c, t, g, unknown or other
  misc_feature (266)..(266): n is a, c, g, or t
  modified_base (271)..(279): a, c, t, g, unknown or other
  misc_feature (271)..(279): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcaccatctgtctcatcttcccgcatctgatatacgatcgctgagcggctggcaggcnatagnnnnnnnnn

SEQ ID NO: 189030 - DNA, 276 bp, Homo sapiens
  misc_feature: GYAE6OF01D2C6R.52.10.A10.1.454.CMB.1.raw
  modified_base (268)..(268): a, c, t, g, unknown or other
  misc_feature (268)..(268): n is a, c, g, or t
  modified_base (274)..(276): a, c, t, g, unknown or other
  misc_feature (274)..(276): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcacatctgtcttcatcttcccgcatctgatatacgatcgctgagcgggctggcaaggcncatagnnn

SEQ ID NO: 189031 - DNA, 281 bp, Homo sapiens
  misc_feature: GYAE6OF01DBAY5.52.10.A10.1.454.CMB.1.raw
  modified_base (276)..(281): a, c, t, g, unknown or other
  misc_feature (276)..(281): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcatagnnnnnn

SEQ ID NO: 189032 - DNA, 279 bp, Homo sapiens
  misc_feature: GYAE6OF01CGFUG.52.10.A10.1.454.CMB.1.raw
  modified_base (270)..(270): a, c, t, g, unknown or other
  misc_feature (270)..(270): n is a, c, g, or t
  modified_base (275)..(279): a, c, t, g, unknown or other
  misc_feature (275)..(279): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaaggttaaacgaactgtggctgcaccatctgtcttcatcttcccgcatctgatatacgatcgctgagcggctggcaggcgnatagnnnnn

SEQ ID NO: 189033 - DNA, 308 bp, Homo sapiens
  misc_feature: GYAE6OF01CQ15N.52.10.A10.1.454.CMB.1.raw
  modified_base (221)..(221): a, c, t, g, unknown or other
  misc_feature (221)..(221): n is a, c, g, or t
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (283)..(308): a, c, t, g, unknown or other
  misc_feature (283)..(308): n is a, c, g, or t
tcagcgcagtacgacacgaccggtgctcgatttagcgtcgatctcagggagtagaagttattcagcaggcacacaacagaggcagttacagacttcactctcaccatcagcaacctagagcctgaagactttgcagttttattactgtcagctaagcgtagtaagtggcgcttcgggccaagggacacgacgtggaaggttaaacgactggtgctgcaccngtctgtcttcactccttcccgcatctgatatacgatcgntgagcggctggcaaggcnagtgnnnnnnnnnnnnnnnnnnnnnnnnnn

SEQ ID NO: 189034 - DNA, 281 bp, Homo sapiens
  misc_feature: GYAE6OF01EIUNV.52.10.A10.1.454.CMB.1.raw
  modified_base (276)..(281): a, c, t, g, unknown or other
  misc_feature (276)..(281): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttccgccatctgatatacgatcgctgagcgggctggcaaggcgcatagnnnnnn

SEQ ID NO: 189035 - DNA, 284 bp, Homo sapiens
  misc_feature: GYAE6OF01CZ3R0.52.10.A10.1.454.CMB.1.raw
  modified_base (272)..(272): a, c, t, g, unknown or other
  misc_feature (272)..(272): n is a, c, g, or t
  modified_base (278)..(284): a, c, t, g, unknown or other
  misc_feature (278)..(284): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagtttattactgtcagcagcgtagtaagtggcgcttcggccaagggacacgacgtggaaggttaaacgaactgtggctgcaccatctgtcttcatcttcccgcatctgatatacgatcgctgagcggctggcaaggcncatagnnnnnnn

SEQ ID NO: 189036 - DNA, 280 bp, Homo sapiens
  misc_feature: GYAE6OF01ERHOZ.52.10.A10.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (271)..(280): a, c, t, g, unknown or other
  misc_feature (271)..(280): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggagttaaaacgactgtggctgcaccatctgtctcatctccncatctgatanacgatcgntgagcggctggcaaggcncatagnnnnnnnnnn

SEQ ID NO: 189037 - DNA, 357 bp, Homo sapiens
  misc_feature: GYAE6OF01BNNVK.52.10.A10.1.454.CMB.1.raw
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (272)..(273): a, c, t, g, unknown or other
  misc_feature (272)..(273): n is a, c, g, or t
  modified_base (276)..(277): a, c, t, g, unknown or other
  misc_feature (276)..(277): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (287)..(357): a, c, t, g, unknown or other
  misc_feature (287)..(357): n is a, c, g, or t
tcagcgcagtacgacacgaccggtgctcgatttagcgtcgatctcgagggatagaagttattcagcaggcacacaacagaggcagttacagacttcactctcaccatcagcaacctagagcctgaagctttgcagtttatactgtcagcagcgtagtaagtggcgcttcggaccaagggacacgactggacgttaaacgactgtggctgcacatctgtcttcatcttccgcatcngatnacgatcgctgagcggctggcaaggcgacatagnnagnncncagtcngnnnnnnnnnnnnnnnnnnnnnnnnnnnnnnnnnnnnnnnnnnnnnnnnnnnnnnnnnnnnnnnnnnnnnnn

SEQ ID NO: 189038 - DNA, 283 bp, Homo sapiens
  misc_feature: GYAE6OF01BD8ZO.52.10.A10.1.454.CMB.1.raw
  modified_base (274)..(283): a, c, t, g, unknown or other
  misc_feature (274)..(283): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggagttaaacgactgtggctgcaccatctgtcttcatcttcccgcatctgatatacgatcgctgagcgggctggcaaggcacatagnnnnnnnnnn

SEQ ID NO: 189039 - DNA, 284 bp, Homo sapiens
  misc_feature: GYAE6OF01BQGQ6.52.10.A10.1.454.CMB.1.raw
  modified_base (204)..(204): a, c, t, g, unknown or other
  misc_feature (204)..(204): n is a, c, g, or t
  modified_base (276)..(284): a, c, t, g, unknown or other
  misc_feature (276)..(284): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagtttattactgtcagcagcgtagtaagtggcgcttcggccaagggacacgactggagttaaacgactgnggctgcaccatctgtcttcatctcccgcatctgatatacgatcgctgacgcgggctggcaaggcgacatagnnnnnnnnn

SEQ ID NO: 189040 - DNA, 287 bp, Homo sapiens
  misc_feature: GYAE6OF01DQFTO.52.10.A10.1.454.CMB.1.raw
  modified_base (276)..(276): a, c, t, g, unknown or other
  misc_feature (276)..(276): n is a, c, g, or t
  modified_base (281)..(287): a, c, t, g, unknown or other
  misc_feature (281)..(287): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagtttattactgtcagtagcgtagtaagtggcgtcttcggccaagggacacggactgggaaggttaaaacgactgtggctgcaccatctgtcttcatcttccgcatctgatatacgatcgctgagcgggctggacaaggcanatagnnnnnnn

SEQ ID NO: 189041 - DNA, 280 bp, Homo sapiens
  misc_feature: GYAE6OF01AO6YX.52.10.A10.1.454.CMB.1.raw
  modified_base (274)..(280): a, c, t, g, unknown or other
  misc_feature (274)..(280): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcaccatctgtcttcatcttccgccatctgatatacgatcgctgagcggctggcaaggcgcatagnnnnnnn

SEQ ID NO: 189042 - DNA, 284 bp, Homo sapiens
  misc_feature: GYAE6OF01EKNB9.52.10.A10.1.454.CMB.1.raw
  modified_base (271)..(271): a, c, t, g, unknown or other
  misc_feature (271)..(271): n is a, c, g, or t
  modified_base (277)..(284): a, c, t, g, unknown or other
  misc_feature (277)..(284): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagtttattactgtcagcagcgtagtaagtggcgcttcggccaagggacacgactggaagttaaacgactgtggctgcaccatctgtcttcatcctccgcatctgatatacgatcgctggagcgggctggacaaggcncatagnnnnnnnn

SEQ ID NO: 189043 - DNA, 353 bp, Homo sapiens
  misc_feature: GYAE6OF01A389U.52.10.A10.1.454.CMB.1.raw
  modified_base (336)..(353): a, c, t, g, unknown or other
  misc_feature (336)..(353): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagtactttgactagttttattactgtcagctagacggtagtaaggtggccgtgttccggaccgaaggggaccacgacgtagggtaacggttaaaacgactggtcggctcgacacctagtctgttccttcacgttccctcccgctatcgtagtaacttagaccgattcggacgtaggacggccgggtctagggacaacgggcgactaggtagnnnnnnnnnnnnnnnnnn

SEQ ID NO: 189044 - DNA, 282 bp, Homo sapiens
  misc_feature: GYAE6OF01ASLI5.52.10.A10.1.454.CMB.1.raw
  modified_base (276)..(282): a, c, t, g, unknown or other
  misc_feature (276)..(282): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggagttaaacgactgtaggctgcaccatctgtctcatccttcccgcatctgatatacgatcgactgagcggctggcaaggcgacatagnnnnnnn

SEQ ID NO: 189045 - DNA, 282 bp, Homo sapiens
  misc_feature: GYAE6OF01D4ICP.52.10.A10.1.454.CMB.1.raw
  modified_base (274)..(282): a, c, t, g, unknown or other
  misc_feature (274)..(282): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggcacgactggagttaaacgactgtggctgcaccatctgtcttcatccttcccgcatctgatatacgatcgctgagcgggctggcaaggcgcatagnnnnnnnnn

SEQ ID NO: 189046 - DNA, 300 bp, Homo sapiens
  misc_feature: GYAE6OF01DRU1T.52.10.A10.1.454.CMB.1.raw
  modified_base (256)..(256): a, c, t, g, unknown or other
  misc_feature (256)..(256): n is a, c, g, or t
  modified_base (284)..(300): a, c, t, g, unknown or other
  misc_feature (284)..(300): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagtttattactgtcagcagcgtagtaagtgcgcttcggaccaagggacacgacgtggaaggttaaacgacgtgtggctgcacatctgtcttcactccttcccgcatctagatatacgatcgntggagcgggtctggcaaggcgcagtagnnnnnnnnnnnnnnnnn

SEQ ID NO: 189047 - DNA, 289 bp, Homo sapiens
  misc_feature: GYAE6OF01A35UK.52.10.A10.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (264)..(265): a, c, t, g, unknown or other
  misc_feature (264)..(265): n is a, c, g, or t
  modified_base (279)..(289): a, c, t, g, unknown or other
  misc_feature (279)..(289): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagtttattactgtcagcagcgtagtaagtggcgtcttcggccaagggacacgacgtggaaggttaaacgactgtggctgcacatctgtctcntccttccnctatctgatactacgatcgctggagcgggnnggacaggcacatgnnnnnnnnnnn

SEQ ID NO: 189048 - DNA, 302 bp, Homo sapiens
  misc_feature: GYAE6OF01C81IC.52.10.A10.1.454.CMB.1.raw
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (293)..(302): a, c, t, g, unknown or other
  misc_feature (293)..(302): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcgggccaaagggacgacgacgtggaaggttaaaacgaacgtgttgggcctggcacaatctagtcttcatccttccgccaatctgaatatacgatcgctgagtcgggctggacaggccgntangnnnnnnnnnn

SEQ ID NO: 189049 - DNA, 406 bp, Homo sapiens
  misc_feature: GYAE6OF01ATGZQ.52.10.A10.1.454.CMB.1.raw
  modified_base (96)..(96): a, c, t, g, unknown or other
  misc_feature (96)..(96): n is a, c, g, or t
  modified_base (176)..(176): a, c, t, g, unknown or other
  misc_feature (176)..(176): n is a, c, g, or t
  modified_base (211)..(211): a, c, t, g, unknown or other
  misc_feature (211)..(211): n is a, c, g, or t
  modified_base (335)..(335): a, c, t, g, unknown or other
  misc_feature (335)..(335): n is a, c, g, or t
  modified_base (339)..(341): a, c, t, g, unknown or other
  misc_feature (339)..(341): n is a, c, g, or t
  modified_base (343)..(345): a, c, t, g, unknown or other
  misc_feature (343)..(345): n is a, c, g, or t
  modified_base (347)..(347): a, c, t, g, unknown or other
  misc_feature (347)..(347): n is a, c, g, or t
  modified_base (349)..(406): a, c, t, g, unknown or other
  misc_feature (349)..(406): n is a, c, g, or t
tcagcgcagtacgacacgaccggtgctcgatttagcgtcgatctcagggatagaagttattcagcaggcacacaacagaggcagttacagtacttnactctcaccatcagccaaccgtagacgcctgaaagtacttttgctagttttatacctgtcagcagcgttagtaagtggcncttcggaccaagggcacgctaggaaggttaaaccntggtgctagccaccgtatcgttgtccttcgaacttcccgttacccgcctaattccgtagtaattactaacgctttcggcgttgggaacggcggggtcctgggaacgtaaccggcgtacaagtgncgannncnnngnannnnnnnnnnnnnnnnnnnnnnnnnnnnnnnnnnnnnnnnnnnnnnnnnnnnnnnnnn

SEQ ID NO: 189050 - DNA, 299 bp, Homo sapiens
  misc_feature: GYAE6OF01AOXU3.52.10.A10.1.454.CMB.1.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (288)..(299): a, c, t, g, unknown or other
  misc_feature (288)..(299): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgctagttttattactgtcagcagtcgtagtaagtggcgcttcggaccgaagggacacgactggaggttaaacgactgtggctcgcaccatctgtacttcactcctcccgctatctnatatacgatccgctgagcggtctggacaggcgacatagntnnnnnnnnnnnn

SEQ ID NO: 189051 - DNA, 284 bp, Homo sapiens
  misc_feature: GYAE6OF01A3NQF.52.10.A10.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (271)..(272): a, c, t, g, unknown or other
  misc_feature (271)..(272): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (278)..(284): a, c, t, g, unknown or other
  misc_feature (278)..(284): n is a, c, g, or t
tcagcgcagtacgacacgaccggtgctcgatttagcgtcgatctcagggatagaagttattcagcaggcacacaacagaggcagttacagacttcactctcaccataagcaacctagagcctgaagactttgctagtttattactgtcagcagcgtagtaagtggcgcttcggccaagggtacacgcgtaggaagttaacgaactgnggctgcaccngtctgtctacactcctaccgcntctganatcgatccgntgngcgngngnaggtnnangntnnnnnnn

SEQ ID NO: 189052 - DNA, 359 bp, Homo sapiens
  misc_feature: GYAE6OF01B7CVH.52.10.A10.1.454.CMB.1.raw
  modified_base (233)..(233): a, c, t, g, unknown or other
  misc_feature (233)..(233): n is a, c, g, or t
  modified_base (320)..(359): a, c, t, g, unknown or other
  misc_feature (320)..(359): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagtactttgctagttttattactgtcagcaggcgtaagtaagtggcgcgttcggaccgaagggacacgtacgtgggtaaggttaaacgacgttggtgctgcaccatctnttctactactccttcccgactactctagatagtaccgacgttccgagtaggacggccgggactcgggacaacgggtcgactagtcgnnnnnnnnnnnnnnnnnnnnnnnnnnnnnnnnnnnnnnnn

SEQ ID NO: 189053 - DNA, 281 bp, Homo sapiens; identical to SEQ ID NO: 189031
  misc_feature: GYAE6OF02G3VIU.52.10.A10.1.454.CMB.1.raw
  modified_base (276)..(281): a, c, t, g, unknown or other
  misc_feature (276)..(281): n is a, c, g, or t

SEQ ID NO: 189054 - DNA, 281 bp, Homo sapiens; identical to SEQ ID NO: 189031
  misc_feature: GYAE6OF02IXUEV.52.10.A10.1.454.CMB.1.raw
  modified_base (276)..(281): a, c, t, g, unknown or other
  misc_feature (276)..(281): n is a, c, g, or t

SEQ ID NO: 189055 - DNA, 280 bp, Homo sapiens
  misc_feature: GYAE6OF02HENEC.52.10.A10.1.454.CMB.1.raw
  modified_base (276)..(280): a, c, t, g, unknown or other
  misc_feature (276)..(280): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcatagnnnnn

SEQ ID NO: 189056 - DNA, 283 bp, Homo sapiens
  misc_feature: GYAE6OF02GZLXR.52.10.A10.1.454.CMB.1.raw
  modified_base (277)..(283): a, c, t, g, unknown or other
  misc_feature (277)..(283): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttaggccaagggacacgactggaggttaaacgaactgtggctgcaccatctgtcttcatcttcccgccatctgatatacgatcgctgagcgggctggcaaggcgcatagnnnnnnn

SEQ ID NO: 189057 - DNA, 280 bp, Homo sapiens; identical to SEQ ID NO: 189028
  misc_feature: GYAE6OF02GE8R6.52.10.A10.1.454.CMB.1.raw
  modified_base (277)..(280): a, c, t, g, unknown or other
  misc_feature (277)..(280): n is a, c, g, or t

SEQ ID NO: 189058 - DNA, 281 bp, Homo sapiens; identical to SEQ ID NO: 189031
  misc_feature: GYAE6OF02GX1ZK.52.10.A10.1.454.CMB.1.raw
  modified_base (276)..(281): a, c, t, g, unknown or other
  misc_feature (276)..(281): n is a, c, g, or t

SEQ ID NO: 189059 - DNA, 282 bp, Homo sapiens
  misc_feature: GYAE6OF02HB59V.52.10.A10.1.454.CMB.1.raw
  modified_base (277)..(282): a, c, t, g, unknown or other
  misc_feature (277)..(282): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcagtagnnnnnn

SEQ ID NO: 189060 - DNA, 282 bp, Homo sapiens
  misc_feature: GYAE6OF02ICP02.52.10.A10.1.454.CMB.1.raw
  modified_base (276)..(282): a, c, t, g, unknown or other
  misc_feature (276)..(282): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcatagnnnnnnn

SEQ ID NO: 189061 - DNA, 281 bp, Homo sapiens
  misc_feature: GYAE6OF02JTQH4.52.10.A10.1.454.CMB.1.raw
  modified_base (268)..(268): a, c, t, g, unknown or other
  misc_feature (268)..(268): n is a, c, g, or t
  modified_base (274)..(281): a, c, t, g, unknown or other
  misc_feature (274)..(281): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcaccatctgtctcatcttcccgcatctgatatacgatcgctgagcgggctggcaaggcncatagnnnnnnnn

SEQ ID NO: 189062 - DNA, 290 bp, Homo sapiens
  misc_feature: GYAE6OF02IR2NT.52.10.A10.1.454.CMB.1.raw
  modified_base (274)..(274): a, c, t, g, unknown or other
  misc_feature (274)..(274): n is a, c, g, or t
  modified_base (281)..(290): a, c, t, g, unknown or other
  misc_feature (281)..(290): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagttttattactgtcagcagcgtagtaagtggcgcttcggccaaggggacacgactggaggttaaacgaactgtggctgcaccatctgtcttcatccttcccgcatctgatatacgatcgctgagcgggctggacaggccncgatagnnnnnnnnnn

SEQ ID NO: 189063 - DNA, 291 bp, Homo sapiens
  misc_feature: GYAE6OF02H2CB6.52.10.A10.1.454.CMB.1.raw
  modified_base (281)..(291): a, c, t, g, unknown or other
  misc_feature (281)..(291): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagttttatactgtcagcagcgtagtaagtggcgcttcggccaagggacacggactgggaaggttaaaacgaactggtggctgcaccatctgtcttcatcttcccgcatcctgatatacgatcgctgagcggctggcaaggcgcatagnnnnnnnnnnn

SEQ ID NO: 189064 - DNA, 298 bp, Homo sapiens
  misc_feature: GYAE6OF02J04GN.52.10.A10.1.454.CMB.1.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (276)..(298): a, c, t, g, unknown or other
  misc_feature (276)..(298): n is a, c, g, or t
tcagcgcagtacgacacgaccggtgctcgatttagcgtcgatctcagggagtagaagttattcagcaggcacgacaacagaggcagttacagacttcactctcaccattcagcaacctagagcctgaagactttgcagtttagttactgtcagcagcgtagtagtgcgcttcggccaagggacacgactggaggttaaacgactggtgctgcacntctgtcttcatcttcccgctanctgatacagatcgctgagcggctggcaggcacatagncnnnnnnnnnnnnnnnnnnnnnnn

SEQ ID NO: 189065 - DNA, 284 bp, Homo sapiens
  misc_feature: GYAE6OF02HJDJ3.52.10.A10.1.454.CMB.1.raw
  modified_base (277)..(284): a, c, t, g, unknown or other
  misc_feature (277)..(284): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatctgatatacgatcgctgagcgggctggcaaggcgcatagnnnnnnnn

SEQ ID NO: 189066 - DNA, 281 bp, Homo sapiens
  misc_feature: GYAE6OF02GTZ3E.52.10.A10.1.454.CMB.1.raw
  modified_base (277)..(281): a, c, t, g, unknown or other
  misc_feature (277)..(281): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatctgatatacgatcgctgagcgggctggcaaggcgcatagnnnnn

SEQ ID NO: 189067 - DNA, 281 bp, Homo sapiens
  misc_feature: GYAE6OF02GJBUL.52.10.A10.1.454.CMB.1.raw
  modified_base (275)..(281): a, c, t, g, unknown or other
  misc_feature (275)..(281): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcaccatctgtcttcatcttcccgcatctgatatacgatcgctgagcgggctggcaaggcgcatagnnnnnnn

SEQ ID NO: 189068 - DNA, 282 bp, Homo sapiens
  misc_feature: GYAE6OF02HK8NS.52.10.A10.1.454.CMB.1.raw
  modified_base (270)..(270): a, c, t, g, unknown or other
  misc_feature (270)..(270): n is a, c, g, or t
  modified_base (275)..(282): a, c, t, g, unknown or other
  misc_feature (275)..(282): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatctgatatacgatcgctgagcggctggcaaggcncatgnnnnnnnn

SEQ ID NO: 189069 - DNA, 286 bp, Homo sapiens
  misc_feature: GYAE6OF02IR872.52.10.A10.1.454.CMB.1.raw
  modified_base (274)..(286): a, c, t, g, unknown or other
  misc_feature (274)..(286): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggacacgactggaggttaaacgactgtggctgcacatctgtcttcatcttcccgcatctgatatacgatcgctgagcgggctggcaaggcgcatagnnnnnnnnnnnnn

SEQ ID NO: 189070 - DNA, 284 bp, Homo sapiens
  misc_feature: GYAE6OF02HFURP.52.10.A10.1.454.CMB.1.raw
  modified_base (276)..(284): a, c, t, g, unknown or other
  misc_feature (276)..(284): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcggccaagggcacgactggacggttaaacgaactgtggctgcaccatctgtcttcatcttcccgccatctgatatacgatcgctgagcggctggcaaggcgcatagnnnnnnnnn

SEQ ID NO: 189071 - DNA, 287 bp, Homo sapiens
  misc_feature: GYAE6OF02G79VM.52.10.A10.1.454.CMB.1.raw
  modified_base (277)..(287): a, c, t, g, unknown or other
  misc_feature (277)..(287): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagttttattactgtcagcagcgtagtaagtggcgcttcggccaagggacacgactggagttaaacgactgtgctgcaccatctgtctcatccttcccgcatctgatatacgatcgctgagcgggctggacaaggcgctataggnnnnnnnnnnn

SEQ ID NO: 189072 - DNA, 289 bp, Homo sapiens
  misc_feature: GYAE6OF02IZNA2.52.10.A10.1.454.CMB.1.raw
  modified_base (271)..(271): a, c, t, g, unknown or other
  misc_feature (271)..(271): n is a, c, g, or t
  modified_base (277)..(289): a, c, t, g, unknown or other
  misc_feature (277)..(289): n is a, c, g, or t
tcagcgcagtacgacacgaccggtgctcgatttagcgtcgatctcagggatagaagttattcagcaggcacacaacagaggcagttacagacttcactctcaccatcagcaacctagagcctgaagactttgcagtttattactgtcagcagcgtagtaagtggcgcttcgggccaagggacacgactggaggttaaacgactgtggctgcaccatctgtcttcatctcccgcatctgatagtacgatcgctgagcgggctggcaagggcncatagnnnnnnnnnnnnn

SEQ ID NO: 189073 - DNA, 423 bp, Homo sapiens
  misc_feature: GYAE6OF02F97BD.52.10.A10.1.454.CMB.1.raw
  modified_base (257)..(257): a, c, t, g, unknown or other
  misc_feature (257)..(257): n is a, c, g, or t
  modified_base (385)..(386): a, c, t, g, unknown or other
  misc_feature (385)..(386): n is a, c, g, or t
  modified_base (394)..(423): a, c, t, g, unknown or other
  misc_feature (394)..(423): n is a, c, g, or t
tcagcgcagtacgacacgaccggtgctcgatttagcgtcgatctcagggatagaagttattcagcaggcacacaacagaggcagttaccagacttcactctcaccatcagcaacctagagcctagaagtactttgctagtttattacttgtcgagtcagtacgtaaggttaacggtgggcctcgtttcggaccgtaaggggaccacggtacgtgggtaaagggttaaaacgaactggtcggactggaccctaaaccnttccgttgttcctttactacgttccccttaccccgactaacgttccgtacgtaattaacgtaggaacctccggtacttaggacggccggggtctacgggacgaacgggacccgagtaacgagcagtanngtcagctnnnnnnnnnnnnnnnnnnnnnnnnnnnnnn

SEQ ID NO: 189074 - DNA, 200 bp, Homo sapiens
  misc_feature: GYAE6OF01EC3ZE.39.21.B10.1.454.CMB.1.raw
  modified_base (158)..(200): a, c, t, g, unknown or other
  misc_feature (158)..(200): n is a, c, g, or t
tcagtcgcactagtcacgaccggtgctcgatttagtgtcgtcgcaaagagggtgcagagaactccatggctaccaggtcagcccaaggccaacccactgtcactctagttcccaccctcctcactagtgcgactgagcgggctggcaaggcgcatagnnnnnnnnnnnnnnnnnnnnnnnnnnnnnnnnnnnnnnnnnnn

SEQ ID NO: 189075 - DNA, 164 bp, Homo sapiens
  misc_feature: GYAE6OF01DCQIO.39.21.B10.1.454.CMB.1.raw
  modified_base (159)..(164): a, c, t, g, unknown or other
  misc_feature (159)..(164): n is a, c, g, or t
tcagtcgcactagtcacgaccggtgctcgatttagtgtcgtcgcaaagagggttgcagagaactccatggctaccaggtcagcccaaggccaaccccactgtcactctgttcccaccctcctcactagtgcgactgagcgggctggcaaggcgcatagnnnnnn

SEQ ID NO: 189076 - DNA, 814 bp, Homo sapiens
  misc_feature: GYAE6OF01ENA2T.39.21.B10.1.454.CMB.1.raw
  modified_base (334)..(334): a, c, t, g, unknown or other
  misc_feature (334)..(334): n is a, c, g, or t
tcagtcgcactagtcacgaccggtgctcgatttagtgtcgtcgcaggagagaggagcccagccctgggattttcaggtgttttcatttggtgatcaggactgaacagagagaactcaccatggagtttggctgagctggtctttttcttgtggcttaattttaaaaggtgtccagtgtagaggtgcagtctggttggagtcgtgggggagtcgttggtacgacgggccggggggttccctggacgtacctcgtcctggtgccgacgtccgtgtggtacttccaccgtttcgacgcacgtactagtcgacctagtcgacccgttcgggtaccccnccgacggtcccgttaccgggaaggggaaacggggtaccgtggggtaacgggttccgggtaccgttccgttagttaagtttgggtaaggtaacgggttggttacgtactttaaacgtaaaccgtaaacgtacgtacgacggtcccgtacggttacggaacgggtcccgtacttacccgacctaacgttacccgtacgtaaggtaaccgttaaccgttaaccgttaacctaaacgggtaccaccgttacgttaccgttaggttaccttacgtaccgaacgtaaacgtacgaactaccggtcgttaacggacggtaccgtaccggaccggtaacggtacccgttaccgtttaatacgttttacgtacgggtacggaacgggtaaggtttagggggtacgggggtagggtttcggggtacccttaccggttacgggttcggtttacgtttacggtaccgttcgggtacggggtcggtaaccggg

SEQ ID NO: 189077 - DNA, 839 bp, Homo sapiens
  misc_feature: GYAE6OF01C9UKZ.39.21.B10.1.454.CMB.1.raw
tcagtcgcactagtcacgaccggtgctcgatttagtgtcgtcgcaagagaggaggagcccagccctgggattttcaggttgttttcatttggtgatcaggactgaacagagagaactcaccagtggtagtttgggctgagcgttggttctttttcgtggtggtactttaagttttaaaaggtcgtccgtaggttgtaggtacggttcgacgtaggtccgttggttggtaggttcgggtagggggtaggtcgttacgggtaccggacggggtccccggggggttcctaggaccgtaccgttccgttccgtgtcgacgtcgtccttgtcggtacttccgtaccgttagacgactaggtacctagtccgtaccacgtccggtaccgttccggaccgaccgtacggtaccgtaacggtaacggggaacggtcgtagggacggtttcggttaccctaggtactttaggttaggagttaacgggttcgtaacgttacgttaaacgtaaaccgtaaacggtaccgacgtaaccggtttaccgtaccgggaaggtacccgggtccttacccgttaaccgaccttacgttacccgaaccgtaaggtaacccgttaaacgttaccgtaacgaaacgtcgtaacttaacccgttagtacggtacacgttacgaaacttacgtaacacgtacgacgtacggtaccgtaccggacgtaaaccggccttacccggttacttaagttcgttaaggttccgaaggaccggtaagggttgggggtcgggtaacggttcggacgtttaccggtcggtttacggttccttagggaccccggtgggtacggcggtacgg

SEQ ID NO: 189078 - DNA, 173 bp, Homo sapiens
  misc_feature: GYAE6OF02JEGM7.39.21.B10.1.454.CMB.1.raw
  modified_base (159)..(173): a, c, t, g, unknown or other
  misc_feature (159)..(173): n is a, c, g, or t
tcagtcgcactagtcacgaccggtgctcgatttagtgtcgtcgcaaagaggggtgcagagaactccatggctaccaggtcagcccaaggccaaccccactgtcactctgttcccgccctcctcactagtgcgactgagcgggctggcaaggcgcatagnnnnnnnnnnnnnnn

SEQ ID NO: 189079 - DNA, 802 bp, Homo sapiens
  misc_feature: GYAE6OF02I2L0A.39.21.B10.1.454.CMB.1.raw
  modified_base (624)..(624): a, c, t, g, unknown or other
  misc_feature (624)..(624): n is a, c, g, or t
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtcttttcttgtggcttatttaaaaggtgtccagtgtgaggtgcagctgttggagtcgtgggggaggcgttggtacgaggtcccgggggggttccctggaagtcctcgttcccgtgtcgcacgtcctcgtggacttcaccttcacgcagctatcgcctatcgtacgtcggtccgccgtacggcctaccggagggtaaacgggtccgtagggaacgggttcgggtacctcggttacgttacgtttagggtagggtaagggttcggtggttacgtttaacgttaaccgtaaaccgtttaaccggacctaaccggtccccttaccgggtacggtaaaccggggtcccgtaccgttacccgtaacccgtacttacccgttaccgtaacggaaccggttaaccgtttaacttaaccccgggtaactaaccggtaccgtaccgttcttaaccggttaacttccgttacgaaaccgtaaagtaccgtaaacnccggtactcggtaaggtcccgtacccggaagtacccgtacccggtacctttaacgtatttagttaccggtagacggttaaacgggtcggggtaggggacgggttacggggtacctaccggttccgtttcggggtacgttttacggacccgtttacggggtccgggtacggtaaccggg

SEQ ID NO: 189080 - DNA, 698 bp, Homo sapiens
  misc_feature: GYAE6OF02GPVLC.39.21.B10.1.454.CMB.1.raw
  modified_base (281)..(281): a, c, t, g, unknown or other
  misc_feature (281)..(281): n is a, c, g, or t
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggcttttctgtggctattttaaaaggtgtccagtgtgaggtgcagctgttggagtcgtgggggaggcttggtacagccgggggggtccctggagacgtctcctgtgcagcctctggattccaccttcagcaggctatgccangctgggtcccgccaggctccgagggaagggactggagtcggggtctcggtcgttaagttaggtggaaagttggtgcgttaatacaaactacgcagccctcgtggaacggccgcttcaccatctccagtacgactattaccaagtaccgactacttctagtacgttacctagtaccgtaaaacgttacgaaaccaacgggtccttaggtaaccggtcggacccgggaacggggaaacctaccggggtaaccccttaagttaactttttaagttacggttacggtaccggtaaaacggtgggggttaagggggggggacggtttacgggggggggtaccctttaaccggttcccggttaggggttcccgggtttttacggacccggtttaacgggttcggggggacccggtaacggggg

SEQ ID NO: 189081 - DNA, 179 bp, Homo sapiens
  misc_feature: GYAE6OF01C4TT8.41.89.I01.1.454.CMB.1.raw
  modified_base (178)..(179): a, c, t, g, unknown or other
  misc_feature (178)..(179): n is a, c, g, or t
tcagtctatactatcacgaccggtgctcgatttagtatgctagtatggggtcacagtgttgggtgttcggcggagggaccaagctgaccgtcctaggtcagcccaaggctgccccctcggtcactctgttcccgccctcctcatagtatagactgagcgggctggcaaggcgcatagnn

SEQ ID NO: 189082 - DNA, 210 bp, Homo sapiens
  misc_feature: GYAE6OF01AY4IE.41.89.I01.1.454.CMB.1.raw
  modified_base (180)..(210): a, c, t, g, unknown or other
  misc_feature (180)..(210): n is a, c, g, or t
tcagtctatactatcacgaccggtgctcgatttagtatgctagtattgggggtcacagtgttgggtgttcggcggagggaccaagctgaccgtcctaggtcagcccaaggctgccccctggtcactctgttcccgccctcctcatagtatagactggagcgggctggcaaggcgcatagnnnnnnnnnnnnnnnnnnnnnnnnnnnnnnn

SEQ ID NO: 189083 - DNA, 181 bp, Homo sapiens
  misc_feature: GYAE6OF01DBOL5.41.89.I01.1.454.CMB.1.raw
  modified_base (178)..(181): a, c, t, g, unknown or other
  misc_feature (178)..(181): n is a, c, g, or t
tcagtctatactatcacgaccggtgctcgatttagtatgctagtatgggggtcacagtgttgggtgttcggcggagggaccaagctgaccgtcctaggtcagcccaaggctgccccctggtcactctgttcccgccctcctcatagtatagactgagcgggctggcaaggcgcatagnnnn

SEQ ID NO: 189084 - DNA, 181 bp, Homo sapiens
  misc_feature: GYAE6OF02IG7DV.41.89.I01.1.454.CMB.1.raw
  modified_base (179)..(181): a, c, t, g, unknown or other
  misc_feature (179)..(181): n is a, c, g, or t
tcagtctatactatcacgaccggtgctcgatttagtatgctagtatgggggtcacagtgttgggtgttcggcggagggaccaagctgaccgtcctaggtcagcccaaggctgccccctcggtcactctgttcccgccctcctcatagtatagactgagcgggctggcaaggcgcatagnnn

SEQ ID NO: 189085 - DNA, 182 bp, Homo sapiens
  misc_feature: GYAE6OF02FHDQ8.41.89.I01.1.454.CMB.1.raw
  modified_base (178)..(182): a, c, t, g, unknown or other
  misc_feature (178)..(182): n is a, c, g, or t
tcagtctatactatcacgaccggtgctcgatttagtatgctagtatgggggtcacagtgttgggtgttcggcggagggaccaagctgaccgtcctaggtcagcccaaggctgccccctggtcactctgttcccaccctcctcatagtatagactgagcgggctggcaaggcgcatagnnnnn

SEQ ID NO: 189086 - DNA, 243 bp, Homo sapiens
  misc_feature: GYAE6OF01ACCCP.51.11.A11.1.454.CMB.1.raw
  modified_base (240)..(243): a, c, t, g, unknown or other
  misc_feature (240)..(243): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttccccctggcaccctcctccaagagcacctctgggggcacagcggccctgggctgcctggtcaaggactacttcctcgtagcactctgagcgggctggcaaggcgcatagnnnn

SEQ ID NO: 189087 - DNA, 245 bp, Homo sapiens
  misc_feature: GYAE6OF01C5S8J.51.11.A11.1.454.CMB.1.raw
  modified_base (241)..(245): a, c, t, g, unknown or other
  misc_feature (241)..(245): n is a, c, g, or t
tcagcgatcgtatacacgaccggtgctcgatttagctacgactgcagggaaggtgtgcacgccgctggtcaggcgcctgagttccacggtcaccgtctcctcagcctccaccaagggcccgactcggtcttccccctggcaccctccctccaagagcacctctgggggcacagcggccctgggctgcctggtcaaggactacttcctcgtagcactctgagcgggctggcaagcgcatagnnnnn

SEQ ID NO: 189088 - DNA, 243 bp, Homo sapiens
  misc_feature: GYAE6OF01DXFXF.51.11.A11.1.454.CMB.1.raw
  modified_base (239)..(243): a, c, t, g, unknown or other
  misc_feature (239)..(243): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttccccctggcaccctcctccaagagcacctctggggcacagcggccctgggctgcctggtcaaggactacttcctcgtagcactctgagcgggctggcaaggcgcatagnnnnn

SEQ ID NO: 189089 - DNA, 245 bp, Homo sapiens
  misc_feature: GYAE6OF01C66SY.51.11.A11.1.454.CMB.1.raw
  modified_base (239)..(245): a, c, t, g, unknown or other
  misc_feature (239)..(245): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttcccctggcaccctcctccaagagcacctctgggggcacagcggccctgggctgcctggtcaaggactacttcctcgtagcactctgagcgggctggcaaggcgcatagnnnnnnn

SEQ ID NO: 189090 - DNA, 244 bp, Homo sapiens
  misc_feature: GYAE6OF01A2MI9.51.11.A11.1.454.CMB.1.raw
  modified_base (240)..(244): a, c, t, g, unknown or other
  misc_feature (240)..(244): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnn

SEQ ID NO: 189091 - DNA, 243 bp, Homo sapiens; identical to SEQ ID NO: 189086
  misc_feature: GYAE6OF01EMFXH.51.11.A11.1.454.CMB.1.raw
  modified_base (240)..(243): a, c, t, g, unknown or other
  misc_feature (240)..(243): n is a, c, g, or t

SEQ ID NO: 189092 - DNA, 247 bp, Homo sapiens
  misc_feature: GYAE6OF01DQQH5.51.11.A11.1.454.CMB.1.raw
  modified_base (242)..(247): a, c, t, g, unknown or other
  misc_feature (242)..(247): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttccccctggccaccctcctccaagagcacctctgggggcacagccggccctgggctgcctggtcaaggactacttcctcgtagcactctgagcgggctggcaaggcgcatagnnnnnn

SEQ ID NO: 189093 - DNA, 276 bp, Homo sapiens
  misc_feature: GYAE6OF01BPCSX.51.11.A11.1.454.CMB.1.raw
  modified_base (236)..(236): a, c, t, g, unknown or other
  misc_feature (236)..(236): n is a, c, g, or t
  modified_base (242)..(276): a, c, t, g, unknown or other
  misc_feature (242)..(276): n is a, c, g, or t
tcagcgatcgtatacacgaccggtgctcgatttagctacgactgcaggggaaggtgtgccacgccgctggtccagggcgcctgagttccacggtcaccgtctcctcagcctccaccaaggcccatcggtcttccccctggcaccctcctccaagtgcacctctgggggcacagcgccctgggctgcctggttaaggactacttcctcgtagcgactctgagcgggctggcaaggcncatagnnnnnnnnnnnnnnnnnnnnnnnnnnnnnnnnnnn

SEQ ID NO: 189094 - DNA, 256 bp, Homo sapiens
  misc_feature: GYAE6OF02HFP32.51.11.A11.1.454.CMB.1.raw
  modified_base (241)..(256): a, c, t, g, unknown or other
  misc_feature (241)..(256): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttccccctggcaccctcctccaagagcacctctgggggcacagcggccctgggcctgcctggtcaaggactacttcctcgtagcactctgagcgggctggcaaggcgcatagnnnnnnnnnnnnnnnn

SEQ ID NO: 189095 - DNA, 154 bp, Homo sapiens
  misc_feature: GYAE6OF02FUS1J.51.11.A11.1.454.CMB.1.raw
  modified_base (153)..(154): a, c, t, g, unknown or other
  misc_feature (153)..(154): n is a, c, g, or t
tcagcgatcgtatacacgaccggtgctcgatttagctacgactgcagggcacgaccggtgctcgatttagagtgctacgaagggaaagggcagcgtcactctgttcccaccctcctctcgtagcactctgagcgggctggcaaggcgcatagnn

SEQ ID NO: 189096 - DNA, 243 bp, Homo sapiens; identical to SEQ ID NO: 189086
  misc_feature: GYAE6OF02HQS83.51.11.A11.1.454.CMB.1.raw
  modified_base (240)..(243): a, c, t, g, unknown or other
  misc_feature (240)..(243): n is a, c, g, or t

SEQ ID NO: 189097 - DNA, 253 bp, Homo sapiens
  misc_feature: GYAE6OF02FHB9H.51.11.A11.1.454.CMB.1.raw
  modified_base (240)..(253): a, c, t, g, unknown or other
  misc_feature (240)..(253): n is a, c, g, or t
tcagcgatcgtatacacgaccggtgctcgatttagctacgactgcagggaaggtgtgcacgccgctggtcagggcgcctgagttccacggtcaccgtctcctcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnnnnnnnnnnn

SEQ ID NO: 189098 - DNA, 336 bp, Homo sapiens
  misc_feature: GYAE6OF01ACGEJ.22.67.G01.1.454.CMB.1.raw
  modified_base (308)..(308): a, c, t, g, unknown or other
  misc_feature (308)..(308): n is a, c, g, or t
  modified_base (315)..(336): a, c, t, g, unknown or other
  misc_feature (315)..(336): n is a, c, g, or t
tcagacatacgcgtcacgaccggtgctcgatttagagtatacatattggggtttgggaggagagggttcgagaacctaatgaacattctgtaggggccacagcctcctccaactctgcctccctcaccatctctggactgaagactgaggacgaggctgactactactgtcagtccttatgatagccgcggtcatgtggtcttcggcggagggaccaagctgaccgtcctaggtcagcccaaggctgccccctggtcactctgttcccacctcctcacgcgtatgtactgagcgggctggcaagggcncatagcnnnnnnnnnnnnnnnnnnnnnn

SEQ ID NO: 189099 - DNA, 311 bp, Homo sapiens
  misc_feature: GYAE6OF01B1Z9U.22.67.G01.1.454.CMB.1.raw
  modified_base (308)..(311): a, c, t, g, unknown or other
  misc_feature (308)..(311): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttcccaccctcctcacgcgtatgtctgagcgggctggcaaggcgcatagnnnn

SEQ ID NO: 189100 - DNA, 311 bp, Homo sapiens
  misc_feature: GYAE6OF01C428W.22.67.G01.1.454.CMB.1.raw
  modified_base (302)..(302): a, c, t, g, unknown or other
  misc_feature (302)..(302): n is a, c, g, or t
  modified_base (308)..(311): a, c, t, g, unknown or other
  misc_feature (308)..(311): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctggtcactctgttcccaccctcctcacgcgtatgtctgagcgggctggcaaggcncatagnnnn

SEQ ID NO: 189101 - DNA, 310 bp, Homo sapiens
  misc_feature: GYAE6OF01DYW66.22.67.G01.1.454.CMB.1.raw
  modified_base (308)..(310): a, c, t, g, unknown or other
  misc_feature (308)..(310): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttcccaccctcctcacgcgtatgtctgagcgggctggcaaggcgcatagnnn

SEQ ID NO: 189102 - DNA, 315 bp, Homo sapiens
  misc_feature: GYAE6OF01CD3L1.22.67.G01.1.454.CMB.1.raw
  modified_base (304)..(315): a, c, t, g, unknown or other
  misc_feature (304)..(315): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagtcttatgatagccgcggtcatgtggtcttcggcggagggaccaagctgaccgtctaggtcagcccaaggctgcccctggtcactctgttcccgcctcctcacgcgtatgtctgagcgggctggcaaggcgcatagnnnnnnnnnnnn

SEQ ID NO: 189103 - DNA, 317 bp, Homo sapiens
  misc_feature: GYAE6OF01CGTOI.22.67.G01.1.454.CMB.1.raw
  modified_base (308)..(317): a, c, t, g, unknown or other
  misc_feature (308)..(317): n is a, c, g, or t
tcagacatacgcgtcacgaccggtgctcgatttagagtatacatagttgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctggtcactctgttcccgcctcctcacgcgtatgtctgagcgggctggcaaggcgcatagnnnnnnnnnn

SEQ ID NO: 189104 - DNA, 365 bp, Homo sapiens
  misc_feature: GYAE6OF01CJES5.22.67.G01.1.454.CMB.1.raw
  modified_base (323)..(365): a, c, t, g, unknown or other
  misc_feature (323)..(365): n is a, c, g, or t
tcagacatacgcgtcacgaccggtgctcgatttagagtatacatattgggtttggggaggagagggttgagaaccctatgaacattctgtaggggccacagctccgtcccaactctgcctccctcgaccatctctggactgaagactgaggacgaggctgactactactgtcagtcttatgactagccgcggtcatgtggtcttcggcggagggaccaagctgaccgtcctaggtcagcccaaggctcgccccctaggtctacttctcgttccccaccctcctcaacgcgtaatcgtctgagcggctggcaaggcgcactagnnnnnnnnnnnnnnnnnnnnnnnnnnnnnnnnnnnnnnnnnnn

SEQ ID NO: 189105 - DNA, 310 bp, Homo sapiens
  misc_feature: GYAE6OF01CJQH4.22.67.G01.1.454.CMB.1.raw
  modified_base (307)..(310): a, c, t, g, unknown or other
  misc_feature (307)..(310): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttcccgcctcctcacgcgtatgtctgagcgggctggcaaggcgcatagnnnn

SEQ ID NO: 189106 - DNA, 313 bp, Homo sapiens
  misc_feature: GYAE6OF01EGT4Y.22.67.G01.1.454.CMB.1.raw
  modified_base (310)..(313): a, c, t, g, unknown or other
  misc_feature (310)..(313): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctggtcactctgttccccgccctcctcacgcgtatgtctgagcgggctggcaaggcgcgatagnnnn

SEQ ID NO: 189107 - DNA, 314 bp, Homo sapiens
  misc_feature: GYAE6OF01CGHOX.22.67.G01.1.454.CMB.1.raw
  modified_base (309)..(314): a, c, t, g, unknown or other
  misc_feature (309)..(314): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttcccgccctcctcacgcgtatgtctgagcgggctggcaaggcgcatagnnnnnn

SEQ ID NO: 189108 - DNA, 334 bp, Homo sapiens
  misc_feature: GYAE6OF01DXQ0J.22.67.G01.1.454.CMB.1.raw
  modified_base (310)..(334): a, c, t, g, unknown or other
  misc_feature (310)..(334): n is a, c, g, or t
tcagacatacgcgtcacgaccggtgctcgatttagagtatacatagttgggtttgggaggagagggttgagaacctatgaacattctgtaggggccacagctcctccaactctgcctccctcaccatctctggactgaagactgaggacgaggctgactactactgtcagtcttatgatagccgcggtcagtgtggtcttcggcggagggaccaagctgaccgtcctaggtcagcccaaggcctgccccctcggtcactctgtcccgccctctcacgcgtatgtctgagcgggctggcaaggcgcatagnnnnnnnnnnnnnnnnnnnnnnnnn

SEQ ID NO: 189109 - DNA, 142 bp, Homo sapiens
  misc_feature: GYAE6OF01A09A7.22.67.G01.1.454.CMB.1.raw
tcagacatacgcgtcacgaccggtgctcgatttagagtatacatattgggtttgggaggagagggttgagaacctatgaacattctgtagggccacagctcctccaactctgcctccctcaccatctctggactgaagactg

SEQ ID NO: 189110 - DNA, 313 bp, Homo sapiens
  misc_feature: GYAE6OF01DE11Q.22.67.G01.1.454.CMB.1.raw
  modified_base (310)..(313): a, c, t, g, unknown or other
  misc_feature (310)..(313): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtctaggtcagcccaaggcctcgccccctggtcactctgttccccaccctcctcacgcgtatgtctgagcggctggcaaggcgacatagnnnn

SEQ ID NO: 189111 - DNA, 339 bp, Homo sapiens
  misc_feature: GYAE6OF01AZSVH.22.67.G01.1.454.CMB.1.raw
  modified_base (184)..(184): a, c, t, g, unknown or other
  misc_feature (184)..(184): n is a, c, g, or t
  modified_base (277)..(277): a, c, t, g, unknown or other
  misc_feature (277)..(277): n is a, c, g, or t
  modified_base (318)..(339): a, c, t, g, unknown or other
  misc_feature (318)..(339): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgnggtcagtgtggtcttcgggcggagggaccaagctcgaccgtcgtaggtcacgcccaaggctccgccccgtggtcacttctcgtcccacctccncacgctatcgtctggcggcggctaggcgaaggcgcagtagnnnnnnnnnnnnnnnnnnnnnn

SEQ ID NO: 189112 - DNA, 369 bp, Homo sapiens
  misc_feature: GYAE6OF01BSKZV.22.67.G01.1.454.CMB.1.raw
  modified_base (276)..(276): a, c, t, g, unknown or other
  misc_feature (276)..(276): n is a, c, g, or t
  modified_base (332)..(369): a, c, t, g, unknown or other
  misc_feature (332)..(369): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggcctgactactactgtcagtcttatgatgccgcggtcatgtggtcttcgggcggagggaccaagctgaccgtccgtaggtcacgccccgaaggcctccgccccctcggtcactcttccgtccccnccctcctcgacgtcgtatcgtcgtggacggcggtcgtcggacgacggccacagtgnnnnnnnnnnnnnnnnnnnnnnnnnnnnnnnnnnnnnn

SEQ ID NO: 189113 - DNA, 368 bp, Homo sapiens
  misc_feature: GYAE6OF01B43TT.22.67.G01.1.454.CMB.1.raw
  modified_base (182)..(182): a, c, t, g, unknown or other
  misc_feature (182)..(182): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (339)..(368): a, c, t, g, unknown or other
  misc_feature (339)..(368): n is a, c, g, or t
tcagacatacgcgtcacgaccggtgctcgatttagagtatacatattgggtttgggaggagagggttgagaacctatgaacattctgtaggggccacagctcctccaactcctgcctcctcacatctctggactcgaagactgaggacgaggctagacctactacgtgtcagttctaatganacgccgtcggtcagtgtggtacttcgggaggaggaccaagtctcggaccgtctacgtcacgcccgaagtctccgccccgtggtccacttcgtccgtcccccnccctacgtcgaccgtcgttatcgtcgnggcggcggtacgnggacgacgctacagnnnnnnnnnnnnnnnnnnnnnnnnnnnnnn

SEQ ID NO: 189114 - DNA, 312 bp, Homo sapiens
  misc_feature: GYAE6OF02FK2M4.22.67.G01.1.454.CMB.1.raw
  modified_base (308)..(312): a, c, t, g, unknown or other
  misc_feature (308)..(312): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttcccgccctcctcacgcgtatgtctgagcgggctggcaaggcgcatagnnnnn

SEQ ID NO: 189115 - DNA, 310 bp, Homo sapiens
  misc_feature: GYAE6OF02GBVF4.22.67.G01.1.454.CMB.1.raw
  modified_base (308)..(310): a, c, t, g, unknown or other
  misc_feature (308)..(310): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagtcttatgatagccgcggtcatgtggtcttcggcggagggaccaagttgaccgtcctaggtcagcccaaggctgccccctcggtcactctgttcccaccctcctcacgcgtatgtctgagcgggctggcaaggcgcatagnnn

SEQ ID NO: 189116 - DNA, 310 bp, Homo sapiens
  misc_feature: GYAE6OF02FWX2P.22.67.G01.1.454.CMB.1.raw
  modified_base (309)..(310): a, c, t, g, unknown or other
  misc_feature (309)..(310): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttcccaccctcctcacgcgtatgtctgagcgggctggcaaggcgcatagnn

SEQ ID NO: 189117 - DNA, 314 bp, Homo sapiens
  misc_feature: GYAE6OF02HUTCB.22.67.G01.1.454.CMB.1.raw
  modified_base (310)..(314): a, c, t, g, unknown or other
  misc_feature (310)..(314): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagccaaggctcgccccctggtcactctgttccccgccctcctcacgcgtatgtctgagcgggctggcaaggcgcagtagnnnnn

SEQ ID NO: 189118 - DNA, 314 bp, Homo sapiens
  misc_feature: GYAE6OF02G4T23.22.67.G01.1.454.CMB.1.raw
  modified_base (311)..(314): a, c, t, g, unknown or other
  misc_feature (311)..(314): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctcgccccctcggtcactctgttccccaccctcctcacgcgtatgtctgagcgggctggcaaggcgcatagnnnn

SEQ ID NO: 189119 - DNA, 324 bp, Homo sapiens
  misc_feature: GYAE6OF02JOL50.22.67.G01.1.454.CMB.1.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (306)..(324): a, c, t, g, unknown or other
  misc_feature (306)..(324): n is a, c, g, or t
tcagacatacgcgtcacgaccggtgctcgatttagagtatacatattgggtttgggaggagagggttgagaacctatgaacattctgtagggccacagctcctccaactctgcctccctcaccatctctggactgaagactgaggacgaggctgactactactgtcagttcttatgatagccgcggtcatgtggtcttggcggaggaccaagctgaccgtcctaggtcagcccaagctcgcccctggtcactctctcccncctcncacgtcgtactcgtctgcgcggtcgtggacgacgcnagtgnnnnnnnnnnnnnnnnnnn

SEQ ID NO: 189120 - DNA, 336 bp, Homo sapiens
  misc_feature: GYAE6OF02JES35.22.67.G01.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
  modified_base (321)..(336): a, c, t, g, unknown or other
  misc_feature (321)..(336): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccggcggtacntggtggtcttcggnggaggaccaagctgaccgtcaggtcagaccaggctacgcccctggtcacctctcgttccccgccctcctccgacgtccgtatcgtcgtgacggtcggctggcagggccncgatcgnnnnnnnnnnnnnnnn

SEQ ID NO: 189121 - DNA, 333 bp, Homo sapiens
  misc_feature: GYAE6OF02I2IJN.22.67.G01.1.454.CMB.1.raw
  modified_base (318)..(318): a, c, t, g, unknown or other
  misc_feature (318)..(318): n is a, c, g, or t
  modified_base (321)..(333): a, c, t, g, unknown or other
  misc_feature (321)..(333): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggaggaccaagctcgaccgtctaggtcgacgaccgaaggctccgccccctcggtcacctcctcgttccccgcccgtcctcgacgtctatgtctgaggcggtcgtgcgaagcgtcanagnnnnnnnnnnnnn

SEQ ID NO: 189122 - DNA, 320 bp, Homo sapiens
  misc_feature: GYAE6OF02HCHCV.22.67.G01.1.454.CMB.1.raw
  modified_base (310)..(320): a, c, t, g, unknown or other
  misc_feature (310)..(320): n is a, c, g, or t
tcagacatacgcgtcacgaccggtgctcgatttagagtatacatattgggtttgggaggagagggttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcggtcactctgttccccgccctcctcacgcgtatgtctgagcgggctggcaaggcgcatagnnnnnnnnnnn

SEQ ID NO: 189123 - DNA, 413 bp, Homo sapiens
  misc_feature: GYAE6OF01D7CEN.12.41.D08.1.454.CMB.1.raw
  modified_base (407)..(413): a, c, t, g, unknown or other
  misc_feature (407)..(413): n is a, c, g, or t
tcagatacgacgtacacgaccggtgctcgatttagtcacgcgagaaagggaagggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatcttcccgccatctgatacgtcgtatctgagcgggctggcaaggcgcatagnnnnnnn

SEQ ID NO: 189124 - DNA, 415 bp, Homo sapiens
  misc_feature: GYAE6OF01AOW39.12.41.D08.1.454.CMB.1.raw
  modified_base (407)..(415): a, c, t, g, unknown or other
  misc_feature (407)..(415): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcacatctgtcttcatcttcccgcatctgatacgtcgtatctgagcgggctggcaaggcgcatagnnnnnnnnn

SEQ ID NO: 189125 - DNA, 422 bp, Homo sapiens
  misc_feature: GYAE6OF01CI3K8.12.41.D08.1.454.CMB.1.raw
  modified_base (412)..(422): a, c, t, g, unknown or other
  misc_feature (412)..(422): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgctactttattactgtcagcactataataattggcctccggatacacctttggccaggggaccaagctggagatacaaacgactgtggctgcaccatctgtatcatctccgctatctgatacgtcgtatctgagcgggctggcaaggcgcatagnnnnnnnnnnn

SEQ ID NO: 189126 - DNA, 422 bp, Homo sapiens
  misc_feature: GYAE6OF01EMUXS.12.41.D08.1.454.CMB.1.raw
  modified_base (414)..(422): a, c, t, g, unknown or other
  misc_feature (414)..(422): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgctactttattactgtcagcactataataattggcctccggagtacacctttggccaggggaccaagctggagatcaaacgactgtggctgcaccatctgtcttcatcttcccgcatctgatacgtcgtatctgagcgggctggcaaggcgcatagnnnnnnnnn

SEQ ID NO: 189127 - DNA, 424 bp, Homo sapiens
  misc_feature: GYAE6OF01CLAPX.12.41.D08.1.454.CMB.1.raw
  modified_base (327)..(327): a, c, t, g, unknown or other
  misc_feature (327)..(327): n is a, c, g, or t
  modified_base (415)..(424): a, c, t, g, unknown or other
  misc_feature (415)..(424): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgctactttattactgtcagcactataataattggcctcggatacacctttggccagggaccaagctgganatcaaacgactgtggctgcaccatctgtcttcatccttcccgcatctgatacgtcgtatctgagcgggctgggcaaggcgacagtagnnnnnnnnnn

SEQ ID NO: 189128 - DNA, 444 bp, Homo sapiens
  misc_feature: GYAE6OF01CN6ZL.12.41.D08.1.454.CMB.1.raw
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (429)..(444): a, c, t, g, unknown or other
  misc_feature (429)..(444): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcactataataattggcctcggagtacacctttggccaggggaccaaagctggagatcaaacgaactgtggctgcacatcngtcttcattcttcccgcctatctnatacgtcgtatcgtgtaagcgggtctgggaccaagggtccgctaagtagnnnnnnnnnnnnnnnn

SEQ ID NO: 189129 - DNA, 552 bp, Homo sapiens
  misc_feature: GYAE6OF01CQFV6.12.41.D08.1.454.CMB.1.raw
  modified_base (534)..(535): a, c, t, g, unknown or other
  misc_feature (534)..(535): n is a, c, g, or t
  modified_base (537)..(552): a, c, t, g, unknown or other
  misc_feature (537)..(552): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcacatcaccagactgcagtctgatgtatttgctactttatactgtacagtacaacttaataaattaacgttggtacctaccgggtaattacctaccgttttacgggaccggtaacggggacccaaaggccgtaggggaactaacgtaccgaaaacgtaacgtggtacgggacttcggacctacctagttccttagtcctttactacctttcccgttccccgacctacgttccgtactaaccgtttaccgtacgttacttccgtaggacggtccgggtacgttcggaccggaaggtcgaacgtagtagnngnnnnnnnnnnnnnnnn

SEQ ID NO: 189130 - DNA, 423 bp, Homo sapiens
  misc_feature: GYAE6OF01AQH3C.12.41.D08.1.454.CMB.1.raw
  modified_base (414)..(423): a, c, t, g, unknown or other
  misc_feature (414)..(423): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgctactttattactgtcagcactataataattgcctcggagtacacctttggccagggacaagctggagatcaaacgactgtgctgcacatctgtcttcattccttcccgcatctgactacgtcgtatcgtgacgcgggctggcgaaggcgcatagnnnnnnnnnn

SEQ ID NO: 189131 - DNA, 426 bp, Homo sapiens
  misc_feature: GYAE6OF01C05HF.12.41.D08.1.454.CMB.1.raw
  modified_base (416)..(426): a, c, t, g, unknown or other
  misc_feature (416)..(426): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcaggtgggtctgggacagacttcactctcaccatcaccagactgcagtctgatgtattttgctatttattactgtcagcactaataataattggcctcggatacactttggctagggaccagctggagatacaaacgactgtggctgcacatctgtcttcatcctcccgcatctgatacgtcgtatcgtgacggcgggctaggcaacggcgacatgnnnnnnnnnnn

SEQ ID NO: 189132 - DNA, 436 bp, Homo sapiens
  misc_feature: GYAE6OF01CEOBC.12.41.D08.1.454.CMB.1.raw
  modified_base (323)..(323): a, c, t, g, unknown or other
  misc_feature (323)..(323): n is a, c, g, or t
  modified_base (429)..(436): a, c, t, g, unknown or other
  misc_feature (429)..(436): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtgtcagtgggtctgggacagacttcactctcaccatcaccagactgcagtctgatgtatttgctactttattactgtcagcaactataataattggctcggatacactttgcagggacaagctaganatacaaagactgtggctgacacatctagtcttacatccttcccgctacttctgtacgtacgttcgtaatcgtagtacggcgggctacgggcaacgggcgcaatagnnnnnnnn

SEQ ID NO: 189133 - DNA, 436 bp, Homo sapiens
  misc_feature: GYAE6OF01CCRCB.12.41.D08.1.454.CMB.1.raw
  modified_base (427)..(436): a, c, t, g, unknown or other
  misc_feature (427)..(436): n is a, c, g, or t
tcagatacgacgtacacgaccggtgctcgatttagtcacgcgagaaagggaaaggggaaagagccaccctctcctgcagggccagtcagagtgttagcggcaactacttagcctggtaccaacagaaacctggccaggctcccaggctcgtcatctatggtgcatccagcagggccactggcatcccagacaggttcagtgcagtgggtctgggacagacttcactctcaccatcagtagactggagcctgaagtattttgctagtttatactgtcagcagtagtgggggctcgacgtcgattcactttcggcctgggacctaaagtagtatcgtacgaaacgtaacgtgtcggctgcacctatctgtcttcacttcttccgctatctgactacgtcgtatctgacgtcggctggcgagcgcatagnnnnnnnnnn

SEQ ID NO: 189134 - DNA, 422 bp, Homo sapiens
  misc_feature: GYAE6OF01DZ47C.12.41.D08.1.454.CMB.1.raw
  modified_base (416)..(422): a, c, t, g, unknown or other
  misc_feature (416)..(422): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccaggctcccaggctcctcatctatgatgcatccaaaagggccactggcatcccagccaggttcagtggcagtgggtctggggcagacttcactctcaccatccagcagcctagagcctgaagattttgctagtttattactgtcagcagcgtagcaactcggcctcggtttcacttttggcctaggggaccaagctggagatacaaacgaactgtggctgcacatctgtctcatcttcccgcatctgtatcgtctatcgtgagcgggctggcgaaggcgcatagnnnnnnn

SEQ ID NO: 189135 - DNA, 429 bp, Homo sapiens
  misc_feature: GYAE6OF01DF1E1.12.41.D08.1.454.CMB.1.raw
  modified_base (328)..(328): a, c, t, g, unknown or other
  misc_feature (328)..(328): n is a, c, g, or t
  modified_base (396)..(396): a, c, t, g, unknown or other
  misc_feature (396)..(396): n is a, c, g, or t
  modified_base (414)..(429): a, c, t, g, unknown or other
  misc_feature (414)..(429): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccagtccactgacatcccagacaggttcagtggcagtggtctgggacagacttcactctcaccatcaccagactgcagtctgatgtatttgctactttattactgtcagcactataataattggcctcggatacactttggcctaggggacaagctaggaganacaaacgaagtgtaggctgacacatctgtctcatcctccgctatctgtatacgtcgtatctgagcggntggaccaaggcgcatagnnnnnnnnnnnnnnnn

SEQ ID NO: 189136 - DNA, 663 bp, Homo sapiens
  misc_feature: GYAE6OF01E26NM.12.41.D08.1.454.CMB.1.raw
  modified_base (617)..(617): a, c, t, g, unknown or other
  misc_feature (617)..(617): n is a, c, g, or t
  modified_base (629)..(629): a, c, t, g, unknown or other
  misc_feature (629)..(629): n is a, c, g, or t
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
  modified_base (643)..(644): a, c, t, g, unknown or other
  misc_feature (643)..(644): n is a, c, g, or t
  modified_base (647)..(653): a, c, t, g, unknown or other
  misc_feature (647)..(653): n is a, c, g, or t
  modified_base (657)..(660): a, c, t, g, unknown or other
  misc_feature (657)..(660): n is a, c, g, or t
  modified_base (662)..(663): a, c, t, g, unknown or other
  misc_feature (662)..(663): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacactccccagactaggttcaggtggcgtaggtcggggtcgtaggggacacgtacttccacctcctaccaccactccaaccgacgtactcgctagttctagatgttattttcgacttacttttacttacgttacgtcacgacctaacttaattaattaacgttccggtcccgttaccggaaccgtttaccgtaccggtttcggacccgtaaacgggggacctaacggtccgtagggaacgtacgtaaccgaaaacgtacggtgggtacgtccgtacgaccacccgttaagtccgttacgtttaccccttacgtaacccgtttcccttacccccggtactacgttaccgttaccggtaacgttaccgttcgttaacccgttcggtacgggtaccggtcggggtaccgttacgggaaccggtacggccgtaacgtagtacgngtacgcagcgtngcnagtcagntgtnncgnnnnnnngacnnnntnn

SEQ ID NO: 189137 - DNA, 585 bp, Homo sapiens
  misc_feature: GYAE6OF01B8QSA.12.41.D08.1.454.CMB.1.raw
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(585): a, c, t, g, unknown or other
  misc_feature (562)..(585): n is a, c, g, or t
tcagatacgacgtacacgaccggtgctcgattttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcaggtgggtcgtgggacagacttcactctcaccatccaccgagactgctagtctgtatgtattttgactacttttattctgtcagtcactaataataacgttggcccgttaccggagtaccgtaccgtttcgggaccccgaggggtaacccaaggtccgtagggaagtaactaaccgaaaacggtaacgtagtacggggaccttacggccctaaacctacttccgttacgttccgtttctaaccgttccctttaccccggactacttcgttacgtaacgttacccgtttgttaacgtcgtacgggtaacgggtccgggtacgtcgggtaaccgaagggtcctacggaaattggcngtnangnnnnnnnnnnnnnnnnnnnnnnnn

SEQ ID NO: 189138 - DNA, 577 bp, Homo sapiens
  misc_feature: GYAE6OF01CL6BF.12.41.D08.1.454.CMB.1.raw
  modified_base (263)..(263): a, c, t, g, unknown or other
  misc_feature (263)..(263): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (549)..(556): a, c, t, g, unknown or other
  misc_feature (549)..(556): n is a, c, g, or t
  modified_base (558)..(564): a, c, t, g, unknown or other
  misc_feature (558)..(564): n is a, c, g, or t
  modified_base (566)..(567): a, c, t, g, unknown or other
  misc_feature (566)..(567): n is a, c, g, or t
  modified_base (569)..(577): a, c, t, g, unknown or other
  misc_feature (569)..(577): n is a, c, g, or t
tcagatacgacgtacacgaccggtgctcgatttagtcacgcgagaaaggggaaaggggaaaagagccaacccgtctcctgcagggccagtcagagtattagcaccaaacctagcctggtatcaggagaaacctggccaggaccttcccagacttctcatctatgctgcatcctccaggtccatgacatcccagacaggttcagtgcagtgggtctgggacagtacttcactctaccaccactccacctagactgcagtctggnttgtacttttgctattttacttactgtactaggtactacctaattaagtaagttaccggtcctaccggggacgtaacccttaccgtttcgggacccgtaacggggtaaccaaggtcgtagggaatactaaccgaaaacggtacttaggtcgggactcgacaacctattcgtgttacttacgtcgttacccgtcccgtactgtttaccgtgttaaccgttacgttcgtacgtcgtacggtaggggccggtccgtacgggacgaacgggtcacgtanagtnagctgtnnnnnnnntnnnnnnngnngnnnnnnnnn

SEQ ID NO: 189139 - DNA, 653 bp, Homo sapiens
  misc_feature: GYAE6OF01B5VQL.12.41.D08.1.454.CMB.1.raw
  modified_base (124)..(124): a, c, t, g, unknown or other
  misc_feature (124)..(124): n is a, c, g, or t
  modified_base (151)..(151): a, c, t, g, unknown or other
  misc_feature (151)..(151): n is a, c, g, or t
  modified_base (323)..(323): a, c, t, g, unknown or other
  misc_feature (323)..(323): n is a, c, g, or t
  modified_base (602)..(602): a, c, t, g, unknown or other
  misc_feature (602)..(602): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (628)..(629): a, c, t, g, unknown or other
  misc_feature (628)..(629): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
tcagatacgacgtacacgaccggtgctcgatttagtcacgcgagaaagggaaaggggaaagagccaccctctcctgcgagggccagtcagagtattacgcaccaacctagcctggtatcagganaaacctggccagacctcccagacttcnatctatgctgctactccgtccacggtcccactgactactcccagacgtacggttcaggtggctaggtcgggtcgaggggacacgtcttacacgttcctaccgacctacgtaccaaccgtacgactcgacctagtctagtactagttactttcgacttactttatcgtagtanacgtactacttaactaagttaccgtgcccgtacggtactaccgtcgttaccgggacggtaacgggacctacgggcttacggaagtacgtaacgtaaaccggttacgtcgtacggtaccagtaccccgtagttaccttccttacgtaccctttcgtaaccctttcccgttaccgactacgttacgttcggtaaccgttaccgttcgttacgtaccgtagggtacccggcggttacgacggtaaccggtacggacgttcaagtacgtagtcgagctacgtnatcgagcgtagtcngtnatagcgtanncgtanccgtantcnggancngngc

SEQ ID NO: 189140 - DNA, 488 bp, Homo sapiens
  misc_feature: GYAE6OF01BLWUL.12.41.D08.1.454.CMB.1.raw
  modified_base (278)..(278): a, c, t, g, unknown or other
  misc_feature (278)..(278): n is a, c, g, or t
  modified_base (453)..(453): a, c, t, g, unknown or other
  misc_feature (453)..(453): n is a, c, g, or t
  modified_base (455)..(456): a, c, t, g, unknown or other
  misc_feature (455)..(456): n is a, c, g, or t
  modified_base (459)..(460): a, c, t, g, unknown or other
  misc_feature (459)..(460): n is a, c, g, or t
  modified_base (463)..(465): a, c, t, g, unknown or other
  misc_feature (463)..(465): n is a, c, g, or t
  modified_base (467)..(480): a, c, t, g, unknown or other
  misc_feature (467)..(480): n is a, c, g, or t
  modified_base (482)..(488): a, c, t, g, unknown or other
  misc_feature (482)..(488): n is a, c, g, or t
tcagatacgacgtacacgaccggtgctcgatttagtcacgcgagaaagggaaagggggaaagagccaccctctcctgcagggccagtcagagtattagcaccaacctagcctggtatcaggagaaacctggccagactcccagacttctcatctatgctgcatccctccaggtccactgacatcccagacaggttcagtggcagtgggtctgggacagacttcactctcaccatccaccagactgcagtctgattgattttgctacttttatactgtnagcaactataagtaattcggcctaccggagtactacctttggccaaggggacctaagctaggagatcaaacgatgtggctgcactatctgcttcagtccttacccgcatctgaacttaccgtgttaactcgtagacggtacggggctcggacgaaacgggtccgactaatacggngnncgnnagnnngnnnnnnnnnnnnnngnnnnnnn

SEQ ID NO: 189141 - DNA, 565 bp, Homo sapiens
  misc_feature: GYAE6OF01ERPIH.12.41.D08.1.454.CMB.1.raw
  modified_base (553)..(565): a, c, t, g, unknown or other
  misc_feature (553)..(565): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatccctccaggtccactgacatcccagacgtaggttcaggtggcaggtggggtctggggacagacttcacctctcaccatccaccagacctgaccagtctgatgtattttgccttatttattacgtgtacagtactaattaataaagtaacgttccgggtacccttaccgggaacgttaccgtacccggtttcgggacccggaacggggtaacccaaggtcccggttagggagtaacgtaccgaaaaccggtacgttagggtacggtacctacggcctaaccgttacttcttaccggttacctttccgtaaccttcccgttcccgcctaattcgttagtacgtacttacgttctacggttggacgtcgggtctacggacgtacgcgctagcgnnnnnnnnnnnnn

SEQ ID NO: 189142 - DNA, 415 bp, Homo sapiens
  misc_feature: GYAE6OF02I1KCP.12.41.D08.1.454.CMB.1.raw
  modified_base (402)..(402): a, c, t, g, unknown or other
  misc_feature (402)..(402): n is a, c, g, or t
  modified_base (408)..(415): a, c, t, g, unknown or other
  misc_feature (408)..(415): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgctactttattactgtcagcactataataattggcctccggatacacctttggccaggggaccaagctggagatcaaacgactgtggctgcacatctgtcttcatccttccgcatctgatcgtctatctgagcggctggcaggcncatagnnnnnnnn

SEQ ID NO: 189143 - DNA, 416 bp, Homo sapiens
  misc_feature: GYAE6OF02HHYBZ.12.41.D08.1.454.CMB.1.raw
  modified_base (408)..(416): a, c, t, g, unknown or other
  misc_feature (408)..(416): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcagtataataactggttcctgctcactttcggcgggggaccaaggtggagatcaaacgactgtggctgcacatctgtcttcattctcccgctatctgatacgtctatctgagcgggctggcaaggcgcatagnnnnnnnnn

SEQ ID NO: 189144 - DNA, 409 bp, Homo sapiens
  misc_feature: GYAE6OF02F000I.12.41.D08.1.454.CMB.1.raw
  modified_base (409)..(409): a, c, t, g, unknown or other
  misc_feature (409)..(409): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatcttcccgccatctgatacgtcgtatctgagcgggctggcaaggcgcatagn

SEQ ID NO: 189145 - DNA, 418 bp, Homo sapiens
  misc_feature: GYAE6OF02F5BWN.12.41.D08.1.454.CMB.1.raw
  modified_base (414)..(418): a, c, t, g, unknown or other
  misc_feature (414)..(418): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcactataataattggcctccggagtacacctttggccagggaccaagctggagatcaaacgaactgtggctgcaccatctgtcttcatcttcccgccatctgatacgtcgtatctgagcgggctggcaaggcgcatagnnnnn

SEQ ID NO: 189146 - DNA, 418 bp, Homo sapiens
  misc_feature: GYAE6OF02JKNB0.12.41.D08.1.454.CMB.1.raw
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (405)..(418): a, c, t, g, unknown or other
  misc_feature (405)..(418): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtcngggacagacttcactctcacatcaccagactgcagtctgatgtattttgctactttattactntcagcactataatattgcctcgagtacaccttggccagggaccagtctggagactacaaacagtgtgctgcaccntctgtcttcatcctccgctntctnatacgtctatctgagcggctggcaggtcacatgnnnnnnnnnnnnnn

SEQ ID NO: 189147 - DNA, 477 bp, Homo sapiens
  misc_feature: GYAE6OF02IHF0I.12.41.D08.1.454.CMB.1.raw
  modified_base (453)..(477): a, c, t, g, unknown or other
  misc_feature (453)..(477): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgtattttgctacttttattactgtcagcaactataataatggcctcgatactaccttggaccagggaccaagctggagatacgaaacaacgtgtggactgactaaccgattcctgtacttctacttccttacccgcattcctagaacttacgtcttaatctaggacggtcgggtcgtgggacaacgggtcaccgtaagtagnnnnnnnnnnnnnnnnnnnnnnnnn

SEQ ID NO: 189148 - DNA, 460 bp, Homo sapiens
  misc_feature: GYAE6OF02HZD93.12.41.D08.1.454.CMB.1.raw
  modified_base (444)..(460): a, c, t, g, unknown or other
  misc_feature (444)..(460): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcaggtgggtctgggacagacttcacctctcaccatccaccagactgcagtctgatgtattttgctactttattactgtcagctaactaataattaattcggccctcggatactcctttggccgaggggaccaaggctaggagatacaaacgactgtgctgcacatctgtcttcacttcctcccgctattcctgtacttacgtcgttatcgtagacggcgggtctggaacgagggcacgtaagtgnnnnnnnnnnnnnnnnn

SEQ ID NO: 189149 - DNA, 580 bp, Homo sapiens
  misc_feature: GYAE6OF02JOW2G.12.41.D08.1.454.CMB.1.raw
  modified_base (166)..(166): a, c, t, g, unknown or other
  misc_feature (166)..(166): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (542)..(543): a, c, t, g, unknown or other
  misc_feature (542)..(543): n is a, c, g, or t
  modified_base (554)..(554): a, c, t, g, unknown or other
  misc_feature (554)..(554): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagacctcccagacttctcatctatgctgcatccncctaggtcccactgacatcccagacaggttcagtggctagtggggtctggggaccagtacttctactctacaccatccacctagactgcagtctgatgtatttcgactactttcttactgtcatcaactataatagtcggtacctcgagtacctcttggccgtaacgggactaagtcgtaggtacaataccgaaactacgtggtagctagacctacattcgtcgttacttcgtactttaccctcccgtctacttcgtacgttaaacggttccccgttaagttccttaccggaggtaccggtccgggggtacttacggggaacccgtaagggtaccccgaggtacggtactgtacgngtctgtcngtcgtntngtgnnggcgtcgcgcntcgtcgtacacgtcgtcntnatgncg

SEQ ID NO: 189150 - DNA, 447 bp, Homo sapiens
  misc_feature: GYAE6OF02HH8TX.12.41.D08.1.454.CMB.1.raw
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (431)..(447): a, c, t, g, unknown or other
  misc_feature (431)..(447): n is a, c, g, or t
tcagatacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagacctgcagtctgatgattttgctacttttatactgtcagcactataataattggcctcggatactacctttggacctaggggaccaagcgtagaggtatacaaacgacgtagtcggctgcaccattcctagtcttcatcttcccgctatctgatacgtcgtatctgacggcgggntggcaaggccganatagnnnnnnnnnnnnnnnnn

SEQ ID NO: 189151 - DNA, 522 bp, Homo sapiens
  misc_feature: GYAE6OF02HJEA7.12.41.D08.1.454.CMB.1.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (489)..(490): a, c, t, g, unknown or other
  misc_feature (489)..(490): n is a, c, g, or t
  modified_base (492)..(493): a, c, t, g, unknown or other
  misc_feature (492)..(493): n is a, c, g, or t
  modified_base (495)..(498): a, c, t, g, unknown or other
  misc_feature (495)..(498): n is a, c, g, or t
  modified_base (500)..(501): a, c, t, g, unknown or other
  misc_feature (500)..(501): n is a, c, g, or t
  modified_base (503)..(504): a, c, t, g, unknown or other
  misc_feature (503)..(504): n is a, c, g, or t
  modified_base (506)..(509): a, c, t, g, unknown or other
  misc_feature (506)..(509): n is a, c, g, or t
  modified_base (511)..(519): a, c, t, g, unknown or other
  misc_feature (511)..(519): n is a, c, g, or t
  modified_base (521)..(522): a, c, t, g, unknown or other
  misc_feature (521)..(522): n is a, c, g, or t
tcagatacgacgtacacgaccggtgctcgattttagtcacgcgagaaagggaaagggggaaagagccaccctctcctgcagggccagtcagagtattagcaccaacctagcctggtatcaggagaaacctggccagactcccagacttctcatctatgctgcatcctccaggtccactgacatcccagactaggttcagtggacaggtgggtctgggacagtacttcactctacaccanccacagactgcagtcngatgtatttgactatttatactgtcagtcataataatacgttcgcctacggagtcctacgttcggacgagggacaagcgtaggaagactagaaaaccgtagtggtgactcggaacaccctattacgttgtaccttacgactttcccttacccgacctagttctaagtaacgttaccgtctagtcgtacgggcggtcggtatacgggaacgacggaccganaagttcgatganannannannnnannannannnnannnnnnnnnann

SEQ ID NO: 189152 - DNA, 774 bp, Homo sapiens
  misc_feature: GYAE6OF02I82HR.12.41.D08.1.454.CMB.1.raw
  modified_base (710)..(710): a, c, t, g, unknown or other
  misc_feature (710)..(710): n is a, c, g, or t
  modified_base (715)..(715): a, c, t, g, unknown or other
  misc_feature (715)..(715): n is a, c, g, or t
  modified_base (725)..(725): a, c, t, g, unknown or other
  misc_feature (725)..(725): n is a, c, g, or t
  modified_base (728)..(728): a, c, t, g, unknown or other
  misc_feature (728)..(728): n is a, c, g, or t
  modified_base (731)..(732): a, c, t, g, unknown or other
  misc_feature (731)..(732): n is a, c, g, or t
  modified_base (739)..(739): a, c, t, g, unknown or other
  misc_feature (739)..(739): n is a, c, g, or t
  modified_base (742)..(742): a, c, t, g, unknown or other
  misc_feature (742)..(742): n is a, c, g, or t
  modified_base (752)..(752): a, c, t, g, unknown or other
  misc_feature (752)..(752): n is a, c, g, or t
  modified_base (765)..(765): a, c, t, g, unknown or other
  misc_feature (765)..(765): n is a, c, g, or t
  modified_base (769)..(769): a, c, t, g, unknown or other
  misc_feature (769)..(769): n is a, c, g, or t
  modified_base (773)..(773): a, c, t, g, unknown or other
  misc_feature (773)..(773): n is a, c, g, or t
tcagatacgacgtacacgaccggtgctcgatttagtcacgcgagaaagggaaaggggaaagagccaccctctcctgcagggccagtcagagtattagcaccaacctagcctggtatcagggagaaacctggccagactcccagacttctcatctatgctgcatcctccaggtccactgacactcccagactaggttcagtggctaggttgggtctggggacaggtagttccacttcctccaaccagtcacgccagcccgtgccagtcgtagaagtattttgacctaagtttacttacttcgtacgtagtactaagttaattaaacgttaaccgtttcgggtttaccttcggtacccgtttaccgttacccgggtttaccgggggggtaaccggggggggtaaaccccgttaaaaggggggttcgggtaaacggtaaccgttaaaccgtaaaaacccgggttaaccgttagggttacggggtaccttaccgggtacccgtaaccctacggtttaccgttttccgtttaccgttttacccgtttaacgttacccccggttttacccccggtacccttaacgtttcccgttaaccgggtttaacctttaacccgggtttacgttaacccggtttccgtaccgggggttaacggggacccgggggtacgtttaccgggaccggtaaccggggtacctagttaacggtcgtacgnaccgntcgctagcgngtngcnncgtgtanctngtgtacgtgntagcgacgtcgtnactntatnc

SEQ ID NO: 189153 - DNA, 154 bp, Homo sapiens
  misc_feature: GYAE6OF01B4U2P.22.86.H09.1.454.CMB.1.raw
  modified_base (154)..(154): a, c, t, g, unknown or other
  misc_feature (154)..(154): n is a, c, g, or t
tcagacatacgcgtcacgaccggtgctcgatttagtgctatagacttgggtttggggaagaggaagactgacggtcctagcacagcggccctgggctgcctggtcaaggactacttccacgcgtatgtctgagcgggctggcaaggcgcatagn

SEQ ID NO: 189154 - DNA, 156 bp, Homo sapiens
  misc_feature: GYAE6OF01BBI3A.22.86.H09.1.454.CMB.1.raw
  modified_base (156)..(156): a, c, t, g, unknown or other
  misc_feature (156)..(156): n is a, c, g, or t
tcagacatacgcgtcacgaccggtgctcgatttagtgctatagacttgggttttgggggaagaggaagactgacggtcctagcacagcggccctgggctgcctggtcaaggactacttccacgcgtatgtctgagcgggctggcaaggcgcatagn

SEQ ID NO: 189155 - DNA, 502 bp, Homo sapiens
  misc_feature: GYAE6OF01BUO68.22.86.H09.1.454.CMB.1.raw
  modified_base (335)..(335): a, c, t, g, unknown or other
  misc_feature (335)..(335): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgcaattanatggtatgatggaagtaataagactatgtggactcggtgaagggcgatcaccatctcagagacaactccaagaacactctgtttctaccaatcgaacagcctagagaggcgaggacacggcagtgtattacgtgtgcggagagatcgacatagactagggaagtacg

SEQ ID NO: 189156 - DNA, 501 bp, Homo sapiens
  misc_feature: GYAE6OF01COR6B.22.86.H09.1.454.CMB.1.raw
  modified_base (368)..(368): a, c, t, g, unknown or other
  misc_feature (368)..(368): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (496)..(496): a, c, t, g, unknown or other
  misc_feature (496)..(496): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtcccctgatcgcttctctggctccaagtctggcaacacggcctccctgaccatctctgggctccaggctgaagntgaggctgattattactgctgctcatttgcaggcncctacacttgggtnttcgggcggtagggaccaagctgaccgtctaggtcagcccaaggcctgccccctcggcactctcgttcccaccctctcncgtcg

SEQ ID NO: 189157 - DNA, 562 bp, Homo sapiens
  misc_feature: GYAE6OF01CNMXR.22.86.H09.1.454.CMB.1.raw
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaanagcaccaggcaaagcccccagactcatcatttangctgtcaaataagccggccctcgaggggtccctgactcgcttctcgtggctccaagtcctggaccaacaccggccctcccctgaccatcctcgtcgggcctccgaggtctaggaagatgacggtctgatttacttactgctgctctatttcgcaggtccgctactacgttgggtcgttcgggacggacggaccgaagcgtgacccgtcgtaggtccacggacccgaaggtcctcgccccccgtggtacccaccttccgtccggtttcccccgccccttccgtcccgccggtccg

SEQ ID NO: 189158 - DNA, 575 bp, Homo sapiens
  misc_feature: GYAE6OF01CCSP1.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaagaacactctgtttctccaaatgaacagcctgagaggcgaggacacggcagtgtattactgtgcgagagatcgacatgactacgggaaagtcttttgatctcgtggggccaagggacacgtggtcaccgtctcttcacgcctccaccaacgggcccatccggtccttcccccgtggcccgccctcgcctccgacggacgccacccgtccgacgacgccacgacggccggcccgtggggcctcggcccgttgggtaccgaaacgggtacccttaacccgtttcccgaccggtccgttaacgtcggttccgtggtacggg

SEQ ID NO: 189159 - DNA, 745 bp, Homo sapiens
  misc_feature: GYAE6OF01CR3OV.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgccaggctccgggcaaggggctgggagtggggtggctaaagtttagaagttgggtaattggaattaggggaaaagttaaacgtaaaggaacttaagttcggtagggaaccttccgggtaggaaacggggtcccgtaagtttcaaccccgtaattccgttaccccgaaggaacggaaacctaaaccgttaacccgaaaaggaaaccctaaccttaccgtttacggttttaccctaaccctaaaaagttacgaaaaccgaacggtccccgtaagggaacgggaacgggaccgggaaacggggaacccgaaccggggacgtaaacgggtttacggttaaacgtttaacccggtgggttacgggaccggaaacgggtaacggtaacgttaccggtaaaccgtaagttaaccgggtaaaccggttaaaaccggggggtaaaagttttacccggg

SEQ ID NO: 189160 - DNA, 551 bp, Homo sapiens
  misc_feature: GYAE6OF01D2KJC.22.86.H09.1.454.CMB.1.raw
  modified_base (369)..(369): a, c, t, g, unknown or other
  misc_feature (369)..(369): n is a, c, g, or t
  modified_base (529)..(529): a, c, t, g, unknown or other
  misc_feature (529)..(529): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttacaagtatgtctcctggtaccaacaccaccagcggacacgacccccaaatcatgatttatgaggtcactaagcgggcctcgaggggtccctgactcgcttctctggctcaagtctggcacacggcctcctcgaccgtctctgggctcgaggctggaggntggagctagtattatactgtactactcatagtcgcgaggcgctaacgtcgttagggtgttcgggcggaggaccaaggctaggacccgtcgtaggtccacgcccgaaggcctcccggcccccgtggtccaccgttccgttccggttcccccgcccttcccnccgaccgtccgtagtcgtaccg

SEQ ID NO: 189161 - DNA, 633 bp, Homo sapiens
  misc_feature: GYAE6OF01CL5AJ.22.86.H09.1.454.CMB.1.raw
  modified_base (268)..(268): a, c, t, g, unknown or other
  misc_feature (268)..(268): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcaccaggcaaagcccccagactcatcatttangctgtcaataagcggcctcgaggggtccctgatcgcttctctggctcaagtctggccaacacggcctccctgaccatcctcgtgggcctccgaggctaggaacgatggaggtctgtaatttacttactgtctgtcttactatttgcctaggcccgtccttaactaccggtttggggttcgtttccggggccgggtaacgggtacccgtaaaggccgttacgggtaaccccggttcccgttaagggttacccaacggtaccccgtaaacgggtcccgttaccggacccccccgttcgggttaccctaacccgttcccgttcccggtttcccccgccccctttcccgtaccgtacccggttacccgg

SEQ ID NO: 189162 - DNA, 550 bp, Homo sapiens
  misc_feature: GYAE6OF01AMM9R.22.86.H09.1.454.CMB.1.raw
  modified_base (269)..(269): a, c, t, g, unknown or other
  misc_feature (269)..(269): n is a, c, g, or t
  modified_base (341)..(341): a, c, t, g, unknown or other
  misc_feature (341)..(341): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttangctgtcaataacgccggcctcaggggtccctgatcgcttctctggctccaagtctggcaacacggcctcccngaccatctcgtgggctccgaggctgaagagtgaggctgattattactgctgctctatttcgcgaggccgcctacgtaccgtttggggttcgttccgggcgggaacggggtacccaaggtcgtcggaccgtccgtacggtcacggcccgaagggtcctccggcccccgtcggtccaccttccgtccgttccccgccctcctccgccgtcg

SEQ ID NO: 189163 - DNA, 510 bp, Homo sapiens
  misc_feature: GYAE6OF01EI9DJ.22.86.H09.1.454.CMB.1.raw
  modified_base (234)..(234): a, c, t, g, unknown or other
  misc_feature (234)..(234): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (408)..(408): a, c, t, g, unknown or other
  misc_feature (408)..(408): n is a, c, g, or t
  modified_base (505)..(505): a, c, t, g, unknown or other
  misc_feature (505)..(505): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaanagcacccaggcaaagccccagactcatcatttatgctgtcaataacgcggccctcgacggggtccctgactcgcttctctggctccaagtctggcaacncggcctcccngaccatctctgggcctccgaggctgaagatgaggctgattatactgctgcttcatttgcaggccncctactacgttgggtcgtcggcggagggaccaagctgaccgtcaggtcacgccgaggcctcgccccgtcggcacctcgtcgttccccaccctctccncgtcg

SEQ ID NO: 189164 - DNA, 523 bp, Homo sapiens
  misc_feature: GYAE6OF01EGG25.22.86.H09.1.454.CMB.1.raw
tcagacatacgcgtcacgaccggtgctcgatttagtgctatagacttgggtttggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaatcttttgatctcgtggggccaagggacactggtcaccgtctcttcagtcctccaccaacgggcccatccggtcttcccccgtggccgccctgcctcaggacgcaccgtccgagacgcacagccggcctgggctgccgtggacaaggacctacttccgacgctatcgtcgtgacgg

SEQ ID NO: 189165 - DNA, 520 bp, Homo sapiens
  misc_feature: GYAE6OF01A978I.22.86.H09.1.454.CMB.1.raw
  modified_base (329)..(329): a, c, t, g, unknown or other
  misc_feature (329)..(329): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (502)..(502): a, c, t, g, unknown or other
  misc_feature (502)..(502): n is a, c, g, or t
tcagacatacgcgtcacgaccggtgctcgatttagtgctatagacttgagtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggcctcgaggggtccctgatcgcttctctggctcaagtctggcaacncgcctccctgaccatctctgggctccgagctgaagatgaggctgattatactgctgctctattgcnggcnctacgcgttgggtgtcggnggtacggaccaagcgtagaccgtcctaggtccacggcccgaaggtcctcggccccctgggtcccacgttccttaccgttccccncccttccgtccgtaccgg

SEQ ID NO: 189166 - DNA, 518 bp, Homo sapiens
  misc_feature: GYAE6OF01BX8NH.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaagcccccagactcatcatttatgctgtcaataagcggccctcgaggggtccctgatcgcttctctggctcaagtctggcaacacggcctccctgaccatctctcgggctccgaggctgaagatgaggctgattattactgctgctctatttgcaggccgctacgtacgttgggtgttccggcgggagggacccaaggctgacccgtcgtaggtcacgcccgaaggcctcgccccctggtccacttcgtcgttccccgccctcctcgcgtccg

SEQ ID NO: 189167 - DNA, 493 bp, Homo sapiens
  misc_feature: GYAE6OF01DG2NL.22.86.H09.1.454.CMB.1.raw
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (424)..(425): a, c, t, g, unknown or other
  misc_feature (424)..(425): n is a, c, g, or t
  modified_base (431)..(431): a, c, t, g, unknown or other
  misc_feature (431)..(431): n is a, c, g, or t
  modified_base (440)..(441): a, c, t, g, unknown or other
  misc_feature (440)..(441): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataagactatgtggactcgtgaaggccgattcaccatctccagagacaactccaagaacactctgtttctccaaatgaacagcctgagaggcgaggacacggcagtgtattactgtgcgagagatcgacatgactacgggaaagcttttgatctctggggccaaagggacacgtggtcaccgtctcttcagcctccacaagggcccatcgtctcccngcnccnnctcagncacctcganncangcgccngggctgcctggtcaaggcctactccacgtctatgtctggacgg

SEQ ID NO: 189168 - DNA, 677 bp, Homo sapiens
  misc_feature: GYAE6OF01CIPD3.22.86.H09.1.454.CMB.1.raw
  modified_base (273)..(273): a, c, t, g, unknown or other
  misc_feature (273)..(273): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgtggtgttataactatgtctcctggtaaccaacagcaaccaggccaaacgccccagactcatctatttatgtntcgtacaatacgccgtcctcgacggtcctgactcgtcttcgtcgtcgcctacgtaagtcgtacgaccaaccgaccggtccctcccgtacgacctacgttccgtcggtcgggtcctaccggtaaggtccgtaaaggaacgtagtacggtacggtacgttagttaatttaacttacgttcgtcgttcgtaccttacgttagtttcggaccgtacggtaccctaccgttacgttacgggtttcggggttcggttaccgggacggggaaccggtaaccgtaacggtccgtaaccggtaccgttaccggtaggtacccgaccgtacccgaacggtcccgtacccggtccccgtcgtaccctaccttcccgttacccgttaccccctaccccgttcctcccgtcgtaccg

SEQ ID NO: 189169 - DNA, 598 bp, Homo sapiens
  misc_feature: GYAE6OF01CL40H.22.86.H09.1.454.CMB.1.raw
  modified_base (239)..(239): a, c, t, g, unknown or other
  misc_feature (239)..(239): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactcgtgaaggcattcaccatcncagagacaactccaagaacactctgtttacaccaatagaacagcctagagaggcgagacgacggcagtgtattacgtgtgcgagagatcgacagtagaacgtaacgggaattctttagattcgtacgtggggaccaagggacctacgtcggtcctaccgtcttccttcacgtccctaccgaccgacggccctacgtcccggtccttcccccgcgcccgtaccctgcccgtaccgaggaccgccacccgtccgacgtacgaccgacgacggccgtcccgtgggcctccggccgtcggtacccgtaacgggtacccttacccgttcccgaacggttcgtaacgttcggtcgtcggaccggg

SEQ ID NO: 189170 - DNA, 537 bp, Homo sapiens
  misc_feature: GYAE6OF01A4UTU.22.86.H09.1.454.CMB.1.raw
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcaccaggcaaagccccagactcatcatttatgctgtcaataagcggccctcaggggtccctgatcgcttctctggctcaagtctggcaacacggcctccctgaccatctctgggcctccgaggctgaagatgaggctgatttattactgctgctctatttcgcacggccncctacnccgtttgggtgttcgggcggagggaccaagctagacccgtcgtaggtccacgaccccgaaggcctcgccccccgttcggtccctaccgtccgttccgttccccaccccttccctccgtccgtccg

SEQ ID NO: 189171 - DNA, 513 bp, Homo sapiens
  misc_feature: GYAE6OF01BJV5N.22.86.H09.1.454.CMB.1.raw
  modified_base (404)..(404): a, c, t, g, unknown or other
  misc_feature (404)..(404): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccgaggctgaagatgaggctgattattactgctgctctatttgcaggcncctacacgttgggtgttcgggcggagggaccaagctgaccgtcctacggtcacgcccgaaggcctgcccccgtcggtccactcctcgttccccgccctcctcgcgtccg

SEQ ID NO: 189172 - DNA, 746 bp, Homo sapiens
  misc_feature: GYAE6OF01BP5MI.22.86.H09.1.454.CMB.1.raw
  modified_base (270)..(270): a, c, t, g, unknown or other
  misc_feature (270)..(270): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagccaccaggcaaacgcccccagactcatcatttangctgtcaataacgcggccctcgacggggtcctgatcgcttctctggctcaagtctggaccaacaccggtcctcccgtacgacctatcctcgtcggggcctccgagggtcctaggaagtagtggacggtcttagtaactttaacgttacgtggtcttcgtaccttacgtagttttcggccgtaacgggtcccgtacccgtttaaccgtaccgggttttacgggggttcggtttaccgggggaccgggtaacggggtaaccccgtaaacgggtcccgttaccgggtacccccggttacccggttaacggggtaccccgaaccgggtacccccggtaaacggggtcccccgtttaccccgggtaccccccccggttttaccgggttcccccgttaaccccggttttccccggtttccccggttttcccccccccggtacccccgtttcccccgttccccggtaacccgggttaccccgg

SEQ ID NO: 189173 - DNA, 769 bp, Homo sapiens
  misc_feature: GYAE6OF01CVPBW.22.86.H09.1.454.CMB.1.raw
  modified_base (268)..(268): a, c, t, g, unknown or other
  misc_feature (268)..(268): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctctggtaccaacagcaccaggacaacgccccagactcatctatttangtctgtacaataacgccggcctcgacgggtccctgactcgtcttctccgtaggcctaccgtaagtcctggacctaaaccgaccggtacccttaccccgtaaacctcgtacctccgtcgggtaccttaccgtagtttacggaacggtacgtacgttaccttactttaacttacgtcgtaccttaacgtttacccgttttaaaagttacgggccttacccgttaacgttccgtttccgggtttcggggtttttaccgggaccggggtaacggtaccggtaacccgggtaacggttcccggtaacccggttcccggtaccggggtaacccgtaaccggtaccccggtaaacgggtcccgttaccccggtacccccgttccgggttaccctaacccgtttccccggttacccgttaccccccgtacccccgttcccgttaccccgtaccggttacccgtttaaccgtcggtttacccggtacgggtaccggggtcccggtccggg

SEQ ID NO: 189174 - DNA, 566 bp, Homo sapiens
  misc_feature: GYAE6OF01EJVTD.22.86.H09.1.454.CMB.1.raw
  modified_base (333)..(333): a, c, t, g, unknown or other
  misc_feature (333)..(333): n is a, c, g, or t
  modified_base (399)..(399): a, c, t, g, unknown or other
  misc_feature (399)..(399): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaacgcccccagactcatcatttatgctgtcaataagcggccctcgacggggtccctgactcgcttctctggctccaagtctggcaacncgcctcctgaccatctcgtgggcctccaggctgaagagtgaggtctgtattattactgctgtcctntatttcgcacggccgtacctacgtacgttgggtcgttcgggacggtacggggaccaaggtctacggtacccgttaccgtacggtcaccggacccgaacgggtccctccggcccccgttcggtaccctaccgttccgttccgttcccccgcccctccgtcgacgtccg

SEQ ID NO: 189175 - DNA, 602 bp, Homo sapiens
  misc_feature: GYAE6OF01B4ZM7.22.86.H09.1.454.CMB.1.raw
  modified_base (346)..(346): a, c, t, g, unknown or other
  misc_feature (346)..(346): n is a, c, g, or t
tcagacatacgcgtcacgaccggtgctcgatttagtgctatagacttggggtttgggggctttgcctgggctctgctcctcctcagcctccttcactcagggcacaggatcctgggctcagtcgtgccctgactcagcctcgctcagtgtccgggtctcctggacagtcagtcaccatctcctacactggaaccagcagtgatgttggtggttataactatgtctcctaggtaccaacagcaccaggcaaacgccccaagactcatccaatttactgctgtcaataagccggcccgtcgacggggtccctgactcgtcttctcgtggctccgaagtctggacaacncgcctccctgaccatcctctcgggcctccgaggcctaggaagattggaggtctagtatttattacgtgctgacttctatttcgctacggcctcctacgtacgttgggtcggttaccgggacgggtagggaccaaggtcctacggtacccgttcgtacgggtccacggaccccaaagggtcccttccggtccccccgttcggtccctaccgttcccgttccggttccccccgacccttcccgtccgaccggttaccg

SEQ ID NO: 189176 - DNA, 533 bp, Homo sapiens
  misc_feature: GYAE6OF01A26XE.22.86.H09.1.454.CMB.1.raw
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtggctatggcatgcactggctccgcaggctccgggcaaggggctggagtgggtctcgagctgttagtgggtggtgagtgggtgcacatacgtacgcagacgtccgtagaacgggtcccggttcaccgatcctaccagacgactaacttaccaaagaacctaccctatactatagacaaatagaacacgcctagagacgaccgaacgacacgaccgtataactcgtagtacgcggaggtcgtgactacgacgngcgnggtcg

SEQ ID NO: 189177 - DNA, 555 bp, Homo sapiens
  misc_feature: GYAE6OF01B4M8G.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaaatgaaacagcctgagaggcgaggacacggcagtgtattactgtgcgagagatcgacatgactaacgggaaatcttttggctcgtggggccaaaggggacacgttggtcaccgtctcttcagccctccaccaacggggccccagtccgtccttcccccgtggcccgcccctcgcctccgaggacgcaccctccgagacgcacgacgccggccctgggcctgcccgtggtacgaagggccttaccgttcccgacgtcgtatggtctggaggtccgggg

SEQ ID NO: 189178 - DNA, 714 bp, Homo sapiens
  misc_feature: GYAE6OF01DMB4B.22.86.H09.1.454.CMB.1.raw
tcagacatacgcgtcacgaccggtgctcgatttagtgctatagacgttaggggtttggggaggcgtggtccagcctgggaggtccctgagactctcctgtgcagcgtctggattcaccttcacgtggctatggcgatgcgactggcctccgccaggcctccgggcaaggggctggagtgggtggcgaattatagtggtatgatggaagtaataaagctatgtggactccgtgagggccgattcgactatctccagtacgacactaccaagaacactctgttacaccaactagacagacctgagaggcgaggacgacggcgagtgtagttacgtgtgcgagacgtagtcgactatagtacgtaacgggaacgtacgttttaggaacttccgtcggtacggggacccgtaaaggggtacctacggttcggttacccgtaacccggttccgttaccgtttacgaacggtccccgtacccgaacccgtaaccggggtacccctaacgttcccgggttccccttacccccgtcgggtccccgtcccgttcgtcccgttaccgacgggacgacccgtaacccggtacccggtaggtaccggtaccgaccggtacggcccgggtcccggtcgggtccgtaccgtacccggttacggtaaccggaacgggtacccttaccgtcccgtaccggtaccgttatccggttcgtcgggtacccggg

SEQ ID NO: 189179 - DNA, 554 bp, Homo sapiens
  misc_feature: GYAE6OF01ETZ8S.22.86.H09.1.454.CMB.1.raw
  modified_base (425)..(425): a, c, t, g, unknown or other
  misc_feature (425)..(425): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaaataagcggccctcagggtccctgatcgcttctctggctcaagtctggcaacacggcctccctgaccatctctgggctccaggctgaagatgagctgattattactgtctgcttcgattttgctagggcgccgttacgacctttggggngtttcggggccggtaaggggacccaagggccttaggacccggttcctaagggttccaaggtccccaagggccctaggcccccctcgggtcccacgttcctacgtttccccgcccttccctccacgtccg

SEQ ID NO: 189180 - DNA, 709 bp, Homo sapiens
  misc_feature: GYAE6OF01CKAOZ.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctccctccgcgtccgggtctcctggacagtcagtcaccatctcctacactggaaccagcagtgatgttggtgttataactatgtctcctggtaccaacagcacccaggacaaacgccccagactcatctatttatgctgtacaataagccggccctcgacgggtccctgactccgtcttctctcggcctccgaagtctggaccaacgaccggtccctcccgtagaccctatcctcgtcgggtcctccgaggctagaagtagtggaggtctagtatttacttacgtgtctgtccttcgtagtttcgaccgtacgggtcccgtaccgttaacgtacgggttttcggggttccgggtttacgggggaccgggtaaccggggaaccctaaacgggtcccgttaaccgggtaaccccgtttacccggttaacgggtacccgaaccggtacccccggtaacgggtccccgttaccccggtacccccccggtttccggtaccccttacccgtttcccgttaccccgtttccccccaaccccgtttcccctaccggtacccggttccgttaacgttcccggg

SEQ ID NO: 189181 - DNA, 682 bp, Homo sapiens
  misc_feature: GYAE6OF01E0MDY.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagttttggctgagctgggttttcctcgttgctcttttaagaggtgtccagtgtcaggtgcagctggtggagtcgtgggggagcgtggtccagccgtgggacgtccctgagactctcctgtgcagcgtctggattcaccttcagtggctatggcatgcacgtggcctccgccaggccgtccgggcgaaggggtctgggaggtgggtcggactaagttagtagtggtaatggaagtagggaaagttaaagtaaagactagtggtaggaccttccggtaggaacggggtccgtaactttccaacctacgttcctacccgaaggaacgaaccaacctacccaaacgtaacctaccttcgttacggttttaccctaacctaaagtacgaaaccgtaacggtacccgttagggaacggaacgggtaccggaacgggaaccgaacccggggtactaacgggtttacggttaacgtttaacggtcgggttaggaccggtaaggtaggtacgtaccggaactagttacggaaacggttaaaccggggtaaagtttaccgg

SEQ ID NO: 189182 - DNA, 626 bp, Homo sapiens
  misc_feature: GYAE6OF01CSH18.22.86.H09.1.454.CMB.1.raw
  modified_base (235)..(235): a, c, t, g, unknown or other
  misc_feature (235)..(235): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngcaccaggcaaacgcccccagactcatctatttatgctgtacaataagccggccctcgacggggtccctgactcgcttctctggctcaagtctggcaacgacggcctccctgaccatctcgtcgggcctccgaggctagaagtagtgaggtctagtattattactgctgctctatttgcgacggccgtaccctacgtacgtttggggtcggttccggggacgggtacgggaccgaacggtccgtacggacccgttccgtaacgggttcccgaaccggtaccccgaaacgggtcccgttaccggtcccccccggttcgggttacccctacccgtttcccgttccccggttttaccccccgcccccgtttcccctccgtaacccggttcccgg

SEQ ID NO: 189183 - DNA, 630 bp, Homo sapiens
  misc_feature: GYAE6OF01CSK2L.22.86.H09.1.454.CMB.1.raw
  modified_base (242)..(242): a, c, t, g, unknown or other
  misc_feature (242)..(242): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatcnccagagacaactccaagaacactctgtttctaccaaatgaacagcctgagaggcgaggacacggcaggtgtattactgtagcgagagatcgacatgacgtaacgggaaatcgttttagattcgtcgtggggaccgaaagggacacgttggtccaccggttccttcttcacgcccttccgaacccgaacgggccccacgttccggttaccctttccccccgtcgggtcccgtccccgtcggtccctccgaacgggacgcccgaacccgttccggaacgtaacggcccacgaccggacccggccccgtggggccctacggtccccgttgggtacccgaaacggtaccttaccgtccccgtacggtccgttagttcggtcgtggtaccggg

SEQ ID NO: 189184 - DNA, 690 bp, Homo sapiens
  misc_feature: GYAE6OF01CNMYN.22.86.H09.1.454.CMB.1.raw
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
tcagacatacgcgtcacgaccggtgctcgatttagtgctatagacttgggtttggggctttgcctggctctgctcctcctcagcctcctcactcaggcacaggatcctggctcagtctgccctgactcagcctcgctcagtgtccggtctcctggacagtcagtccaccatcctcctacactggaaccagcagtgatggttgtagttataactatgtctcgtaggtaccaancgccaccaggccaacgccccagacctcatctattangtactacgtcaagtaacgccggcctacgtacgggtcctcgtactccgtcttctcgtcggctacctaacgtcgtcggacctaacgaccggtcctcccgtacgacctactccgtacgtcgggtaccctccgtacggtcttacggaacggtactaggacggtctacgtaactttacttacgttccgtacttaacctcgtaacttacgtcgccgtaagggtcccgtaaccgtaaccgtttcgggttacgggttaccggttcggggtaccgggaaccgggtacccgaacggttcccgtagggaccccgttaccggtaacgtccggacccgtaccgaaccgggttcccgtacccggtccccccggtggttaccccaccgttcccgttacccgtaccccgttaacccctcccgttccgtaccgttcccg

SEQ ID NO: 189185 - DNA, 622 bp, Homo sapiens
  misc_feature: GYAE6OF01CY5S1.22.86.H09.1.454.CMB.1.raw
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (392)..(392): a, c, t, g, unknown or other
  misc_feature (392)..(392): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaacngcaccaggacaaacgcccccagactcatctatttangctgtacaataacgccggccctgacggggtccctgactccgcttctctggctaccaagtcctggaccaacgaccggcccttcccgtacgacccattcctcgtcgggcctcgaggtctagaagntggagctagtatttacttactgctgcttctatttcggcgacggtccgtacccttacgtacgttttggtcgttacgggttccggggacggggtacggtaacccgaacggtccttacgggtaaccccgttaccgtaacggtccaacgggtaccccgaacgggtccctcccggtccccccgtcggttcccaccgttcccttaccgttcccccaaccccttccgtcgtacccgg

SEQ ID NO: 189186 - DNA, 515 bp, Homo sapiens
  misc_feature: GYAE6OF01DF1TJ.22.86.H09.1.454.CMB.1.raw
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaaggccgattcaccatctccagagacaactccaaagaacactctgtttctccaaatgaacagcctgagaggcgaggacacggcagtgtattactgtgcgagagatcgacatgaactaacgggaaatcttttagattctcgtggggaccaaagggacacgtggtacaccgtctcttcagccctcaccaaggcccatcgtccttccccgngccgccctgcctcaggacncaccgtcgagcgcacagccggccnggctcgcctggcaaggctactccacgctatgtcgtgacgg

SEQ ID NO: 189187 - DNA, 504 bp, Homo sapiens
  misc_feature: GYAE6OF01AV04T.22.86.H09.1.454.CMB.1.raw
  modified_base (432)..(432): a, c, t, g, unknown or other
  misc_feature (432)..(432): n is a, c, g, or t
  modified_base (458)..(459): a, c, t, g, unknown or other
  misc_feature (458)..(459): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgccaggctccgggcaaggggctgggagtgggtggcaattatagtggtatgatggaagtaataaagactatgtggactccggtgaagggcatcaccatctcagagacaacacaagaacactctgttctaccaatnaacagacctgagaggcgaggacaggnngtgtatacgtgngcgagagancgacagtagacgtagggaagttcg

SEQ ID NO: 189188 - DNA, 711 bp, Homo sapiens
  misc_feature: GYAE6OF01CJ3N2.22.86.H09.1.454.CMB.1.raw
  modified_base (269)..(269): a, c, t, g, unknown or other
  misc_feature (269)..(269): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagccaccaggcaaacgccccagactcatcatttangctgtcaataacgccggccctcgacggggtccctgactcgtcttctctgctccagtctggccaacaccggcctcccgtcgacctatctcgtcgggcctccgaggctaggaagtacgtggacggtctaggtaatttacgttactcgtcgttcgtcttacgtagttttcggaccgtacgggtacccgtacccttaacggtaccggttttgggggttccgggtttaccggggaccggggtaaccggggtaacccgtaacgggtcccgttaccgggtaaccccgggttacccggttaaccggggttacccgaacccgggtaccccggtaaacgggttccccgttccccgggtacccccccggttccgggttacccctaacccgtttccccgttacccggtttcccccccgtcccccgtttccccggtcccgtacccggttacccgg

SEQ ID NO: 189189 - DNA, 546 bp, Homo sapiens
  misc_feature: GYAE6OF01DJQLQ.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatagactaacgggaaagtcgttttgatctcgtggggccaagggacacgtggtcaccgtctcttcacgcctccaccaaggcccagtcggtccttcccccgtgccgccctcgctccgaggcgccacgtccgagacgcacacgccggcccgtcgggcctcggcccgtggtacgaacggaccttaccgtccgtacgacgttatgtcgtggtaccggg

SEQ ID NO: 189190 - DNA, 501 bp, Homo sapiens
  misc_feature: GYAE6OF01DAHZN.22.86.H09.1.454.CMB.1.raw
  modified_base (309)..(309): a, c, t, g, unknown or other
  misc_feature (309)..(309): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggnaaggggctggagtgggtgcaattatagtggtatgatggaaagtaataaagctagtgtggactcggtagacgggcatcacatctcagagacactcaagaacactctgtttcacaaatgaacagcctagagaggacgaggacacggcagtgtatacgtgtagcgagagatacgacaatgaacgtagggtaatcg

SEQ ID NO: 189191 - DNA, 613 bp, Homo sapiens
  misc_feature: GYAE6OF01EDSOJ.22.86.H09.1.454.CMB.1.raw
  modified_base (275)..(275): a, c, t, g, unknown or other
  misc_feature (275)..(275): n is a, c, g, or t
  modified_base (466)..(466): a, c, t, g, unknown or other
  misc_feature (466)..(466): n is a, c, g, or t
tcagacatacgcgtcacgaccggtgctcgatttagtgctatagacttgggtttgggggctttgcctgggctctgctcctcctcagcctcctcactcaggcacaggatcctgggctcagtctgccctgactcagcctcgctcagtgtccgggtctcctggacagtcagtccaccatctcctacactggaaccagcagtgatgttggtgttataactatgtctcctaggtaccaacagccaacccgaggacaaacgccccagacctcatctatttangcttgtacaagtaacgccggccctcgacggggtccctgactccgtcttctcgtcggctccagtcgtcgacaacgacggcctcccgtagaccctatccgtcgtcgggtcctccgaggtactaggaacgtgtaggtacgtcgtagtaacgtttaactcgtacgcgttcgtcttactagttcgcgtacggtccnccttacgtagttcgggtcgttccgggacggacggacctaggtccgtacgacccgttcgtacggtccgacggcccaacggtccgtcccgtccccgtcggtacctaccgttcccgttcccgttacccccaccgttcctccgtaggtccg

SEQ ID NO: 189192 - DNA, 560 bp, Homo sapiens
  misc_feature: GYAE6OF01AR9EJ.22.86.H09.1.454.CMB.1.raw
  modified_base (405)..(405): a, c, t, g, unknown or other
  misc_feature (405)..(405): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcccggacagtcagtcaccatctcctacactggaaccagcagtgacgttggtggttataactatgtctcctggtaccaacaacacccaggcaaacgcccccagactcatcatttatgctgtcaataagcggccctcaggggtccctgatcgcttctctggctccaagtctggcaacacggcctcctgaccatctctgggctcgaggctagaagatgagctgattattacgtgtctgctctatttgcaggcncctacgacgttgggtgtcgggcggaagggaccaagccgtacgtacccgtcgtacggtacgacgacccgaaggtccgtccgcccccgtcggtcctaccgttccgttccggttccccccgccccttccccgtccgaccgtccgttacgttcggtccg

SEQ ID NO: 189193 - DNA, 658 bp, Homo sapiens
  misc_feature: GYAE6OF01EBK8E.22.86.H09.1.454.CMB.1.raw
  modified_base (234)..(234): a, c, t, g, unknown or other
  misc_feature (234)..(234): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaaccaacngcaccaggacaaacgccccagactcatctatttatgctgtcaataacgcggcctcgacggggtcctgactcgcttctctcgctccagtctggcaacgacgccctcctcgacctactctcgtacgggcctccgaggtctagaagtagtaggacggtctgtaatttaacttacgtcggtcttaggtccttacgtagttttcggacccgtacggtcccgtacccttaacggtaacggttttcgggggttcggtttaccggggacggggtaacgggtaacccgaacggttccgtaccggtacccggttccgtaggtccgtaaccggacccggtaacggcccgttacccggccccccggttcgggtaccctacccgttccgttaccccggttcccccgtaccccttcccgttacccgccgggttacccg

SEQ ID NO: 189194 - DNA, 646 bp, Homo sapiens
  misc_feature: GYAE6OF01CSS24.22.86.H09.1.454.CMB.1.raw
  modified_base (157)..(157): a, c, t, g, unknown or other
  misc_feature (157)..(157): n is a, c, g, or t
  modified_base (193)..(193): a, c, t, g, unknown or other
  misc_feature (193)..(193): n is a, c, g, or t
  modified_base (487)..(487): a, c, t, g, unknown or other
  misc_feature (487)..(487): n is a, c, g, or t
  modified_base (520)..(520): a, c, t, g, unknown or other
  misc_feature (520)..(520): n is a, c, g, or t
  modified_base (606)..(606): a, c, t, g, unknown or other
  misc_feature (606)..(606): n is a, c, g, or t
tcagacatacgcgtcacgaccggtgctcgatttagtgctatagacttgggtttgggggagaggagcccagcactagaagtcggcggtgtttccattcggtgatccagcactcgaacacagaggactcaccatggagtttgggctgagcgtggtttcncgttagctactttaagaggtcgtccagtgtcaggtncgagctggtggagtcggtggggacgcgtggtccaggccgtgggacggtccctgagtcctctccgtgtacgctagtcgttcgtaggacttcaccgtttgagttggctagtcggctagtgactagtggcctaccggaccacggcgccgggacaacggggtccttagggagtcgggtaccgataagtttacacgtttaggacttaggtataaggggtaaaattaacgtaaacggatttaaccgtagggtacggtaacctaccgggtaggaaaccggtccgtaacgttcaccgttacncgtacagaacgaacaacgacctaagacttactnttacgttacctacaactcgaaagcacggtagacgtaggacgacggacgtaccggagtaggtacgttataccggtggacgaccggtnacggtacacgttacgagtaccgaacggtaggtacgttacg

SEQ ID NO: 189195 - DNA, 747 bp, Homo sapiens
  misc_feature: GYAE6OF01D9K2R.22.86.H09.1.454.CMB.1.raw
  modified_base (154)..(154): a, c, t, g, unknown or other
  misc_feature (154)..(154): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgtggtttcncgtagctctttaagaggtgtccagtgtcaggtgcagctggtggagtcgtggggggagcgtggtccaggccgtggggacggtccctgacgacctctcctgtgcagcgtntggattcaccttnagtgctagtggcatcgcacgtcggcctcccggaccagggccgtccggggacgaagggggtccttagggacggttggggtacggactaaatttagtagttggggttaatcggaagttaaggggaaaattaaaactaaaggtactagtggtacggtaaccgttccgggtaagggaacggggtaccctaatttacccgaaccgtattacccgtaccgaacggaacgtaaccaaacccgttaacccgaaaacgtaaacctaccgtttaccgtttactttaacccggttaaaccctaaaagttaccggaaaccgtacggtacccgtagggaaacggaccgggaacggtaacgggaccggtaaccgggtagtaacgggttacgttaaacgtttaccggtggtaacggtacggaaaggaacgttaccgacgtaaacgtacgttaaccgggaaacccgttaaaggggtaacgttttccgg

SEQ ID NO: 189196 - DNA, 673 bp, Homo sapiens
  misc_feature: GYAE6OF01DVS3N.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagagtgtccagtgtcaggtgcagctggtggagtcgtggggggaggcgtggtccagccgtgggacggtccctgagactctcctgtgcagcgtctggacttcaccttcgagttggctagtggcagtgcacgtggcctcccgccgagggccgtccggggacaagggggctgggaggttggggtggactaagttagtagtggtatggataggtaaagtaaataaagacttagtggtaggacctcggtaggaacgggccgtattaccgaccattccgtaccaagaacgaacaacctaccgaaagtaaccacctttacttacgtttacctaacctaaaatcgaaacctacgtacccgtagggaacggaacgggtacggaacgggaaccgaacgggaccgtaaggttagtttaaacgtttaccggtgggttaggaaccggtaaggtaacggtaagttacccggtaaactaggttaacggaaacccggttaaacggggtaaacgtttaccgg

SEQ ID NO: 189197 - DNA, 157 bp, Homo sapiens
  misc_feature: GYAE6OF01CA0WR.22.86.H09.1.454.CMB.1.raw
  modified_base (156)..(157): a, c, t, g, unknown or other
  misc_feature (156)..(157): n is a, c, g, or t
tcagacatacgcgtcacgaccggtgctcgatttagtgctatagacttgggttttgggggaagaggaagactgacggtcctagcacagcggccctgggctgcctggtcaaggactacttccacgcgtatgtctgagcgggctggcaaggcgcatagnn

SEQ ID NO: 189198 - DNA, 709 bp, Homo sapiens
  misc_feature: GYAE6OF01D07JR.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgacgactctcctgtgcagcgtctggacttccaccttcagtgctagtggcatgcacgtcggctcccgccgaggtccgtccgggacgaaggggtctgggaggttggggtgactaaagtttagtagttagggtataggaagttaagggtaaaagttaaaacgtaaaaggtactttaaggttcggttacgggtaacccgttccgggtaagggtaacggggtaccgttaacttacccgaaccgtacttacccgtaccgaagtaacgaaacctaaaccgtaccaaacggtaacccaactttccgttacgttttacctaacccgtaaagtacgaaaaccgacgtaccgtagggaaggaacgggacggaacggaccgacggacgtacggttgtaacgtttacggtggttacggacggtaaaggaacgtacgtacggtaactaagttacggtaaacggttaacggggtaaacgtttacg

SEQ ID NO: 189199 - DNA, 661 bp, Homo sapiens
  misc_feature: GYAE6OF01CW4OS.22.86.H09.1.454.CMB.1.raw
  modified_base (273)..(273): a, c, t, g, unknown or other
  misc_feature (273)..(273): n is a, c, g, or t
  modified_base (318)..(318): a, c, t, g, unknown or other
  misc_feature (318)..(318): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcaggcgtctggacttcaccttnagtggctagtggcatgctacgtggcctccgccaggccgtccgggngaaggggctgggacggtgggtcggactaagttagtagtggtatggaataggaaaagttaataaagtacttagtcgtacggaactccggtaggaacgggtccgtaattaccgacctagtacctacgtaagaacgtaaccgaactacccgaaagtaacctaccgttacgttacgttttaaccaaccgtaaacgtacgtaaacctacggtacccgtagaacggacggacgaacgggaccgacgggacgtaaggtcgttaacgttacgtcggtaggacggtaaggacgtacggtaccgtaacgtaacggttacgggtaaaccggtaaacggggttaaactttccggg

SEQ ID NO: 189200 - DNA, 879 bp, Homo sapiens
  misc_feature: GYAE6OF01CW40D.22.86.H09.1.454.CMB.1.raw
  modified_base (371)..(371): a, c, t, g, unknown or other
  misc_feature (371)..(371): n is a, c, g, or t
  modified_base (851)..(851): a, c, t, g, unknown or other
  misc_feature (851)..(851): n is a, c, g, or t
tcagacatacgcgtcacgaccggtgctcgatttagtgctatagacttgggtttgggggctttgcctgggctctgctcctcctcagcctcctcactcagggcacaggatcctgggccctacgtcgttcgtccgtccctagtacctacgaccgtccctcgtcctacgtacggttccgggttcccgggttcccttccggtacggaacgttacgtacgtaccgtacccaacctacttcccttaaccctaacctacggtaaccggaaaccacgacgtagtagtagtttggtttgggttaagttaaacttaacttgttccgttacctaccggttacgaaaccaacgaccgacccaaccggacgaaaccgaaaccccnccccgtaatacctactaactaccttttaagtttacgtctacgttaacgtaacgtaaacgtacccggccccggtacccgttacgggggtaccccgggttcctagtaccgttcccttttcgtttccgtcggtccgttaacccctaaccggtacgttcggacggaaaccctaaccggtcccccgttccccttacgaaccgtacctttacttccgtcgggtccgtcctaccggagttcgtaaagaagttcgtagggtactgttatttaacttacgtttacgcgttcgtacgtccttacgttacgttcgacggccgtaccttaccgttacgtttcggggttagggttccggacggggacgggtaaccgaccgtacgttccgtacccgttcggtaaccggtacgtaccgacccgtaaccggccggttcccgtccccggttaccccgtcgtacccttaccggtttcccgttaccccccggttccccnccccgttaccgtcccggtcgtttaccgg

SEQ ID NO: 189201 - DNA, 685 bp, Homo sapiens
  misc_feature: GYAE6OF01DCWFN.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatgggtagtttgggctgagcttgggttttcctcgttgcttcttttaagaggtgtccagtgtcaggtgcagctggtgagtcgtggggagcgtgtccagccgtgggagtccctgacgctctctgtgcagcgtctggacttcaccttcgagtggactagtggccagtcgcctacgtcggcccttccggccgaggggcctacccggggacgaaggggtcctaggggaggtgggtagacctaaagttgtagttggtaatggtaagtagggtaaaattaagtaaaagcgtttagtcgggtacggtaccgttccggtagggaaacgggtcccgtaattcccaacgtctacgtaccgaagaacgtaaccaaaccctaacgaaccgtacctacgttaccgtttaccggtttacaaccgtaaattcgaaacctggtaccgtagggaacgtacgggaacggaccggacgtcccggaagttacggtttcgtaaactttccggagttacggacgtaaggaagtaccgtaacgtacgtaagtaacgggtaccggtaaaagggttgtttaacg

SEQ ID NO: 189202 - DNA, 567 bp, Homo sapiens
  misc_feature: GYAE6OF01EG1OM.22.86.H09.1.454.CMB.1.raw
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
tcagacatacgcgtcacgaccggtgctcgatttagtgctatagacttgggtttgggggaggcgtggtccagcctgggaggtccctgagactctcctgtgcagcgtctggattcacctttcagtggctatggcatgcactggctccgccaggctccgggcaaggggctggagtgggtggcaattatatggtatgatggaagtaataaagactatgtgactccgtgaaggccgattcaccatctccaagagacaactcaagaacactctgtttctaccaaatgaacagcctgagaggcgaggacacggcagtgtattactgtgcgagagatacgacagtgaacgtaacgggaaagtcttttagattctcgtggggaccaagggacacgtggtcctaccgtcttctcacgtccctaccaccgacggccctagtcccgttcctccccgnggccnccctcgcctccgaggacnccgacccgtcgacgacgcacgcggccggcccgtcggcgtcggccgtggtaccgaaacggtaccctacgttacccgacggtcctagtcgtcgtggacggg

SEQ ID NO: 189203 - DNA, 554 bp, Homo sapiens
  misc_feature: GYAE6OF01ART0Z.22.86.H09.1.454.CMB.1.raw
  modified_base (390)..(390): a, c, t, g, unknown or other
  misc_feature (390)..(390): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaaatgaacagcctgagaggcgaggacacggcagtgtattactgtgcgagagatcgacatgactacgggaaagcttttgatctcgtgggcaagggacactgtcacgtctctcanccctccaccaacggcccactccggtccttcccccgtggccgccctgcctcccaggacgccaccctccgagacgccacgacggccggcccgtcggggcctcggcccgtgggtaccgaacggaccttaccttcccgacggtccgttatcggttccgtggtacgggg

SEQ ID NO: 189204 - DNA, 738 bp, Homo sapiens
  misc_feature: GYAE6OF01E0GUL.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcaccgaggaccaaacgcccccagactcatctatttatgctgtacaaagtaacgccggccctcgtacggggttccctgactccgtcttctcgtggcctccaagtctcggaccaaccgaccggccctcccgacgaccctacttccgtccgtcgggcctccgaggctaggaagtagtggacggtcttagtatttacgttacgtcgtctgtaccttcgttagtttcgaccgtaccgggtcccgtacccgtttaccggttacgggtttcggggttaccgggtttacccggggacgggtaccggggtaaaccgtaacggtccgttaacccggtacccgggttaccgtaaccgggttaccgaacccggtacccccggtaaacggggtccccttaccccggggtaccccccccgtttaccgggttccccgttaacccgtttccccggtttaccccggtttaccccccctaacccccgtttccccgttaccccggtaacccgggttacccgg

SEQ ID NO: 189205 - DNA, 539 bp, Homo sapiens
  misc_feature: GYAE6OF01DNAD4.22.86.H09.1.454.CMB.1.raw
  modified_base (174)..(174): a, c, t, g, unknown or other
  misc_feature (174)..(174): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (406)..(406): a, c, t, g, unknown or other
  misc_feature (406)..(406): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagttttggctgagcggtggtttcgcgtaggcgtcttaagagtntcagtgcagtgcagctggtgagtcgtggggaggcgtgtccagccgtgggacgtccagagctctcgtgngcagtctgtgtacttcacttnagtgctagtgctgtgctcgtcggccnccgacnggtcccgcggacgagggcgtggnggtggngatattatagtgtanggaataggaaatactaaagtgtagtgtacgacgttacgagtacggctaactcactagctacgaaganaccaactaccaagtaacttctgttacttactaacaatacgaccaagtccaaggacgaggaccgtaagcgtacgactgttacctagttaccggngtacgagganagtacgacgatagtagacggtaggtattag

SEQ ID NO: 189206 - DNA, 649 bp, Homo sapiens
  misc_feature: GYAE6OF01AT6TM.22.86.H09.1.454.CMB.1.raw
  modified_base (339)..(339): a, c, t, g, unknown or other
  misc_feature (339)..(339): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagccacccaggcaaacgcccccagactcatcatttatgctgtcaaataacgccggccctcgacggggtccctgactccgcttctctggcctcaagtctggcaacnccggcctccctgaccatctcgtcgggcctccgaggctaggaagagtggaggtatagtaattattacgtgtctgtcttactagtttgccgacggccgtaccgttaccgtacgggtttcggggtcggtttccggggaccgggtaacggggtaacccgtaacgggtccgttacgggtaccccgttaccggtacgggtccgaaccggaccccggaacggtcccgttcccggacccccccggttcgggtacccttacccgttcccgtttcccggttaccccccgtcccccttcccgtccccggtaccggtacccg

SEQ ID NO: 189207 - DNA, 631 bp, Homo sapiens
  misc_feature: GYAE6OF01B80FW.22.86.H09.1.454.CMB.1.raw
  modified_base (270)..(270): a, c, t, g, unknown or other
  misc_feature (270)..(270): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacacacccaggccaaacccccactcatcatttatggtntcactcgtcggccctcaggagtctctcatcgcttctcaggctcagtctggcaacgcgcctcctaaccatctcgtcggctcctagtttgacggtacgagttctacttacttacgtgactagtttacctttaaagttcggaccgtcctacttcgttcggttcgggttttccggcgggtacggccgtaacccggtaagtccggtaacccgttcccgttccgggtccacggtacccccgaaggtcccgttccggcccccccgttgggtccctaaccgttccttccggtttacccccaccccgttccctaccgtacccggtcccgttattcggttcccttaggacggtccgggcgttggaacccgg

SEQ ID NO: 189208 - DNA, 500 bp, Homo sapiens
  misc_feature: GYAE6OF01DSBH2.22.86.H09.1.454.CMB.1.raw
  modified_base (416)..(416): a, c, t, g, unknown or other
  misc_feature (416)..(416): n is a, c, g, or t
  modified_base (495)..(495): a, c, t, g, unknown or other
  misc_feature (495)..(495): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatcctctgggctccaggctgaagatgaggctgattattactgctgctcatttgcaggcgctacatttgggtnttcgggcggagggaccaagctgaccgtctaggtcagcccaaggctcgccccctcggtcactctcttcccaccctcctcncgtcg

SEQ ID NO: 189209 - DNA, 636 bp, Homo sapiens
  misc_feature: GYAE6OF01BDP1N.22.86.H09.1.454.CMB.1.raw
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
  modified_base (591)..(591): a, c, t, g, unknown or other
  misc_feature (591)..(591): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaangcaccaggccaaacgccccagactcatctatttatggtntcactcgtcgccctgaggacgtctctcatcgtcttctcgacggtcctccgtaagtccgtacggaccaacgtaccggtcccttacccctaacctacgttccttccggtcgggtccttccgtaggtttggaacggtacgtagttctacttacttacgtcgtacttacgtttacttaaagttcggcctaccgtactcgttcggttcggtttcggcggtacgtaccgtacggtaacgtcggtacccgttccgtccggtacgaccggtcccgaacggtccgtcccggtccccgtcgggtccctaccgttccgttcccttccccnccccttccgtccaccggtcgttactcgtcctggtacggtcccggg

SEQ ID NO: 189210 - DNA, 565 bp, Homo sapiens
  misc_feature: GYAE6OF01B98JS.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggcctccgccaggcctccggggcgaaggggctgggaggttggggcggcaagtttatagtggtaatggaatgggaaagtaaataaaggactatggtggacctcggtgaagggccatcaccatcacagacgacaacaccaagaacactcttagtttaccactaaagtcgaaacgacgcccgtagaggacggacgaaggacgacggcgagtcgtaacttacgtgtaggacggaaggacgaagtccgtacataggaacgtaacggggaaagtttcgg

SEQ ID NO: 189211 - DNA, 680 bp, Homo sapiens
  misc_feature: GYAE6OF01CGE28.22.86.H09.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
tcagacatacgcgtcacgaccggtgctcgatttagtgctatagacttgggtttgggggctttgcctgggctctgctcctcctcagcctcctcactcaggcacaggatcctgggctcagtctgccctgactcagcctcgctcagtgtccgggtctcctggacagtcagtcaccatctcctacactggaaccngcagtgatgttggtgttataactatgtctcctggtaccaacngccaccaggccaacgccccagacctcatcatttatgctgtacaataacgccggccctcgacggggtccctgactccgtcttcgtcgtcggcctaccgaagtcctcggaccaaccgtaccggtccctcccgtacgacctacgtccgttccggtcgggcctccgaggtcctaggaacgtacgtggacggtctagtatttacgttaccgtcgtacctcggtaccttctacgtttcggaccgtacggccgtaccgttacgtaccggtttcggggttcggttaccggggtacgggaacggggtaccgtaacggtcccgttacggtacccggttaccgtacggtaccgaccggtacccgtaacgggcccgttacccggcccccgttccggtaccctacccgttcccgttcccgttaccccccgtaccccttcccgttcccgtaccggtacccg

SEQ ID NO: 189212 - DNA, 735 bp, Homo sapiens
  misc_feature: GYAE6OF01BAP8M.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccggtctcctggacagtcagtcaccatctcctacactggaaccagcagtgatgttggtgttataactatgtctcctggtaccaacagccaccgaggaccaacgcccccagactcatcatttatgctgtacaataacgccggcctcgacgggtccctgactcgtcttctcgtcggctaccgaagtcgtggaccaaccgccggtaccctcccgtcgaccacttccgtcgtcgggcctccgaggtctagaacgtagtggacggtcttagtatttacgttactgtacttcgtcttacttagtttcgaccgtacggtcccgtaccgtttaacgtacgggtttcggggtttccggttaccgggggaccgggtaaaccggggtaacccgtaaaccgggtttaccccgttttaacccgggttacccggttaaccgggttcccgaaacccggtacccccggtaaaccgggtccccgttaccccgggttccccccgttacccgggtttacccgtaccccgtttccccggtttacccgtttacccccccggttacccccttacccccggtttaccgtacccgggttcccgtttaaccgg

SEQ ID NO: 189213 - DNA, 778 bp, Homo sapiens
  misc_feature: GYAE6OF01C9IWU.22.86.H09.1.454.CMB.1.raw
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctgggtggagtcgtgggggagcgtggccagcctgggacgtcctgagctctcctgtgcagctctggattccaccttcaggtgctagtcgcatgcacgtggcctccgcaggcctccgggctaaggggctgggacggtgggtaggactaagttagtgtagggttaataggaagttaggggaaaaacgtttaaataaaacggtacgttagtttcggacgggtaaccttccgggagggaaacgggggtccctaacgtttaccaacccgtaatacccgtacccgaaaggaacgtaaaccaaacccgttacccgaaaaagttaaccctaacctttacccgtttacggtttttaaccctaaccccttaaaagttacggaaaacccgtacggtccccggttaaggggaaccgggtaacggggtaacccggtaacggggaacccgaaccggggtacgttaacgggttaccgggtttaaatttaacccggtaggggtaaccggtaccgggtaaaggtaaaccgtaacggtttacccggaaacaacggttttagggaaaacccggtaaaacggggggttaaactttttacccggg

SEQ ID NO: 189214 - DNA, 574 bp, Homo sapiens
  misc_feature: GYAE6OF01CZSIK.22.86.H09.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
tcagacatacgcgtcacgaccggtgctcgatttagtgctatagacttgggtttgggggctttgcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcnggacgtctctcatcgcttcncaggctccaagtctgcaacncggcctccctaacatctctcgggctcctagtttgacggacgagtctaactttattactgtctacgtttacctttaaagttaggccgccctacttcgttcgttcggttttcgggcggtaggcacgagtcgacctccgtcggtcacgcccgaggtcctcgccccctcggtctactcctccgttccccgtccctccgtctacccgcgttactcgtcgtcggacggtccgggcgtcggcgacggtcgg

SEQ ID NO: 189215 - DNA, 647 bp, Homo sapiens
  misc_feature: GYAE6OF01B4B4O.22.86.H09.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccggtctcctggacagtcagtcaccatctcctacactggaaccngcagtgatggttggtgttataactntgtctcctggtaccaacngcaccgaggaccaaacgcccccaagacctcactctatttangtctagtacaaagtaacggccggtccctcggacggggtccctgactcgtcttctcgtggcctccgaagtcgtcggaccaacgtccgtccctcccgtacgacctactcctcggtcgggcctaccgacggtcgtaagaagtacgtggacggtctagtacttacttacgtgtcgtcgtcttactacgttcgaccgtacggtcccgtaccttacggtacggtttcgggtcggttccgggacgggacggtacccgagtccgtacgtacccgtacgtaccggtacgaccgtacccgtacggtccctacccggtcccccgtcgggtaccctaccgttcccgttcccgttccccccgtacctcccgtccggacgtaccgg

SEQ ID NO: 189216 - DNA, 549 bp, Homo sapiens
  misc_feature: GYAE6OF01CIZ0G.22.86.H09.1.454.CMB.1.raw
  modified_base (192)..(192): a, c, t, g, unknown or other
  misc_feature (192)..(192): n is a, c, g, or t
  modified_base (376)..(376): a, c, t, g, unknown or other
  misc_feature (376)..(376): n is a, c, g, or t
  modified_base (476)..(476): a, c, t, g, unknown or other
  misc_feature (476)..(476): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagccgtgggacgtccctgacgactctcctgtgcagcgtctggacttcaccttcagtggctatggcatgcacgtggctccgcaggcctcggcaagggctgggagtgggtagacaattatagtggtatggataggaagtaaataaagactagtgnggactcggagaacggctatcaccatctcagacgaacaactacaagaactctctgtttacactaagtagaacagccgagagaggacgaacgacgaacggtntagtgtaattacgtgtaggacgtaggaagtacgttacgacttaacgtgtaaaccggtaacgggtaaagtttcg

SEQ ID NO: 189217 - DNA, 709 bp, Homo sapiens
  misc_feature: GYAE6OF01EM1GX.22.86.H09.1.454.CMB.1.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
tcagacatacgcgtcacgaccggtgctcgatttagtgctatagacttgggtttgggggctttgcctgggctctgctcctcctcagcctcctcactcaggcacaggatcctgggctcagtctgccctgactcagcctcgctcagtgtccgggtctcctggacagtcagtcaccatctcctacactggaaccagcagtgatggttggtgttanaactagtgtctcctggtaccaacacaccgaggcaaacgccccaaatcatcgattangacgtcaactaagccgtcctacgacgggtccctgactcgcttctctcggcttaccgaagttccgtggaccaacgccggtcccttcccgtagacccgtctcgtcgggtaccctccggaggtcttacggaggtacgtgacgggtcttacggtatttaaccgttacgtcggtaccgtacgtccgtacagttacggtacgggacgggtccaacggtccgtaaagttacggttttcgggtacggtttaccggggacgggtaacggggtaacccgtaacggtccgttaccggtaccccggtttccggtaacgggtaccgaaccggttaccccggaaggttccccgtacccggtccccccggttacggtacccgttacccgttcccggttcccgttacccccgaccccgttccccgtaccgaacccggttcgttccggtcgtacccggg

SEQ ID NO: 189218 - DNA, 713 bp, Homo sapiens
  misc_feature: GYAE6OF01CLVAP.22.86.H09.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
tcagacatacgcgtcacgaccggtgctcgatttagtgctatagacttgggtttgggggctttgcctgggctctgctcctcctcagcctcctcactcagggcacaggatccgtgggctcagtctgccctgactcagcctcgctcagtcggtccgggtctccgtggacagtcagtcaccatccnctacactggaaccngcagtgatgttcggagttaataactgtgtctcctagtaccaancgcaccgaggcaaacgccccagactcatctatttangntcgtacaataacgccggcctcggacgggtccctggactcgtcctcgtcgacggcctacgtaagtcacgggacaaaccgtacccgtaccctaaccctaacctactccgtcggtcgggtaccttccggtaggtttacggaggtaccgtacgttacttaacttacgttacgtcgtacttaaccgtttaacgtttaaacgtacggtacccgtacttacgttccggttacgggttcgggttttaccggacgggtaacggccgtaaacgggtaacggtcggttaacccggccgttacccggtacgaccggtaccgaacggtcccgccggtaccccggtccgtaccgtccgttacccgttcccgtacccccgtacccgttccccgtaccgtacccggttcgttaaccgttacggtaccgtcgggccggtccggggtacccggg

SEQ ID NO: 189219 - DNA, 775 bp, Homo sapiens
  misc_feature: GYAE6OF01D5RPD.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcgtctggattccaccttcagtggctagtggcatgcactggctccgccaggccgtccgggacgaaggggctgggaggtgggtaggactaagtttagtagtggtatggaagtagggaaaagttaaataaacggcttaagtgggttacggaaccttacccgggtaagggaacggggtcccgtaaacgtttcccgaaacccgtacgttacccttaccccgaaggtaaacggaaaccctaaaccgttacccaaaaggtaaacccctaaccttaccgttttaccggtttttaaccctaaccccgtaaaaagttaccggaaaaaccgtaccgggtaaccccgttaaggggaacggggtaaacggggacccggtaaacggggaacccgaaccggggaaccgttaaaggttacggtttaaacttttaaccggtgggttacgggaccggtaaagggaaacggtacgttaaccggaacgtaaacggttacgggtaaaacccgggttaaacgggggtaaaacgttttaccgg

SEQ ID NO: 189220 - DNA, 706 bp, Homo sapiens
  misc_feature: GYAE6OF01AV5XG.22.86.H09.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngcacccaggcaaacgccccagactcatcatttangctgtacaataacgcggccctacgacgggtccctgactcgtcttctctggctccgaagtctggcctaacgaccggtcctcccgtcgaccactcctcgtcgggtcctccgacggtcgtagaacgtacgtcgtaggtcttaggtactttaagttaccgtgtacctcgtaccttacgtaacgtttcgacccgtacgggtccctaccgttacgtaccggtttcggggttcggttaccgggacggggtaaccgggtaccgtaacggtccgttaccggaccccgttacccggttagggtacccgtaccgggaccccggtaaacgggtccccgttaccccggtacccccccggtttgggttacccctaacccgtttccccgttaccccgggtttacccccccaacccccgtttcccgtaacccggttaccccgggttaacccgg

SEQ ID NO: 189221 - DNA, 649 bp, Homo sapiens
  misc_feature: GYAE6OF01DJ2QK.22.86.H09.1.454.CMB.1.raw
  modified_base (271)..(271): a, c, t, g, unknown or other
  misc_feature (271)..(271): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttnagtgctagtggcatgcacgtggcctccgcaggcctccgggcaaggggctgggaggtgggtggactaagttagtagtgggtaatggaagtagggaaaagttaaataaagtacgtagttggtggaaccttccggtaggaacggggccgtaagttccgaacctatacctaccgaagaacgaacctaacctaccaaagtaacctactctttacgtttacctacctaaatcgaaactacgtaccgtagggaacggacgggacggaacggaccggtaacgggtaccgtaggttacggttaactttaccggtaggtacggtacggaaaggacggtactaccggaactaaggtaccggtaaaccggttaacgggaaacgttttacg

SEQ ID NO: 189222 - DNA, 639 bp, Homo sapiens
  misc_feature: GYAE6OF01DPI5D.22.86.H09.1.454.CMB.1.raw
  modified_base (428)..(428): a, c, t, g, unknown or other
  misc_feature (428)..(428): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtggctatggcatgcacgtcggcctcccgccgaggccgtccggggagaacgggggctgggaggtggggtagactaattagtagtggtagtgagtaggaaataataaagactagtgtggactcggtaggaacgggctactccaactatctacgaganaaccaacctaccaaacgaacctacgttcttcgtttacctacctaaagtacgaaaccgtacgtacccgtaggacgggtaacggacgggtaacggaccgaaccgggtacgtaacggttagtttaacgttacggttgggtacggacggtaaaggaacgtaacgtaccgtaacgtaagtacgggtaaaccggtaaaccggggttaagtttaccgg

SEQ ID NO: 189223 - DNA, 505 bp, Homo sapiens
  misc_feature: GYAE6OF01D82N1.22.86.H09.1.454.CMB.1.raw
  modified_base (194)..(194): a, c, t, g, unknown or other
  misc_feature (194)..(194): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggtttttcctcgttgcttctttttaagaggtgtccagtgtcaggtncagctggtggagtcgtgggggagcgtggtccagcctgggagtccctgagcctctcctgtgcagcgtctggattcaccttcagtggctatggcatgcactggcctccgccaggccgtccgggcaaggggctgggaggtgggtaggctaagttatagtggtatgagtaggaataaataagactatgtggactcgtagaacggcatcacatcaccagacacaactcaagacnctctgttcacaatgaacacnctagagagcgagacacggcagtntatcgngtgngagagatacganatagacgtaggaattcg

SEQ ID NO: 189224 - DNA, 616 bp, Homo sapiens
  misc_feature: GYAE6OF01BUMB5.22.86.H09.1.454.CMB.1.raw
  modified_base (232)..(232): a, c, t, g, unknown or other
  misc_feature (232)..(232): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaccaangccacccaggcaaacgcccccagactcatctatttatgctgtacaataacgcggccctcgacggggtccctgactcgtcttctctggcctccaagtcctggaccaaccgaccggccctcccgtcgaccctatccgtcgtcgggctccgaggctagaagagtggaggtctagtagtttacttacgtgtctgtccttctagtttcgaccgtacggccgtccctacgtcgtttcggggttcggtaccgggcgggtaacgggacaacggtcctacggacccgttcgtacggtccgacggtacccgacgggtccctcccggacccccgttcggtccctaccgttcccgttaccgttaccccccgaccccttccgtaccgtccgtaccgg

SEQ ID NO: 189225 - DNA, 595 bp, Homo sapiens
  misc_feature: GYAE6OF01DTIIK.22.86.H09.1.454.CMB.1.raw
  modified_base (227)..(227): a, c, t, g, unknown or other
  misc_feature (227)..(227): n is a, c, g, or t
  modified_base (260)..(260): a, c, t, g, unknown or other
  misc_feature (260)..(260): n is a, c, g, or t
tcagacatacgcgtcacgaccggtgctcgatttagtgctatagacttgggtttgggggctttgcctgggctctgctcctcctcagcctcctcactcaggcacaggatcctggctcagtctgccctgactcagcctcgctcagtgtccggtctcctggacagtcagtcacatctcctacatcggaaccagcagtgatgttggtgttataactatgtctctgtaccaancgcacagacaacgccccagactcatctatttancgctgtacaagtaacgcggtcctagacgggtcctagacgtcgtcttctcgtgcctactaagtcgtgaccacgtaccgtcctacctagacctagtctcgtggtcctcgtacggctaggagtacgtcgagtcttacgtaactttaacttcgtcgtacgtgtccgttacgtagtttcgcgtacggcccgttacgttaacgttcggttcgggtaccggttcgggacgggtaccggtaaccgtacggtccgtaccggtaccgtcgttaacggtacgaccgtaccgacgtccgtacgccccgtagtcctacgtcgttccctacccgcctccgcgtcgtccg

SEQ ID NO: 189226 - DNA, 566 bp, Homo sapiens
  misc_feature: GYAE6OF01A98P1.22.86.H09.1.454.CMB.1.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
  modified_base (557)..(557): a, c, t, g, unknown or other
  misc_feature (557)..(557): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaancgcaccaggaccaaacgccccagactcatcatttangctgtcaataagcggcctcgacgggtcctgactcgtcttctcgtggactccgtaagtctcggccaacgtaccggcctcccgtacgtacccgtctccgtcgggccctccgacggtccgtggaacgggtatcgggagggtcctaggtactttagttacctgtacctactcatagtcgcgaggcgactaacgttgtgggtcgtcgggacggtacggaccgtagccgtagacccgtcgtacggtcacggccacggcgtccgcccgngtccnctctcgtcccaccgtcctcncgtcgtccg

SEQ ID NO: 189227 - DNA, 552 bp, Homo sapiens
  misc_feature: GYAE6OF01A6DEH.22.86.H09.1.454.CMB.1.raw
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngccacccaggacaaacgcccccagacctcatcatttatgctgtacaataagccggccctcgacggggtccctgactcgcttctctgctccagtctgacaacncggcctccctgaccatctcgtgggcctccgaggctagaagagtgagtctgtatttattactgtctgtctctatttgcaggcctcctacgtacgttgggtcgttcgggcggtacgggaccagtctacgaccgtcgtacggccacgcccgaaggtcctccgccccgttcggcctaccgttcctcccgttccccaccccttccctccgtaccggtccg

SEQ ID NO: 189228 - DNA, 564 bp, Homo sapiens
  misc_feature: GYAE6OF01EGNME.22.86.H09.1.454.CMB.1.raw
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
  modified_base (501)..(501): a, c, t, g, unknown or other
  misc_feature (501)..(501): n is a, c, g, or t
  modified_base (517)..(517): a, c, t, g, unknown or other
  misc_feature (517)..(517): n is a, c, g, or t
  modified_base (531)..(531): a, c, t, g, unknown or other
  misc_feature (531)..(531): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccctggggacgtccctggacgacctctcctggtgcaggcgtctggattccaccttgaggtggctagtggacatgcacgtgcctccgcgaggcctaccgggngaaggggctagggaggtgggtagctaagttntagtgggtanggaagtagggaaataataagctagtggtaggacctcggtaggaacgggcctattccactntccacaggacacactacaagaactctntgttacaactaatcgaacacgctaggaggacggacgaggaccgacggntaagttgtaattcggngtagacggaagacngtaccatagtcggtaaacgtagggtatttaccg

SEQ ID NO: 189229 - DNA, 754 bp, Homo sapiens
  misc_feature: GYAE6OF01C5QUJ.22.86.H09.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagacatacgcgtcacgaccggtgctcgatttagtgctatagacttgggtttgggggctttgcctgggctctgctcctcctcagcctcctcactcagggcacaggatccgtggctcagtctgccctgactcagcctcgctcagtcgtccggtctccgtggacagtcagtcaccatctcctacacgtggaaccngcagtnagttgttggtgttaataactgtcgtcctaccgtaggtaaccaagacgaccaaccgaggaccaaaaccgccccctaaaactccaagttacgttaactttagacggtaacggtacctaacgtaacggcccggtacccgttacggaccgggtccctagacgtccgtccttcgtcgtcggtacctaccgtaagttccgacggaaccctaaccgtccggtcccttacccgtcgtaacccgttccgttacggtccggtccgtacccggacggtccgtaggtaacggtatcggtaacggtccttaaggttactttaacgtttaccgacgtacggtaccttacgttacgttacggtttggacccgtacgggtccctaaccgtaccgttacgggtttcggggttaccgtacgggggacggtaacgggaacctacggtccgtaccgtaccggtacgtacggaccgaccggtaacccgacggtcccgtacccgtccccggtcgtacctacccgttccgttaccccgtcccgcccttaccgtacgaccgttactcgttcggtccgg

SEQ ID NO: 189230 - DNA, 858 bp, Homo sapiens
  misc_feature: GYAE6OF01D05DQ.22.86.H09.1.454.CMB.1.raw
  modified_base (275)..(275): a, c, t, g, unknown or other
  misc_feature (275)..(275): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatgggagtttgggctgagctgggtttcctcgttgctctttaagaggtgtccagtgtcaggtgcagctggtgagtcgtgggggagcgtggtccaggccgtgggacgtccctgacgtactctctgtgcagcgtctggtacttccaccttnagtcggctagtggcagtcgcactggcctccggcgacggcctaccggggacgaaggggtcgttagggaggttggggtacggacttaaagttagtacggtaggttaataggaagtagggtaaaagttaaaacgttaaaggtacttaaggttacgggttaggaacccgtttccggggtaagggtaaccgggggtccccttaaagttttaccccgaaacccgttaacgttacccgttaaccccggaaaggtaaacccggtaaaccctaaacccgtaaacccccgtaaaaaggtaaaccccttaccgtttacccgttttaccggttttaacccctaaaacccgtaaaagtttaacccggaaaacccgtaaacggggttaccccgttaacgggggaaacgggttaaaccggggtacccgggaaaaccggggtaccccgtaaccggggttaacggtaacgggttttacgggtttaaaccctttacggttacggggtaccggaaccgggtaacggaaacggttaccctaccgggtaaacctaacggttaaccgggtaaacccgggttaaacgggtaaacggtttttaccgg

SEQ ID NO: 189231 - DNA, 766 bp, Homo sapiens
  misc_feature: GYAE6OF01ECERX.22.86.H09.1.454.CMB.1.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
tcagacatacgcgtcacgaccggtgctcgatttagtgctatagacttgggtttgggggaggcgtggtccagcctgggaggtccctgagactctcctgtgcagcgtctggattcacctttcagtggctatggcatgcactggctccgccaggctccgggcaaggggctggagtggtggcaattatatggtatgatggaagtaataaagactatgtggactccgtgaaggccgattcaccatctcaganacaactccaagaacactctcgtttactaccaaatgaaacngcctgagaggcgaggacacggcaggtgtattactgtgacgagagatcgacagtagacgtaacggaatctttgactcgtcgtggggaccaaagggacacgtcggtctaccgtcttcgtacctacgtccctaccgaacccgtaacgggcccctaacggttcccggttacccgtttaccccccgtcgggtaccccgtccccccgtttacggaccccgttaccggaaccgggtaaccggtacccccgtaaccccgtacccggtaaacgggacccgtacccggtaaacccggtcccgggtaaccccggggtcccccgttaccgggggggtccctttacccggggtaccccgggtttaaccggggtaacccccggtaaaacggggtttaacccccgttaaacccggtttacccccgtaacccggggttaccccgggttttaactttaccggggtttaccccggtacggggttaaaccccgggggg

SEQ ID NO: 189232 - DNA, 664 bp, Homo sapiens
  misc_feature: GYAE6OF01BOE8W.22.86.H09.1.454.CMB.1.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (427)..(427): a, c, t, g, unknown or other
  misc_feature (427)..(427): n is a, c, g, or t
tcagacatacgcgtcacgaccggtgctcgatttagtgctatagacttgggtttgggggctttgcctgggctctgctcctcctcagcctcctcactcaggcacaggatcctgggctcagtctgccctgactcagcctcgctcagtcgtccgggtctccgtggacagtcagtcacctatcctcctacactcggaaccngcagtgagtggttggtagttaataactagttcgtccttccgtaggtaaccaacgacgaccaacccgaggaccaaaccgcccccaagactcatctatttngtctgtacaagtacggccgtccgtacgtacgggtccctgtacgtctcttctcgtcgcctacgagtcgcgaccacgtccgccctccacgtacctgtccgtcgtcggacctcgagtcaaggagtactggacgtntcgttaactttgtacgtcgtcgttcgtacttcgtagttcgaccgtacggtcccgtacctttacgggtaccggtttggggtaccggtacggggaccggtaaccggtcgtaacggtccgtaccggtaccgtccggacgtcccgaccgacccggtacggtccctccccggtcccgttccgtacccgttacccttccggtttacccccacccccgttacccgtcgttaccccggagtccgg

SEQ ID NO: 189233 - DNA, 537 bp, Homo sapiens
  misc_feature: GYAE6OF01EGS4N.22.86.H09.1.454.CMB.1.raw
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggaccaaacgccccagactcatcatttatgctgtacaataacgcggccctcgacggggtccctgactcgcttctctgctccagtctggcaacgcgcctccngacnctctcgtcgggtcctccgaggtctagacgagtagaggctagtattattactgtctgtctactntttgctaggccnctactgttggtgtcggcggagggaccacgcgtggacccgtcgtaggtccagacccgaggcccgtccgccccgtcggtccacgtccgttccgttaccccacccttcctcgcgtccg

SEQ ID NO: 189234 - DNA, 812 bp, Homo sapiens
  misc_feature: GYAE6OF01A5NZB.22.86.H09.1.454.CMB.1.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (287)..(287): a, c, t, g, unknown or other
  misc_feature (287)..(287): n is a, c, g, or t
tcagacatacgcgtcacgaccggtgctcgatttagtgctatagacttgggtttgggggctttgcctgggctctgctcctcctcagcctcctcactcagggcacaggatccgtgggctcagtctgccctgactcagcctcgctcagtcgtccgggtctcctggacagtcagtcaccatctcctacactggaaccngcagtgatggttggtagttaataacgtatcgtcctccgtaggtaaccaanacgaccaaccgaggaccaaacgccccaagacctcatctattangtctgtacaagtacgccggaccgtcgacgggtccctagtacgtccgtctttcctcgtcggtacctaccgtaaggttccgtacggaccaaaccggtcccggtacccctcccgttacgtaaccctacgttccgtccggtacggggtaccctaccgtacgggtcgtagggaacggtacgtcggtaacgggtacctttagggttaaacttttaaccgttaaccggttcgtaaccttaaccgttacgtaacgtttaacgtcgggaacccggtaacggggtacccggttaaacgttaacgggtttccgggtttaacgggggtacggtttacccgggggaaccgggtaacggggtaacccgtaacggtccggttaaccggtaacccggttaccgtaccgggtacctaaccgggaccccggttaacggtccccgttaccccggtaccccccggttacggtacccgtacccgtttaccccgttccccggttaaccccccacccgtttaccccgttaaccgtcccggttaaccgg

SEQ ID NO: 189235 - DNA, 612 bp, Homo sapiens
  misc_feature: GYAE6OF01D2B7S.22.86.H09.1.454.CMB.1.raw
  modified_base (181)..(181): a, c, t, g, unknown or other
  misc_feature (181)..(181): n is a, c, g, or t
  modified_base (232)..(232): a, c, t, g, unknown or other
  misc_feature (232)..(232): n is a, c, g, or t
  modified_base (269)..(269): a, c, t, g, unknown or other
  misc_feature (269)..(269): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccggtctcctggacagtcagtcaccatctcctanactggaaccagcagtgatggttggtgttataactatgtctcctgtaccaangccaccaggacaaacgccccagactcactctatttangtctgtacaataacggccggccctcgacggggtccctgactcgtcttctctgctaccgaagtctggcaacgcgtccctcctagaccatcctcgtcgggcctccgaggtctggaacgtagtgacggtctagtaatttacttacgtgcttgtccttactagtttcgcgtacggtccgtaccttacgtcggtttgggtcggttccgggacgggtacggaccaggtcgtacgacccgttcgaacggtccaccggtcccgaacgggtccctacccggtcccccgttcgtacccgtacgttcccggttcccggttcccccctccccttcccgtccgtaccggttaccgg

SEQ ID NO: 189236 - DNA, 650 bp, Homo sapiens
  misc_feature: GYAE6OF01CXYOK.22.86.H09.1.454.CMB.1.raw
  modified_base (190)..(190): a, c, t, g, unknown or other
  misc_feature (190)..(190): n is a, c, g, or t
  modified_base (237)..(237): a, c, t, g, unknown or other
  misc_feature (237)..(237): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
tcagacatacgcgtcacgaccggtgctcgatttagtgctatagacttgggtttgggggctttgcctgggctctgctcctcctcagcctcctcactcaggcacaggatcctggctcagtctgccctgactcagcctcgctcagtcgtccggtctcctggacagtcagtcacatctcctgcacgtggaaccngcagtgacgttggtgtaacagtatcgtctctgtaccaacaccaccgngccacacgaccccaaatcatgatttangagtcacgtaggccgctcgacggtccngactcgcttcgtcgtcgcctacgagtcgtcggaccacgaccgtccctccgtcgtaccgtcgtcgtcggtcctccgaggtccgtaggaggtgtcggacgtcgttagtacttacgttacgtcgtacttaccgtactaagttacgtcgacgtacggtccgtactaacggttcggtttcgggttcgttccgggaacggtaccgggaacctaacggtccgtaacggtacccgttacgttacggaccgaaccggtacccggtacggtcccgtacccggtccccgttacggtcccgttacccgtcccgttccccgttaacccccgtacccttccgacccgtaccggttccttcgtaacgttcccgg

SEQ ID NO: 189237 - DNA, 685 bp, Homo sapiens
  misc_feature: GYAE6OF01D36HQ.22.86.H09.1.454.CMB.1.raw
  modified_base (271)..(271): a, c, t, g, unknown or other
  misc_feature (271)..(271): n is a, c, g, or t
tcagacatacgcgtcacgaccggtgctcgatttagtgctatagacttggggtttgggggctttgcctgggctctgctcctcctcagcctcctcactcaggcacaggatcctggctcagtctgccctgactcagcctcgctcagtgtccggtctcctggacagtcagtcaccatctcctacactggaaccagcagtgatgttggtggttaataactatgtctcctaggtaccaacagcaccgaggacaaacgccccagactcatctaattangctgtacaatacgccgcctcgacggtcctgactcgcttctcgtggcctcgaagtcgtcggacaacgacggtccctaccctcgtaccctacttacctccggtcgggacctccggaaggtacctaggaaacgtcgtaggacggtcttaggtaactttaacgttacgtcgtacgttacgtacttacgttacgtttcggaccgtacggtaccgttaccgttacgttaccgggtttcggggtcggttacgggaccgggtaacggaccgtaacggccgttacggtacccgttaccggtaaacggtccgaacccgggtaccgtaacgggcccgttaccccggtaccccgttcgggtaacccttccgtacccgtttccccgttacccccgtacccctttacccgtaccgtaccggttacccg

SEQ ID NO: 189238 - DNA, 536 bp, Homo sapiens
  misc_feature: GYAE6OF01AH2C5.22.86.H09.1.454.CMB.1.raw
  modified_base (345)..(345): a, c, t, g, unknown or other
  misc_feature (345)..(345): n is a, c, g, or t
  modified_base (481)..(481): a, c, t, g, unknown or other
  misc_feature (481)..(481): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctggggaggtccctgagactctcctgtgcagcgtctggattcaccttcagtggctatggcatgcactggcctccgccaggccgtccggggcaaggggctgggaggtgggtggcaagttnagtggtatgatggaaataataaagctagtgtggactcggtagacgggcattcacctatctaccagacgaccaactaccaagaacactctcgtttcacaaatcgaacacgcctagacgacggcgaacggacgacggnagtagtattacgtggtagacgagagactacgacagtacgacgtaagggaagttcg

SEQ ID NO: 189239 - DNA, 971 bp, Homo sapiens
  misc_feature: GYAE6OF01CS289.22.86.H09.1.454.CMB.1.raw
  modified_base (180)..(180): a, c, t, g, unknown or other
  misc_feature (180)..(180): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctggagtcgttgggttttcctcgttgtcttacgttttaaggnggttcgtccagtgtcgaggtgcaggtcgtgggtggagtcggtgggggaggcgtcggtccgaggccgtgggacgtcctgacgtacctcctccgtgtcgcgacggtcgttcgtaggtactttccgacgttcgtaggttcggactagtcggactagtcgacctacggtccggaccgtcccggaccgaccgggtcccggtacccggggacggaacgggggtcgtagggggtacgggttacggggtacgtaacgttaaggtttaacgttaggtaggttaagtaggtaaagttaaagggtaaaacgttaaagtaaaacgtacttagggttacggtaccggtacgttacccgggaaggaccggggtaccttaaccgtacctaaccgtacgtacccgtaaccgtaaacggtaacgtaaaccccgtaaacgtaaaccccggtaaaaccgtaaacccgtttaaccgttttaacccgttttaacccggtttttaaacccgaaaaccccgttaaaaacggtaacccggttaaaacccgttaacccgggttaccccgggtaaaacggggaacgggtaaacccgggggtaaaccggggtaaaaccgggtaaccccgggaaacgggttaaaccgggtttaaacgggttttaaccgggtttaaaccgttttaacccgggtaggggttaaaccgggaaaccgggttaaaggtaaacccgtaaccggttaaacgtaaaacccgggttaacgggttaaaccggggttaaaaccggggttaaaacccggggtttaaacgtttttaaccggg

SEQ ID NO: 189240 - DNA, 885 bp, Homo sapiens
  misc_feature: GYAE6OF01EJLLQ.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtcgtccggtctccgtggacagtcagtcaccatcctacctacactggaaccagcagtgatggttggtaggttaactaactatcgtcctccgtaggtaaccaactacgccaacccgaggaccaaaaccgcccccaagtacctcattctaatttatacgtctagtacaaagttaacggcccggtacccgtacggtacggggtccctggtaccttccgtccttctcgtcggtcctaccgtaagtccgtacggacctaaacccgccggtccccttacccgtacgtaccctacgttcccgttccggtccggggtaccctaccggtaacggtacgtaacgggtaacgtaacggttacggtaacggtacgtttaacgttaattttaaccgtttaaccgtcgttccgttacgtttacccgttaacgtttcgttacgggtacccgttaacgggtacccgtttacccgttaaccggtttaccgggtttcgggggtttaccgggtttaccgggggaaccgggttaacccggggtaaccgtaacggttacccggttacccgggtaccccggtttacccgggttaaccgggtacccgtaaacccgggtaaccccggttaaccgggtcccccgttacccccgggttaccccccgtttcccgggttaccccgtacccccggtttaccccgtttacccccgttaccccccccgttacccccggtttaccccgtttccccggaacccgggttaacccgg

SEQ ID NO: 189241 - DNA, 554 bp, Homo sapiens
  misc_feature: GYAE6OF01BSO69.22.86.H09.1.454.CMB.1.raw
  modified_base (156)..(156): a, c, t, g, unknown or other
  misc_feature (156)..(156): n is a, c, g, or t
  modified_base (271)..(271): a, c, t, g, unknown or other
  misc_feature (271)..(271): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (427)..(427): a, c, t, g, unknown or other
  misc_feature (427)..(427): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttccncgttgctcttttaagagtgtccagtgtcaggtgcagctggtgagtctggggagcgtggtccaggccctgggagttccctgacgactctcctgtgcaggcgtctggattcaccttnagtggctagtggcatcgcacgtggcctccgcctaggcctccggggnaagggggtcctgggagtgggtgacaagttntagtggtatggatagggaaagtaagtaaagcgttatggtggacttccggtaggaacgggccgattcacctatctcaaganacaactacaacgactactcttgtttactaccaatcgaacgagtacctagagtaggacgaggacacggctagtcgttaagttacgtgtagacgtagagtatacgacgataggacgtagggtaagttcg

SEQ ID NO: 189242 - DNA, 946 bp, Homo sapiens
  misc_feature: GYAE6OF01EC9AC.22.86.H09.1.454.CMB.1.raw
  modified_base (176)..(176): a, c, t, g, unknown or other
  misc_feature (176)..(176): n is a, c, g, or t
  modified_base (846)..(846): a, c, t, g, unknown or other
  misc_feature (846)..(846): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcgttttaaagnggttgtccagtgtcgaggtgcagcgtgggtggagtcggtggggggacgtcgtggtccaggccgtgggacgtccctgacgtcctctcgtgtgcgagtcgttctggtacctttcgaaccctttgaggttcggacttagtgggtacctagttcggcctaccggtcggcccgttacccgccggaacgggtcccggtacccggggacggtaacgggggtccgtagggggtagggttcggggtacggtaccttaaagttagttaagttagggtaatagggtaagttaaagggtaaaacgtttaaaaagtaaacggttactttaacgggtacggttaacggggttaacccggttaaccgggtaacgggggaaacccggggtttacccggtaactttaccccggaaaccccttacggtttaaccccgtaaccgtaaacgggaacccgtaaaaaccccgttaaacccgtaacccgtaaaaccgtaaaccccgtttaaccccgttttaccgtttttaacccggtttaaaccgttaaacccaaaaggtttaacccggaaacccgtaaacccgggtttacccggtaacggggtaaaagggtacccggggaaccggttaaaccgggggaacccgtaaaccggggttacgtaaacgggtttacgttaaacgggttttaaccggnggggtttaacccggacgggtaaacggtaacggtaccgtaacgtaaaccggttaggttaaacgggttaaacccgggttaaacgggtaaaggtttttcccgg

SEQ ID NO: 189243 - DNA, 803 bp, Homo sapiens
  misc_feature: GYAE6OF01B43T8.22.86.H09.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (323)..(323): a, c, t, g, unknown or other
  misc_feature (323)..(323): n is a, c, g, or t
tcagacatacgcgtcacgaccggtgctcgatttagtgctatagacttgggtttggggagaggagcccagcactagaagtcggcggtgtttccagttcggtgatcagcactgaaacacagaggactcaccatgggtagtttgggctgagtcgttggttttcctcgttgtcttagttttaagnggtgtccagtgtacagggtncagtcgtgggtggtacgtcggtggggggacgtccggttggcccaggtccggtggggacgtcccgtagacgtccttctccgttggacgactacggtctacgttcggaactttccgtaccttgnggtacggtacttaggtcggactacgtcgtaccgtaacggttcggaccctcccggacggaacgggtcccggttaccggggaacggtaacggggtccgtagggtaaccgggttggggtactaacggttaaattttaggaaggttttgggaaaccgttaaggggaacggttaaaggtaaaacgtttaaaagtaaaccgtacgtttaagtaccgggtacgtaaacccggttgggtaacggaaaccgggtcctacttaccgaacgtactaccgtaacgaacgaacaaccgtaaccgtaccgaaacgtaacctactttacgttacgttaacctacgtaaacgtaacgaacctacgaccgtaagacgggtaccggtacgaaccggtacgaccgaggttaacggttactaacggtttcgaggttacgaacggtagtacctaaggaacccgttacgaagtaacgggtaacgttaaaggtcgtttaacgg

SEQ ID NO: 189244 - DNA, 671 bp, Homo sapiens
  misc_feature: GYAE6OF01EVT4X.22.86.H09.1.454.CMB.1.raw
  modified_base (311)..(311): a, c, t, g, unknown or other
  misc_feature (311)..(311): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgcagcgtctggattccaccttcagtggctatggcatgcactggctccgccaggcgtccgggnaaggggctgggagtggggtgactaagttatagtgggtatggagtaggtaaagtaaataaagacttagtggtaggacgttccggtaggaacgggccgtagtttaccaacctactcctaccgaaggaacgaaccaacctacccgtaaacgaaccttaccttaccgtttacgtttccctaaccgtaaacgttacgaaaccgtaaggtaccccgtaaggaaccgggtaacggggaaccggaaccgggaaccgtaaccgggactaagggtttacgtaacgttttacggtcggtaggtacgggaaggacgtaagtacccggtaagtaacgttacggtaaccggttaaacggggtaaacgtttacgg

SEQ ID NO: 189245 - DNA, 584 bp, Homo sapiens
  misc_feature: GYAE6OF01ER7JR.22.86.H09.1.454.CMB.1.raw
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctctttaagngtgtccagtgtcaggtncagctggtggagtcgtgggggagcgtggtccagccgtgggagtccctgagacctctctgtgcagcgtctggattccaccttcgagtggctatggctatcgctacgtcgggcctccggccgaggccgtaccgggcgaaggggctgggagtcgggtgactaatgtagtgtatgaataggaaataanaagatagtgtacggactcggaggaacggtcgtactcacactcacgacgacacaactaccgaanaaccncttcgtacgtttaccaactaatacgaacgtacgacccgtagacgacgggacgaacgggaccacgggtctacggttcgtacttacggtggtagtacggagacgtacacggtaacaggtaacgacggttaacgggaagtttaccgg

SEQ ID NO: 189246 - DNA, 675 bp, Homo sapiens
  misc_feature: GYAE6OF01CP7R8.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcacttcagtggctatggcatgcactcggcctccggccgacggcctcccggggacaagggggctggggaggtggggtggactaattagtagtggtatggaagtaggaaagtaataaagactagttggtggtactccggtaggaacggggtcccgtagttccaaccattcctacccgagaacgaaccaaccgtaccaaagaaccctaccttcgttacgttttacctaaccctaaaatacgaaaccacggtaccctagggaagggtaacggggacccggaaggggaacccgaaccggggtaccgtaacgggtttaggttaacgtttaaccggtgggttacggacggtaaaggaggtaaccgttacggaacgaacggttacggtaaaccggttaaacgggggtaaacgtttacgg

SEQ ID NO: 189247 - DNA, 779 bp, Homo sapiens
  misc_feature: GYAE6OF01BJ4S3.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatccgtgggctcagtctcgccctgactcagcctcgctcagtcgtccgggtctccgtggacagtcagtcacctatcctcctacacgtcggaaccagcagtgattggttggtagttaataactattgtcctaccgtacggtaaccaacgcgacccacccgaaggaccaaaacccgcccccaagtacctaccaacttctaactttagtcgtacgtacgtaactaaacggtaccggcccggtaccccgttacggtaccggggttaccctaggtaccttccggtccttcgtccgtacggtccctacgtaacgttccgtacggaccaacccgtaccggtccctacccgtacgaccttacgtcccgtcggtcgggtccctacggacgtacgtaggaacgtagtacggtcgtacgtagttaacgtttacttaccggtcgtccgtactaccgttactttacgttacggaccggtaccggtaccttacccggttaaccgtttcgggtttcggggtaccgggtaccggggaccgggttaaccgggtacgtacgggtacccgtaccgggtacccgtacgtaccgggcctaaccgggacccgtaccgggtccctcccgccccggttaccggtccttcccgttcccgttaccccgtaccccgtaccctcccgtccgtccggttcccg

SEQ ID NO: 189248 - DNA, 693 bp, Homo sapiens
  misc_feature: GYAE6OF01C16JY.22.86.H09.1.454.CMB.1.raw
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
  modified_base (372)..(372): a, c, t, g, unknown or other
  misc_feature (372)..(372): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggatttccgacctttcgagtggctatggcatgcacgtggcctccgccgaggctccgggnaaggggctgggagtgggngactaagttatagtggtatgagtagggaaattaaanaaagacgttagtggtacggtaccttccgggtagggaaacggggtcccgtaatttcccaaccctactcccgtacccgaaggaacgaaaccctaaccttacccgaaaacgtaacctaaccgttccgtttacgtttttaacccaccctaaaaagttcgaaaaccgacgggtacccttagggaacgggaacgggaccgggtaacggaccgaaccgggtactaaggttacggttaactttaaccggttgggtacgaaccggtaaggaggtaacttaccggaactaaggtacgggtaaacccggttaaacggggtaaacgttttccg

SEQ ID NO: 189249 - DNA, 828 bp, Homo sapiens
  misc_feature: GYAE6OF01AGIBA.22.86.H09.1.454.CMB.1.raw
tcagacatacgcgtcacgaccggtgctcgatttagtgctatagacttgggtttgggggcttttcctgggctctgctattcctcaccttcctcactcagggcacagggtcctgggcccagtctgccctgacccagcctgcctccgtgtctggatcatctggacagtcgatcagcatttcctgcacgtgggaccaacagtgactattgggtcttttgactctgtcctctggtaccaacaacaccagaccaaacccccatcatcattatggtctcactccgtcggccctagaggacgtcctcgtcacttccgccttctcgacgggtcctaccgtaaggttccgtcggaccctaaaccgaccgggtaccccttacccgtaaaccctagttcccttccggtaggggtcccttaccggtaaggtttacggaacggtacgtaacgttaccttaaacgtttacgttaaccgttgtaccgtttaacgttttaacccgttttaaaagttaccgggtacctacccgttaaaccgtttccggtttaccgggtttacgggtttttacccgggaccggggttaaccggtaccgtaaacccgggttaagtacccggttacccggttcccggttacccgggtaccgtaacccggttaaccccgtaacgggtcccttacccccgggtacccccgttacggggttaccctacccgttccggtttaccccggttcccccgttccccgtacccgttaccggtaccggtaccgttacgttcccgggtaccgttccggggtaaccggtcccggggtaccgttaccgggaaccgttaccggcccggtaccg

SEQ ID NO: 189250 - DNA, 841 bp, Homo sapiens
  misc_feature: GYAE6OF01DTE0Q.22.86.H09.1.454.CMB.1.raw
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcacatggagtttgggctgagcttgggttttcctcgttgcttacttttaaggnggtgtccagtgtcgaggtgcagcgtggtggngtcggtgggggagtcgtggtccaggccgtggggacgtccctggacgtacctcgtcgtgtcgacgcggtcgttcggtagttaccttaccgtaccgttggtagggttccgtacgtaggtcggactacgtcggtaccgtacggtccggtacccgtcccggaccggtaccgggtccgggtaccggggaacgggtaaccggggtggtaggggtacggggttaggggttacgaaatttaaaggttacggttaaggttagggtaagtaagggtaaaggttaaaacggtaaaaagttaaaagtaacggttacgttaggtacgggttaaccggacccggttaacgggtaagggtaacccgggtaccttaccgttaacgaaccgttaccgtaccgaaacgtaaacggtaaccctaaacccgtaactaaacccgaaacgttaaccttaccgtttaccgtttaccgttaaaccctaaacgtaaacgtaacggacccgtaacgtacccgggtaagggtaaccggaaccgggtaacggaacggtaacgtacgggtacgttaagttacccgttaagttccggaggtaccggaggaaacgtcgttaacgaccgtaactagggtaccggttaaacggtaggttcgtttacgg

SEQ ID NO: 189251 - DNA, 660 bp, Homo sapiens
  misc_feature: GYAE6OF01A6IWH.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtcgcaggcgtctggacttcaccttcaggtcggctagtggctagtgcacgtcggcctccgccgaggccgtccgggcgaaggggcctagggagggtgggtggactaagtttacgtagtggtatggagtaggtaaagtaataaagcgttagtcggtacggtacctcggtaggaacgggtccgtattaccgactactcctaccaagtacgaacctaacctaccaaacgtaacctaccgtttacgttacgtttacctaacctaaacgtacgaaaccgtacgtaccggtagtacggtaacgggacggaacggtaccgaaccgggtacgtacggttacggttaacttacgttacgtacggacggaacggtagtaacgtacgtaacgtacgttaggaacggtaacgggtaacggtttaccg

SEQ ID NO: 189252 - DNA, 1016 bp, Homo sapiens
  misc_feature: GYAE6OF01ESRH9.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtgggagtccctgagactctcctgtcgcagcgttcgtggactttccaccttcaggtggcttagtcggacatcgactacgtcgggcctcccggccgacgggcccgtacccggggacggaaacggggggtccttagggggagggttcgggggttacggaccttaaaagtttagtaaggttggggttaaagtgggtaagttaaggggtaaaaagtttaaaacgttaaaaaggtccgtttaaaggtacgggttacggggtaacccgtttacccggggttaagggtaaaacccgggggtcccgttaaacttttaccccgaaaccccgttaacgtttacccccgtaaccccggtaaaacggtaaaccggtaaaacccctaaaaacccccgttaaacccccggtaaaaaacgggttaaaaaccccctttaaacccgtttttaacccggttttaacccgggtttttttaaacccccgttaaaaaccccccttaaaaaacgggtttaaacccggaaaaaccccggtaaaccgggttaacccccggttaaggggtaaaccggggtaaccgggggtaaacccgggtaaaccggggtaaaccccgggtaaccgggggttaaaccgttaaacggggttttaacgggttttaaaacgttttaacccgggttacggggttaaccgggaaaccggggtaaaggggtaaaccgttaaacccggttacccgggtaaaaccgtaaacggggtttaacccggtaaaaacccggggtttaaaaccgggggtaaaacgttttttaccccggg

SEQ ID NO: 189253 - DNA, 871 bp, Homo sapiens
  misc_feature: GYAE6OF01B7WW4.22.86.H09.1.454.CMB.1.raw
tcagacatacgcgtcacgaccggtgctcgatttagtgctatagacttgggtttggggctttgcctgggctctgctcctcctcagcctcctcactcaggcacaggatcctgggctcagtctcgccctgactcagcctcgctacgagtcgtccggtctccgtggacagtcagtcaccatcctcctacactggaaccagcagtgattggttggtagttaacagtatcgtcctccgtaggtaaccaacgaccaccgaggccacaccgaccccaaatcgatagtatttacgagtacgtacacgtaacggcggtacctggacgggtccctagactccgtcgttacgtctacggcttaccgaacggtttccgcgggacccgtaaccgtcccggtcccgttacccgtacgggtaccccgttcgttccggtacgggtcccgtacggaacggttccgtagggaacggtagtacggtacgggtaccttagggttaacttttaaccgttacggtaccgttaccgttaaccgttaaccgtaacgtttaacgttacgggaccgttaacggggtacccggtaaccgtttaccggtttccgggtttaaggggttcccgggttaccggggaaccgggttaaccgggtaaaccgtaccggtaccgttacccgggtaaccccggttaacggttacccggtaaccgtaaacccggtcccccgggtaaagggttcccccccgttacccggtaccccccgggttttaccgggtaacccccttaaccgggtttccccccggtttccccgtaaccccccccgtttaccccgggttacccgtacccggtttaaaccccggttacccggtttaaccggttccggtttaaacccgggg

SEQ ID NO: 189254 - DNA, 661 bp, Homo sapiens
  misc_feature: GYAE6OF01CYV4K.22.86.H09.1.454.CMB.1.raw
  modified_base (156)..(156): a, c, t, g, unknown or other
  misc_feature (156)..(156): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagtctgggttttccncgttgctcttttaagaggtgtccagtgtcaggtgcagctggtggagtcgtgggggagcgtggtccagccgtgggacggtccctggagactctcctgtgcaggcgtctggacttccacttcgagtggctagtggcagtgcacgtcgccgtccgcgacggccgtccggggagaacggggctggggtacggtggggtacggactaagttacgtagttagggtaataggaagttagggtaaaacgtaacgtaaaagacgttagtggtacggtacctccgggaggacggggtaccacgtccaccgtactaccgtacgagaacgaaccaaccgtaccaaagtaaccctacgtcttacgtttaccacctaaagtcgaaccagtacccgtaggacgacgggtaccgaaggacctaacgggcgtaacggtacgttaagtaccggtcggtaagccggtaaagtacgtaacgtcgtaaaccgtaggtacggtaacggtaaacgggttacgttacgg

SEQ ID NO: 189255 - DNA, 617 bp, Homo sapiens
  misc_feature: GYAE6OF01CCK03.22.86.H09.1.454.CMB.1.raw
  modified_base (190)..(190): a, c, t, g, unknown or other
  misc_feature (190)..(190): n is a, c, g, or t
  modified_base (453)..(453): a, c, t, g, unknown or other
  misc_feature (453)..(453): n is a, c, g, or t
  modified_base (572)..(572): a, c, t, g, unknown or other
  misc_feature (572)..(572): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagcttgggttttcctcgttgctcttttaagaggtgtccagtgtcaggtncagcgtggtggagtcgtgggggaggcgtggtccagccgtgggacgtccctgacgctctcctgtgcagcgtctggacttccaccttcgaggttggcttagtggctatcgctacgtcggcctccgccgaggccgtccgggacgaaggggcctgggacggttggggtcgacgtaattacgtagtggtatggaagtaggaaagtaaataaacgcttaagtggtacgtacgtacggtaggacgggtaccgtattaccaccgtataccncgaagacgaacaccgtaccaaagtaacctacttcttacgttactaaccctaataccgaataccgaccgtacggaggacgacggaacgacgaccggagtagtagtacgtacgtgtacggngtaacgataacgcgtacacgtgaaacggtacgggtaagtttacgg

SEQ ID NO: 189256 - DNA, 713 bp, Homo sapiens
  misc_feature: GYAE6OF01D0BJ1.22.86.H09.1.454.CMB.1.raw
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
tcagacatacgcgtcacgaccggtgctcgattttagtgctatagactttgggtttggggagaggagcccagcactagaagtcggcggtgtttccattcggtgatcagcactgaacacagaggactcaccatggagtttgggctgagtcttgggtttttcctcgtttgcttctttttaagaggtgtccagttgtcgaggtncagcgtggtggagtcggtgggggagcggtgtccagccgtggggacgtcccngacgactctcctgtcgcgagcgtctgacttccaccgttgagtgctagnggcagtgcagtcggcctccgccgacggccgtccgggacgaggggtctagggacggttgggtacgacttaagttagtagtgggttataggaagttaggaaaagttaaacgtaaagacttaggtggttacggaccgttcggtaagggacgggtaccgtacgttaccaacctattaccacgaacgaacgaaccctaaacccgacctaaacgtaaccttcctttaccgtttaccgtttacctaacctaaacgtacgtaaaccgacggtacccgtaagggacgacgggtaccggaacggaaccgaccgggtacgtaagggttacgtttaacgttacggttacggtagggtacggtaaagacgttaccgacgtacggtaagtaccggtaaaaccggttaccggggttaaattttaccggg

SEQ ID NO: 189257 - DNA, 922 bp, Homo sapiens
  misc_feature: GYAE6OF01EQ6XU.22.86.H09.1.454.CMB.1.raw
  modified_base (230)..(230): a, c, t, g, unknown or other
  misc_feature (230)..(230): n is a, c, g, or t
  modified_base (263)..(263): a, c, t, g, unknown or other
  misc_feature (263)..(263): n is a, c, g, or t
tcagacatacgcgtcacgaccggtgctcgatttagtgctatagacttgggtttgggggctttgcctgggctctgctcctcctcagcctcctcactcagggcacaggatcctggctcagtctgccctgactcagcctcgctcagtgtccggtctcctggacagtcagtcaccatctcctacactggaaccagcagtgatgttggtgttataactatgtctcctgtaccaangcacccagccaaacccccatcatcattatggtntcactcggtaccggcccctagaggtacgttccttacgtcagttccgactttcctaccgaggtccttacccgtaaaggttccgtacgggaccaaaccgtacccggtaccccttaacccccgttaaactaccgtttcccgtcggttccggggtacccttacccgttaaagggttttccggaaacgggtaaacccgttacgtttaccccgttttaaacgttttaacgtttaacccgtttacggtaacccgtttaacggtttttaacccctttttaaaaacggttacgggtacccgttaccccgttaccgtttacccggtttaccggggtttttcgggttttttacccgggggaccgggttaaccggggtaccccgttaaaccccggggtaaacgttaccgggtaacccccggttttacccgggttaccccgggttaacccggtaaccccgggaaccccggttaaccgggtcccccggtttaccccgggtacccccccggtttccggggtaaccccgttaaccccggtttacccgtttcccccggtttacccccccgtaacccccgttaccccggttcccttaaacccccgggttacgtttaaacccgttcgggttaccccggtagggttaacccggggtccccgggtcgggtaaccccgggg

SEQ ID NO: 189258 - DNA, 688 bp, Homo sapiens
  misc_feature: GYAE6OF01AW2GV.22.86.H09.1.454.CMB.1.raw
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctccgtggtaccaacagcacccaggacaaacgccccagactcatcatttangctgtcaatacggccgcctcgacgggtccctgactcgcttctcgtggcctcgagtcnggtaccaaccgccggcctcccgtagaccctagtcctacgtcgggtcctccgaggtctaggaacgtacgtcggaggtcctagtaactttacttaccgtgtccgtacgtcctactacgtttcgacgtacgccgtacctacgtacgggtttcgggtcggttacgggcgggtaacgggacccgtaaggtcccgttaccgggtacccgttaccggtaacggttacccgaacccggtaccccggaaacggttcccgtaccccgggttaccccccgttcggggttacccccgttaaccgttcccccgggtttcccggttcccccccggtaccccccgttccccgtttcccgaacccgggtttccccgg

SEQ ID NO: 189259 - DNA, 625 bp, Homo sapiens
  misc_feature: GYAE6OF01AX4YU.22.86.H09.1.454.CMB.1.raw
  modified_base (300)..(300): a, c, t, g, unknown or other
  misc_feature (300)..(300): n is a, c, g, or t
tcagacatacgcgtcacgaccggtgctcgatttagtgctatagacttgggtttgggggctttgcctgggctctactcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccagcaaacgcccccagactcatcatttatgctgtcaataagccggccctcgacgggtcccngactcgcttctctggctccagtctggaccaacgaccggccctcccgtgaccctatcctcgtcgggcctcccgaggtcctagaagtagtcggaggtcttagtatttattacctggcttgccttactagtttcggccacggtccgtaccgttacgtacgtttggggtcggttccggggacgggtaacgggaaccgtaacggtccgtacgtacccggtccgtaacggtccgacggccccgaacggtcccgtcccgtccccccggttcggtaccctaccgttcccgttcccgttcccccaccccgttcccctccgtccggtccgttacg

SEQ ID NO: 189260 - DNA, 690 bp, Homo sapiens
  misc_feature: GYAE6OF01AX3S6.22.86.H09.1.454.CMB.1.raw
  modified_base (266)..(266): a, c, t, g, unknown or other
  misc_feature (266)..(266): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgctcttttaagaggtgtccagtgtcgaggtgcagcgtggtggagtcgtgggggaggcgtgtccagccgtgggacggtccctgagactctcctgtgcagcgtctgnttcaccttcgagtgctagtcggctatcgctacgtcggaccgtcccggccgtagggcccgtaccggggacgaaggggcgtcgggaggtcgggtacgacgtaattagtacgtaggtatggtatagggtaaagtaaagtaaagtactagtcggtaccggtaacttccgggtaaggtaaccgggtacctacgttaccacctacgtccgttaacccgaagaaccgtaaccaaacccgtacccgaagtaaaccctcgttaccgtttaccgttaccgtaactaaacgtacgaaccgtacgtacgtagggacggacggtacgtacggaccgacggtcgtacgttacgtaacgttacggtcggtagaacggtaggaacgtaccgtacggtaaacgtaggtaacggtaaccgggttaaagggttatttaccggg

SEQ ID NO: 189261 - DNA, 719 bp, Homo sapiens
  misc_feature: GYAE6OF01A3JIR.22.86.H09.1.454.CMB.1.raw
  modified_base (156)..(156): a, c, t, g, unknown or other
  misc_feature (156)..(156): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttccncgttgctcttttaagaggtgtccagtgtcaggtgcagctgggtggagtcgtgggggagcgtggtccagccgtgggacgtccctgacgacctctcctgngcgagcgtctggacttccaccttnagtgctagnggcagtcgcctacgtcggcctccggccgacgggccgtcccggggacgaagggggtccttaggggagggttggggtacgaactaaagtttagtaaggtgggttaatcggtaagttaagggaaaacgttaaaagtaaacggtacttaaggtagggttacggaaccttaccgggtaagggaacgggtcccgtaatttcccggaaccttacgtaccctaccgaagaactaaccaaaccctaccgaaacgtaaccttaccgtttacgttaccgtttaccgaacctaaagttacgaaacctacggtaccgtacgggaacggtacgggacgaacggaacgaccggagtaggttacgtacgtttacggtaggtggaacggtaggtaacgtacgttaccgaacgttacgtaacggtaaccggttaaaggggtaacgtttcg

SEQ ID NO: 189262 - DNA, 677 bp, Homo sapiens
  misc_feature: GYAE6OF01C4TLL.22.86.H09.1.454.CMB.1.raw
  modified_base (245)..(245): a, c, t, g, unknown or other
  misc_feature (245)..(245): n is a, c, g, or t
  modified_base (345)..(345): a, c, t, g, unknown or other
  misc_feature (345)..(345): n is a, c, g, or t
  modified_base (398)..(398): a, c, t, g, unknown or other
  misc_feature (398)..(398): n is a, c, g, or t
tcagacatacgcgtcacgaccggtgctcgatttagtgctatagacttgggttgggggctttgcctgggctctgctcctcctcagcctcctcactcagggcacaggatcctgggctcagtctgccctgactcagcctcgctcagtcgtccgggtctccgtggactagtcagtcaccatcctcctacacgtggaaccagcaggtgagttgttggtagttataactatcgtctccgtggtaacccaanacgaccaccgaggtaccaaaaccgccccaagtacctcataccgtatttactcgctagtacaagtaacggccgcctcggacgggtcctgtactcgtcttcncgtcgcctacgagtctgacacgccgcctcctacgacctatcgtcgtcggtccncgagctagaagtgtagtagtctagtattacgttactacgtctacgtcttacgtagtttcgacgtacggtcccgtaccgtacgttacgggttcgggttacggtaccggggacggtaaccggggtacccgtaacggtccgttaacccggtacccggttaccgtaaccgggtaccgtacccggacccggtaacggttccccggtaccccggttacccccggtacggttacccctacgttccccgttaccgtcccccgtacccgtccgtacccgtcggtaccg

SEQ ID NO: 189263 - DNA, 831 bp, Homo sapiens
  misc_feature: GYAE6OF01BX7Y9.22.86.H09.1.454.CMB.1.raw
  modified_base (282)..(282): a, c, t, g, unknown or other
  misc_feature (282)..(282): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtggggacggtccctgacgaccttcctcctgtcgcagcgtctggattccaccttnagttggactagtggctatgcctacgtcggcctcccgccgacgggtccgtacccggggcggtaacgggggtccgttaggggacggggttcgggggtacggaaccgttaaagtttaagttacgttaggggtttaatagggtaaagtaacgggtaaaaaggttaaaaacgttaaaacggtaacgttaaggtttacgggtacgggtaacccgtttaccggggagggtaaacggggtaccgttaacgttacccgtaaccgtacttacccgtacccgaaacggtaacgtaaaccctaaaccctaacccgaaaacggtaaaccctaaccctttaccttaccgttttacccgtaaaccgtaaacttaaccggaaacctacggtaccgtaagggaacggtaaccggggtacggaacggacgggaacccgggtaacggttaagggtttacggttaaacgtttacgggttacggtacgggttacggaaacggtaggtaacgttaacccggaacttaacggtaacggtaaaccgggttaaaccggggtaagttttaccggg

SEQ ID NO: 189264 - DNA, 655 bp, Homo sapiens
  misc_feature: GYAE6OF01BUDW1.22.86.H09.1.454.CMB.1.raw
  modified_base (242)..(242): a, c, t, g, unknown or other
  misc_feature (242)..(242): n is a, c, g, or t
  modified_base (329)..(329): a, c, t, g, unknown or other
  misc_feature (329)..(329): n is a, c, g, or t
tcagacatacgcgtcacgaccggtgctcgatttagtgctatagacttggggtttggggggaggcgtggtccagcctgggaggtccctgagactctcctgtgcagcgtctggattcaccttcagtggctatggcatgcactggctccgccaggctccgggcaaggggctggagtgggtggcaattatatggtatgagtggaagtaataaagactatgtggactcggtgaaggcgatcacatcncagacacaactaccaagaacactctgtttcctactaaatgaacagcctgagaggcgaggacacggctagtcgtatctagtgcgaganagtcgaatatacggtaacgtaacgggaaagtcttttacgacttcgtacgtggggacctaagggactacgtcggtacctacccggttcttccgtactaacggtcccttacccgaacccggtaaaccgggccccgtaagtcccggttcccttcccccgtcggtcccccgtaccctcggccctaccgacgggtacgcccgtaaccctaccggacgacggacaccgtaccgggcccggtcccggacggggtcctccggtccggtacggtacggaaaccggtacttacccgttacccgtaccgcggttaagttcggtcgtggtacccgggg

SEQ ID NO: 189265 - DNA, 749 bp, Homo sapiens
  misc_feature: GYAE6OF01C8ICA.22.86.H09.1.454.CMB.1.raw
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcggtgggggnggcgtggtccaggccgtggggacgtccctgacgtcctctcctgtcgcngtcgtctggattccaccttnagtggctagtggcangcacgtggcctccggccaggccgtccgggagacggggctgggaggtgggtagctaagttactagtggtataggagtagggtaaagttaaagtaaacgtacgttagtggtacggtacgttccgggtaagggtaacgggacccgttaacgttacccgaaccgtactacccgtacccgaaggaacgtaacccaaaccgttaccgaaacgtaacctacccgtttcgtttaccgttttaccctaaacctaagtacgtaaaccgaccgtacccggtaagggaacgggacgggtaccgggaacgggaacccggtaccggggtacgttaacggtttacggttaaacgttttaaccggtcggtagggtaacgggtaaacggaaccgttaaggtaacccggtaacgttaaacgggttaacgggtaaacccgggttaaacgggggtaaactttttacccgggg

SEQ ID NO: 189266 - DNA, 920 bp, Homo sapiens
  misc_feature: GYAE6OF01DVF6T.22.86.H09.1.454.CMB.1.raw
tcagacatacgcgtcacgaccggtgctcgatttagtgctatagacttggggtttgggggctttgcctgggctctgctcctcctcagcctcctcactcgagggcacaggactccgtgggctcgagtctcgccctgactcacgcctcgctcgaggtcggtccggtctccgtaggacagtcacgtccacctacttcctacctacgacgtacggaaccagcgtaggtgtagttggttaggtacgttaactaacgtgttacgttcctaccgtacggtaacctaacgacgacccaaccgaacggaaccctaaacccggaccccgagtaccttacgtacttacgtttaacgtttacgtcgttacgttacgtaaccgtaaacggtacccgggtcccggttaccccgttacggggtaccggggtttaccctacggttaccgtttaccggttccctttacggttccggtttaccggtacccgttaaccggtaaccggttccgtaacgggaacccgtaacccggtaccggttaccccgttacccgtaacggtaaccctttacggtcccgtttaccgggtaccggtttacccgtttaccgggtttaacgggttaacggtaaacccgggttaccgtttaaccgtttaccgtttaactttaccggtttaccgtaccggtttaaccgttttaaaaccgttttaaccgttaacgggtccggttacccgttaccgttacggttttcccgggttacgggtttacgggtttacccgggacggttaacgtacccgggtaacgttacggtcccgttaaccggtccggtacgtaccgaccgtaccgacggtcccgtcccgtacccgtccgtacttcccggttcccgtccctacccgtccctaccggtacgtacgttacgttcgtagccggtggtccgggtcg

SEQ ID NO: 189267 - DNA, 746 bp, Homo sapiens
  misc_feature: GYAE6OF01E4N9W.22.86.H09.1.454.CMB.1.raw
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
  modified_base (300)..(300): a, c, t, g, unknown or other
  misc_feature (300)..(300): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaagnggtgtccagtgtcaggtncagcgtggtggagtcgtgggggagcgtggtccagccgtggggacgtccctgacgtacctctccgtgtcgcaggtcgtcgtggtacttccaccgttgaggtggcttagnggctagtcgctacgtcggccctcccgccgacgggcccggttacccggggacgtaacgggggtcgtggggtagggttgggtcggtaacttaagtttagtaggttaggttacgaggtagtaagggaaaagttaaacgtaaagtcgttaagtcggtaggtaccctcgggtaagggaaccgggtcctaacttcccgaacctagttaccccgtacgaacgaacgtaaccaaccgtacccgaagtacctaaccgtttcttacgtttacccaaacgtaagtaccgaacgtacgtaccgtagggaaacgtacggggtacggaccggaacggtacccgggagttaacgttacggttaacctttagggtcggtacgggtaaacggaggttaacggaacgttcccggaaaactcgggttaaacggacccgggtttaaaacggggtcgttttaccggg

SEQ ID NO: 189268 - DNA, 714 bp, Homo sapiens
  misc_feature: GYAE6OF01C9LBH.22.86.H09.1.454.CMB.1.raw
  modified_base (218)..(218): a, c, t, g, unknown or other
  misc_feature (218)..(218): n is a, c, g, or t
  modified_base (656)..(656): a, c, t, g, unknown or other
  misc_feature (656)..(656): n is a, c, g, or t
  modified_base (676)..(676): a, c, t, g, unknown or other
  misc_feature (676)..(676): n is a, c, g, or t
  modified_base (700)..(700): a, c, t, g, unknown or other
  misc_feature (700)..(700): n is a, c, g, or t
  modified_base (707)..(707): a, c, t, g, unknown or other
  misc_feature (707)..(707): n is a, c, g, or t
tcagacatacgcgtcacgaccggtgctcgatttagtgctatagacttggggtttgggggctttgcctgggctctgctcctcctcagcctcctcactcgagggcacaggactccgtggctcgagtctcgccctgactcacgcctcgctcgagtcggtcccggtctccgtggacagtcacgtccaccattcctacctacacgtacggaaccagcgagtgngttggttggttagttaactacgtagtcgtcctaccgtacggtaaccaacgaccgaccaaccggacggtaaccaaacccgcccccgtaagtacctactaacgttacttaattttcgcgtaccgttaacgtacgtaaaacggttaccggcccggtaccccgttacgggtaaccggggttccctaacggtacctttccgttaccgttccgttacgtccggaccctacgtaacgtcgtacgaccaaccggtaccgtccttacccgactacgtaccgtacctcggtacggactaccggaacgtcggtaacgtacgtacgtggacgtgtacgttaacttactacgtcgtacgtactctacgttcgtcgacgccgtcgtaccttcggtgtttacgggcggtcgggaccgtagggtacacgctacgtcgtcgacgtcaccggtacncggtccgtacccgcccgtcncgtccttcctaccgtcccgtaccncccggtntcgtacg

SEQ ID NO: 189269 - DNA, 710 bp, Homo sapiens
  misc_feature: GYAE6OF01CV3FT.22.86.H09.1.454.CMB.1.raw
  modified_base (188)..(188): a, c, t, g, unknown or other
  misc_feature (188)..(188): n is a, c, g, or t
  modified_base (262)..(262): a, c, t, g, unknown or other
  misc_feature (262)..(262): n is a, c, g, or t
  modified_base (308)..(308): a, c, t, g, unknown or other
  misc_feature (308)..(308): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgtggtttcctcgttgctctttaagaggtgtccagtgtcaggtncagctgggtggagtcggtgggggagcgtgggtcccaggcccgtggggacgtcccctgacgaccttctccgtggngcacggtcgtctggactttccgacctttcgagtgacttagtggacngtcgctacgtcggcctccgccgtaggccgtccggggacgaggggcgtgggaggtggggtaggtactaaagtttgagttgggtaattgggaagttaacgggtaaattaaagtaaacgtacttaaggtgtacgggaacttccgggaggacggggtacctacttcccgaacttagtacctaaccgaggtaacaaccgtaaccgtacaaagtaacctacgtctttacgttactaccaaagtccgaacgtacgtaccgtaggacgggaacgggtacggaacggacccgacgggttaaccgtaagggttacgttacggtttaaacgtcggggtgtaccgggtaaagaccgttaataccggtaaacctaaggttacggaaaaccggttaccggggtaaagttttaccgg

SEQ ID NO: 189270 - DNA, 720 bp, Homo sapiens
  misc_feature: GYAE6OF01DIXOP.22.86.H09.1.454.CMB.1.raw
  modified_base (194)..(194): a, c, t, g, unknown or other
  misc_feature (194)..(194): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgttgggttttcctcgttgcttcgttttaagaggtgtccagtgtcaggtncagctgggtggagtcggtgggggaggcgtggtccaggccgtgggacggtcctgacgctctccgtgtgcaggcgtctggtacttccaccttcgagttcgcttagtcggcatcgcacgttcggcctccgcgacggccgtccgggaggacggggtcgtgggacgggtggggtagacttaagttagtagtaggtataggaagttaggggtaaaactaaataaacggtattaggtaggtacggtaaccgttccgggtaaggaaccggggtacctaagttacccgaacctagttaccctaaccgaagtaaacccgaaccgtaaccctaaccgaaagtaaacccttaccctttcgtttaccgtttaacctaaccctaaagttaccgaaaaccgtcgtacccggtaaggaacggtaaccgggacggtaacccgggacgtaccgggtaaccgttaggtttaacgtacgtttacggagtacggacggtaaagtacgtacgtacgacgtaaggcccgtaaaggtacgggttattacg

SEQ ID NO: 189271 - DNA, 737 bp, Homo sapiens
  misc_feature: GYAE6OF01DHI42.22.86.H09.1.454.CMB.1.raw
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagcttgggttttcctcgtttgcttcttttaagaggtgtccagtgtcaggtgcagtcgtgggtggacgtcggtggggggagcggtggtccaggccgtggggacgtccctgacgtactctcgtgtcgcagcgtcgtggacttcaccttcgaggtggctagtcgacagtcgactacgtccggcctccggaccgtacgggccgtccggggaacgagggggtctaggggaggtgggtagtactaagttagtgtaaggttctaggaagttaggaaaagttaacgtaaagtcttggttacggtcggtacgttcggaacgggtaacgggaccttacgtaccaaccgttacgtaccctaacccggaaataaccggaaaccctaaacccgttaacgaaaacgtaaacccttcttaccgtttacgttttaaccaaacccgtaaagtaccgaaaccgtccgtacccggtaagggacgggtaccggtagggaacggtaccggtaacggtacgtacgggttattaacgtttcggtaggtacggtacggacgaacgtacgttaaccgaacttaaggtaccgtaaaaccgggttacgggtaaacgttttcgg

SEQ ID NO: 189272 - DNA, 830 bp, Homo sapiens
  misc_feature: GYAE6OF01DYN3A.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcacctagtggtagtttgggctgagtcgttgggttttcctcgttgcttacgttttaagaggttgtcctagtgtacgaggtcgctagtcgttgggtcggaggttcggtggggggacggtccggttaggtcccgaaggtcccgtacgggggtacgttccccgtggaaccgtccttccgtccgtggtcgaccgtagtccggttgtaggtacttccgtaacctttcggaggtcgtacgttaagtcgggacagtcgtaccgaccggttccggcccgttacccggccgtaaggtccccggtaccggggacgggtaaggggtccgtggggtaacggtgggtacgtaacgtaagtttaaggtacgttggggtaataggtaaggtaaggtaaaagtttaaaacgaaacggtagttaacgtgggttaaccgtaccggttaccgggaagggtaacccgggtaccgtacgttaacccgtaccgtacgttaaccgtaccggaaacgtaacgtaacctaaaccgtacgaaaccgttaacctaccttacgtttaccgttaaccgtaacgtaacgtaacgtaaccgtacggtacggtaaggacggaccggaacggtacggaacgtacggtacgtaagttacgtaaacggttggtaacggacggtacgaagaacgtccgaagtaccgtaacggtaccgggttaacggtaaacgtccggtttaacg

SEQ ID NO: 189273 - DNA, 542 bp, Homo sapiens
  misc_feature: GYAE6OF01C2CPW.22.86.H09.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (469)..(469): a, c, t, g, unknown or other
  misc_feature (469)..(469): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
tcagacatacgcgtcacgaccggtgctcgatttagtgctatagacttggggtttgggggctttgcctgggctctgctcctcctcagcctcctcactcagggcacaggatccgtggctcagtctgccctgactcagcctcgctcagtgtccggtctcctggacagtcagtcaccatctcctacactggaaccagcaagtgatgttggtgttaataactangtctctggtaccaacagcaccaggacaaaagccccagactcatactatttaatgctagtanaaataagccggcctcgacggggtccctgatcgtcttcnctcggctccaagtctggacaacgacgtcctccctcgacatctcgtgggccttcgagctagaaagctagaggctagtagttaattactgtctgcctntagtttcganacggcgacctacaacgtttggggtattcgggacggtagggacaanctgaccgtcaggtcacgaccgaaggcctcgccccttcggcctaatcgtccgttcccncccgttcncncgtacg

SEQ ID NO: 189274 - DNA, 836 bp, Homo sapiens
  misc_feature: GYAE6OF01EZTK3.22.86.H09.1.454.CMB.1.raw
  modified_base (148)..(148): a, c, t, g, unknown or other
  misc_feature (148)..(148): n is a, c, g, or t
  modified_base (598)..(598): a, c, t, g, unknown or other
  misc_feature (598)..(598): n is a, c, g, or t
  modified_base (737)..(737): a, c, t, g, unknown or other
  misc_feature (737)..(737): n is a, c, g, or t
  modified_base (787)..(787): a, c, t, g, unknown or other
  misc_feature (787)..(787): n is a, c, g, or t
tcagacatacgcgtcacgaccggtgctcgatttagtgctatagacttggggtttggggagaggagcccagcactagaagtcggcggtgtttccattcggtgatcagcactagaacacagagactcaccagtgggtagtttgggctggngtcgttgggttttcctgttgtcttacgttttaaggaggttcgtaccgtagtcgtacgaggtgcgaggtcgtgggtaggtcggtcgggtaggggggacgtcgtcggtaccaggtccggtggggtacgtcccgtaggtaacctcctccgttccgtggtacggcgtacggtccggtttacgtcggttaccttacccgtaccgttacgacggtttccgacgtttacgtggaccgtaagttccgaaccggttcgtccgggttaccctaccggacccggtaggggtcccggtaccggggacgggtaacgggtccgttagggggtaggtcggtacggtaattaacgttagtaggttacgtaagacgtaagtaaacggtaaataaacggtaatacggttagtaccggtaggtaccgtacgggttaaggtaacgggtcctaacttaaccaaccggttanaccgttagaaaacgtaccgtaaacaaacccgttaacgaaaccgtaaccggttctttacccttacgttactaaaacctaccggtaaataacgtaccggtcggtaacggtacggacgggacggtaactacgggaaacgttnttaaaagggttccttaacggtacggtaacgggttcgaggtaaccggtacnggttaaacccgattacggggtaaactacggggttaaacgtagttttacg

SEQ ID NO: 189275 - DNA, 700 bp, Homo sapiens
  misc_feature: GYAE6OF01BHXT5.22.86.H09.1.454.CMB.1.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (370)..(370): a, c, t, g, unknown or other
  misc_feature (370)..(370): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactntgtctcctggtaccaanagcaccaggacaaacgcccccagactcatctatttangctgtcaatacgcgccctgacggggtccctagatcgcttctctgctacagtcngcaacncggcctcctgacacgtctcgtcggcctcgaggtctagaagntaggacggtctgtaatttacttacgtcgtacttgaccttacgttacgtttcgacgtacgggtacccgtacccgtttaacgtaccgggttttggggttaccggttaccggggtacggggtaaacccgggtaacccgaaacggtccgttaccgggtacccgttacccggtaacgggttaccccgaaaccggtacccccggtaaacgggtcccggttaacccccgggtcccccgggttaacccggttacccgttaccccggtttaccccgtttcccccgggtttaacccccccttaccccgttccccgttaacccggtacccggttaccccgg

SEQ ID NO: 189276 - DNA, 724 bp, Homo sapiens
  misc_feature: GYAE6OF01D24YE.22.86.H09.1.454.CMB.1.raw
  modified_base (193)..(193): a, c, t, g, unknown or other
  misc_feature (193)..(193): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
tcagacatacgcgtcacgaccggtgctcgatttagtgctatagacttgggtttggggagaggagcccaacactagaagtcggcggtgtttccattcgatgatcagcactgaacacagaggactcaccatggagttttggctgagcttgggttttcctcgttgcttctttttaagaggtgtccagtgtcaggtncagcgtggtggagtcgtgggggagcgtggtccagccgtgggacgtccctgagctctctgngcagcgtntgacttcaccttnagtcgcttagtcggcagtgctacgtcggcctccggcgagggtccgtcccggggaggacggggtctaggggagggttggggtacgactaaagtttataggttgggtaactaggtaagttaagggtaaaacgttaaagtaaacgtacgttagtcgggtacggtaacccgttccgggtaagggaccgggtaccctagttacccaaccgtacttaccgtacccgtaacgtaacgaaacctaaccgttacccgaaaagtaacccttacttccgtttaccgttttaaaccaaccgttaaatacgggtaaacctcggttaaccgtagggaaccgggtaacggggaccgaacgggtacccggaacggttaccgttaggtaacgttacgttacggcggttaggacggtaaagtgtaacctacggtataacgtcggaaacggtttacgggaaacgtttcg

SEQ ID NO: 189277 - DNA, 909 bp, Homo sapiens
  misc_feature: GYAE6OF01B4ABZ.22.86.H09.1.454.CMB.1.raw
  modified_base (292)..(292): a, c, t, g, unknown or other
  misc_feature (292)..(292): n is a, c, g, or t
tcagacatacgcgtcacgaccggtgctcgatttagtgctatagacttgggtttggggagaggacgcccagcactagaagtcggcggtgtttccattcggtgatcagcactgaacacagaggactcaccatggagtttgggctgagctgggttttccttgttgcgtattataaaaggtgtccagtgtcgaggtgcagctgggtggcgtcgtgggggagcgttggtcaagcctgggagggtccctggacgacctcgtccgtgtcgcacgtccttcgtcggtactttccccgttnaggttcgtaacctttccgtacagttaggtaacttcgggactcccggaccgacgggtccgtaccggaagggggacggggtaccgttggggtaaggttcggggttttacaagttaccgttagttttagggttacgggttaacggtttaggtttaaagttttttaaacgtaccggaacgttacggtaacccgttaccggttaggttaacgggtaacggggtaacccggttactttaccgaaccccttaacgtttacccgttacccgggaaacggggaaaccccgtaaccgggtaaaccccgtaaaacggttaaacccgttacccgtaaccggtttaagggtttaaaccctttccggttaaacggaacccgttaaaaaggtaccgggaaaacccggttacggtaacccggtagggttaaccgggacggtttaaccgggaacgggtaacccggacccggttacgggttagtttaaaccgtttgtttaacgggacgggttaagggtaaaggtaaccggggtacggttcccggggattaacgggtttcgtcggtttacccggttttaccccgggacccgggttacggggaccccgtaacggggttaccccggtggttacccccg

SEQ ID NO: 189278 - DNA, 732 bp, Homo sapiens
  misc_feature: GYAE6OF01EP3ZS.22.86.H09.1.454.CMB.1.raw
  modified_base (242)..(242): a, c, t, g, unknown or other
  misc_feature (242)..(242): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctccgtggacagtcagtcaccatctcctacactggaaccagcagtgagttggttggttagttaataactatgtctccgtagtaccaacncgccaccgaggaccaaaccgccccagacctcactctatttangctntacaagtacggccggtcctcgacgggtcctgactcgtcttctcgtcggctacgtaagtcgtacggacctaaccgccggtacccttcccgtacgtacctacgttccgtccggtcgggtccctaccggtaggtaccgtaaggaaacgtacgtacggacggttacgtaacgttaatttacgttaacgtcgtacgtcgtacccgttacgttacgtttcggaccgtacgggtacccttaccgttaccggttacgggtttaccggggtcggttaccgggggacgggtaacgggtaacccgtaacgggttccggtaccgtacccggttccgtaagggtacccgacccggtaccggtaaccgggtcccgttaccccgggtccccgtaccggtaccctacccgttacccgttaccccggtaccccttaccccgtacccgtcgtccggttaccg

SEQ ID NO: 189279 - DNA, 809 bp, Homo sapiens
  misc_feature: GYAE6OF01BY0UC.22.86.H09.1.454.CMB.1.raw
  modified_base (409)..(409): a, c, t, g, unknown or other
  misc_feature (409)..(409): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctggttttcctcgttgctcttttaagagtgtccagtgtcaggtgcagctggtgacgtcggtgggggagcgtcggtccagccgtggggacgtccctgacgtacctccgtcctgtcgcgacgtccggtcgtggtactttccgtaacccgtttgaaggtggtacttagtggactatcggactacgtcggtccctcccggaccgacgggtccggtacccggggacggtaacgggggcgttagggaggtttgggtacggacttaaagttnttacgttaggtatacgggtaagttaagggtaaaagttaaagtaaaagtaccgttaaggttcgggtaacggtaacccgttacccgggtagggaaaccggggtcccgttaaacgttacccctaaaccgtacgttaccccgtaacccgtaaagaaaccgtaaacctaaacccgtaacccgaaacgtaacctaaccgtttccttaacgtttaccctaaaccgtaaacgtcgaaaacgccgttaaccgtaagggaacgggtacggaaccggaacggtaccggaaccggtaccgttaagttacggtttaaccgtacggtttacgggtcgtaacgggtaagaacggtaacgtaaccggtaaccgttaaggtaaccggaacgggttaaaaccggttaacgtttaccgg

SEQ ID NO: 189280 - DNA, 839 bp, Homo sapiens
  misc_feature: GYAE6OF01AN32B.22.86.H09.1.454.CMB.1.raw
tcagacatacgcgtcacgaccggtgctcgatttagtgctatagacttggggtttgggggggaggcgtggtccagcctgggaggtccctgagactctcctgtgcagcgtctggattcaccttcagtggctatggcatgcactggcctccgccgaggccgtccggggcgaaggggcgtgggaggtggggtggctaagttatagtggtatggagtaggaagtaataaagactagtgtaggactccggtggaacgggccgacttccactactcgtaccagacgacaacctaccgaacgaacacttcttcgtttacactaaagtacgaacacgcctggaggaggacgacggacgacggagagtgtattacgtgtcggacgagagtacgtaccgaactagtacggtaaggtaacgggtaagttcgttttacgacgttccggtacgggtacggggaccgtaaacgggtacgtaccggttcggtacccgtccgttaccgttccgttacccgtacccgtaccccgtacccggaaacccgaccccgggggttaaccccctacgggtttccccccggtttccccccgtttacccccccgggtccgggtacccccggtccccccgtttacgggacccccggttaaccgggtaaccgggtaccccggtaccccgtaaccccgggtaaccgggtaccgaacccggacccgtaaccggccccgggtacccggggcccggttacgggccggttaacccggtccgggttaccggtaaacccggtaccgttaacccggttaccctttacccgggacccggtttacggtaccgttccgggtcggtaacggggccgggg

SEQ ID NO: 189281 - DNA, 888 bp, Homo sapiens
  misc_feature: GYAE6OF01DGML6.22.86.H09.1.454.CMB.1.raw
  modified_base (770)..(770): a, c, t, g, unknown or other
  misc_feature (770)..(770): n is a, c, g, or t
tcagacatacgcgtcacgaccggtgctcgatttagtgctatagacttggggtttggggggaggcgtggtccagcctgggaggtccctgagactctcctgtgcagcgtctggattcaccttcagtggctatggcatgcacgtggcctcccgccgaggcgtccggggacgaagggggctgggaggtggggtaggactaattatagtagggtatggaagtagggtaaagtaaaagtaaaacgtacgttagtaggtacggaccgttaccggtaggaacgggtccctaattaccaacctacttccgtaccgaaggaacaacctaaccgtacccgaaaagtaacctaccttacgttacgtttaccaaccgtaaaatacgaaactacgtaccgttaggaacgggaacgggaccggtaacggaaccgacgggtacgtaaggttacgtttaactttaccggtaggtacggaacggtaacggtaacgtaacgtaccggaaacgtaacgttaaccgggtaaaaccggttaaacgggggttaaacttttacgttttacgaacgtttccgggtacgggttaccgggggaaaccggtaaacgggtaccctaacgggttccgggtaacccgttacccgttcttaccgttccgaacccgtccccgtaaacccgaaccgggtaaacccggcccgttaacgttcccgggttaccccttccccggcggtacccgtttaccgtccggaacccgtccggaaggtcccgacccgtaacccgtcggacgaccnccggacgaccgggtccccggtacggcggtacccgtccggtaaccgttacgggaacccggtaaacgttaccctaccggttaccgtacgttacgttaggtacggtcgtcggggaccgggg

SEQ ID NO: 189282 - DNA, 747 bp, Homo sapiens
  misc_feature: GYAE6OF01DLK6B.22.86.H09.1.454.CMB.1.raw
  modified_base (617)..(617): a, c, t, g, unknown or other
  misc_feature (617)..(617): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagtcgttgggttttcctcgttgtcttacgttttaaggaggttgtcctagtgtcgaggtagcgagcgtgggtggtacgtcgggtggggggagccggttggtccacggtccggtgggtacggtccctaggacgtaccttccgtccgtggtcgcgtacgtcgttcgtaggtaccttccgtacccgttcgaagggttcgactagtcggctagtcgacgtccgtcggcccgtccggccggtacggtaccggaccgggtacgggacggggtcgtaggggtaggtttcgggagtaactttaaagttcgtaggttaggtagtaggtaacggtaaggtaaaagttaaacgtaaacgtcgttaggtaggttaccggtaaacgttccgggtaacggacggtaaccgtactaccgtacgtactaccgtacgacgtaacaaccctaacaacctacgtaaccttcttacgttacgttactaaccgtaanacgaactaccgacgtggaagtacggacgaacggcctacgggtacgttacgtaggttaccgtagtcgggtacgaaggaagtaacgtcgtaaccgagtaacgtaacggttaacggtaggttaacggtttacg

SEQ ID NO: 189283 - DNA, 760 bp, Homo sapiens
  misc_feature: GYAE6OF01CTYLA.22.86.H09.1.454.CMB.1.raw
  modified_base (299)..(299): a, c, t, g, unknown or other
  misc_feature (299)..(299): n is a, c, g, or t
  modified_base (661)..(661): a, c, t, g, unknown or other
  misc_feature (661)..(661): n is a, c, g, or t
  modified_base (684)..(684): a, c, t, g, unknown or other
  misc_feature (684)..(684): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagtcgtgggttttcctcgttgcttcttttaagaggttgtccagtgtcgaggtgcgaggtcgtggtggagtcggtgggggagcgtcggtcaggtccgtgggacgtcctgacgctctctgtgcagtcgtagtgtacgttccacgttcgagtcggtactgnggtacctagtcggactcgtcggcctccggcgaggcccgtacggggtacgacggggtcgtagggtagggtcggacggtaactaagtttagtagttaaggtagttacggtaaggtaaaggttaaaagaaaggttaaaccgttagttaacggtacggtaaccggttaacctaacgggttcggaacggtaccgacttacccgtaacgtaacaccggttaaccaacgggtaaccgtaaccttaaccccgaacgtaacccgtaacccttaactttacgttaacccgtttacgtaactaacgtaacgaacgttaacgcccgttaaagggacgaaccggggacgaaccggtcgaaaccggtcgttaacgngtttaacggccggtttaaacggnggtaacggtaacggtacgtaaaccgtcgtaaccgttaacgggtaaacggtaacgggttaaacggttacggtttacg

SEQ ID NO: 189284 - DNA, 937 bp, Homo sapiens
  misc_feature: GYAE6OF01BJTNH.22.86.H09.1.454.CMB.1.raw
  modified_base (301)..(301): a, c, t, g, unknown or other
  misc_feature (301)..(301): n is a, c, g, or t
tcagacatacgcgtcacgaccggtgctcgatttagtgctatagacttgggtttgggggctttgcctgggctctgctcctcctcagcctcctcactcagggcacaggatccgtgggctcagtctgccctgactcagcctcgctcagtcgtccgggtctcctggacagtcagtcaccatcctctacactggaaccagcagtgattggttggtagtttaataacttagtcgttccttccgtacggtaacccaacgacgacccaccgaaggtaccaaaccgcccccaagacctcatctaatttangctagtacaaatacggcccgacccgtcggacgggtccctagactccgtcgttactccgtagccttaacgtaacgtcgtaccggacccaaacgtaccccggtccctaccccgttacgaaccctacttcccggtgtcccggggtaccgtacccgtaacggggtaccttaaccgggaaaggttacgtacgggtaccgggtacctttaagtttaacgttttttacgtttacccccgtacgggtaacccccgttaacgtttacccccggtaatttacccgggaaaaccctaacccgggtaaccgggttacccgggtttcgggggttacccgttaacccgggtttagggggtttaaacccgttcccggggggaacgggttaaaaccccgggggtaccttaaaaccgggtccccgtttaacgggggttaaccccccgtttaccggttaaaccccggggacgtaaacccccccgggggtaccccggttaaaccgggttacccccggtttccccccgggttaaaccccccccgggttttaccggacccccggtttaaccgtttaccccccccgggtttacccccttaccccccccgggttaacccccgtttaccctaacccccgggtaacggtttaacccccggg

SEQ ID NO: 189285 - DNA, 894 bp, Homo sapiens
  misc_feature: GYAE6OF01B0QEH.22.86.H09.1.454.CMB.1.raw
tcagacatacgcgtcacgaccggtgctcgatttagtgctatagacttgggtttgggggagaggagctcagcactagaagtcggcggtgtttccattcggtgatcagcactgaacacagaggactcaccagtggtagtttgggctgagtcgttgggttttcctcggttgtcttacgttttaaggaggttcgtccaggttggtacagggtgcaggtcgttgggtgggtacggttcgggtgggggggacggtccggttcggggtcccaacgggtcccggttaggggggtaccggttccccgtaggaacggtaccttccgttccgttggtcgcgtacggtccggttcgttagggtactttacccgtaccgtttacggtaacggttcggtacgttaaggtcgggactaacggttcgggacctaccgggtccgggtcccgtacccggtccgaccggggtcccggtaccggggacggtaaacgggggtccgtaggggtagggttcggggtagtaacgttaaaggtttactagggtacggtaagtaggtaagtaaacgggtaaaattaaacgtaaaggtacgtttaacggtaggtaccggtaaccggttacgggtaagggaacccgggtaccttactaccgaaccgtactaccgtacgaaaggaccctaaccaaccgtaacgaaactacttacctacggtttacttactaacgtaataccggtaactaccgtcgtaaggacgggtacgggtaccggacggtaaccggtacggtaacggttacgttaggtttaaaccgttacgggtagtaacccggggtacgggaaacgttaacgggtaacccggttaccgtaaacggtaacgggttaaaccgggtaaacggggtttaaacgggtttaaccgg

SEQ ID NO: 189286 - DNA, 815 bp, Homo sapiens
  misc_feature: GYAE6OF01C9I1M.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtcgtccggtctcctggacagtcagtcacatctcctacactggaaccagcagtgattggttaggtggttaataacgttatcgttcctaccgtaggtaacccaacgacgaccaacccgaggaccaaaaccgcccccaagacctacactactatttatgctgtacaacgtaacgccggtccctagacggtacgtcctactctacgtccgtactttctacgacggtacctaccgtaacgttcgtacggacctaaaccgtacccggtaccccttacccgtaaacctacgttccgttacgtcgggtaccttaccgttagtttacggaacgggtacgtacgttaccttaccgtttaattacgtacgtactttacgtttaacctttaaacgttaccggtacccgtacctaaccgtttccgttaccgggttttcgggttttaccgggacgggtaaccgggtaccgtaaccggttacggtaccggtaccccgttccggttaccgggtacctaacccgggtacccggtaacggtccccgttacccggtacccccccgttcgggttacccctacccgtttccccggtttaccccggtttcccccccggtacccccgtttccccgtaaccccggtaccgggttacccgtttaccgttacgggtcccgttacggggtacccgggg

SEQ ID NO: 189287 - DNA, 783 bp, Homo sapiens
  misc_feature: GYAE6OF01CZAHE.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccagtggtagtttcgggctgagtcgttggttttcctcgttagcttacttttaagaggttcgtcctagtgtcaggtcgcagtcgtgggtggtagtcggtgggggaggcgtaggtccgacggtcccgtaggggtaccggtcccgtggaacgtccttcgtccgtagtcgacgtacggtcgttcgtacggtaactttccctaccgttcgaggttcgacttaggcgactagtcgacgtaccgtcggcctacccggacggcgtcccggtcgggacggtacgggtgtagggtacgggtcggtacggaacttagttaagttacgtggttacgtaggaagttaaggtaaaagttaaacgtaagtacgttaggttcggacggttaccggtaccggtagggaaccgtacccgttactacccgaaccgttacgtccgtaaacccgacggaaacgtaaccctaaaccgtacgtaaaccggtccttaccgttaccgttttaactacccgaactaaagttaccgaacccgacgtcggtaaggacgacgggaacggaaccgtacggacggtacttaaggttagttacccgttggacggtacgggaaactacggtaacgtacccgtagtaaccggtacgttaaccgggtaccgttaaaaggggttcgttttacgg

SEQ ID NO: 189288 - DNA, 771 bp, Homo sapiens
  misc_feature: GYAE6OF01CLG38.22.86.H09.1.454.CMB.1.raw
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggaggtccctgagcctctcctgncagcgtctggattccaccttnagtggctagtggcatcggctacgtggcctcccggccgaggccgtccggggacacgggggtcctgggacgggttggggtaggtactaaagtttacgtagttacggggttatagggtaagttaaggggtaaaaagtaaaacgttaaaacggtcttaaaggttcgggtaacgggtaaccttcccggggtaagggaaacggggtccctaacgtttacccgaaacccgttaagtacccctaccggtaaacggtaaaccgaaaccctaaacccttaacccgaaaacgtaaaccctaccgtttacccgtttagttttaaccctaaccgtaaaacgttacggaaaccgacgtacccgtaggaacgggtaacgggaaccggaaggacccgtaacgggaccttaagggttacgttaacgttaaccggtggtaggacccggtaaaggtaacgaacgttaccgaaaccgtaagtaccgggtaaaaccgttaacggggtaaacgtttacg

SEQ ID NO: 189289 - DNA, 658 bp, Homo sapiens
  misc_feature: GYAE6OF01AWQMY.22.86.H09.1.454.CMB.1.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
tcagacatacgcgtcacgaccggtgctcgatttagtgctatagacttgggtttgggggggaggcgtggtccagcctgggaggtccctgagactctcctgtgcagcgtctggattcacctttcagtggctatggcatgcactggctccgcaggctccgggcaaggggctggaggtgggtggcaattatatggtatgatggaaagtaataaagacttatgtggaccttccggtggaacgggccgtattccaccatctccaganacacacaagacactctgttcacaaatgaacncgcctagaggacggacgacggacacggagtagttagttagttactggtcggacggagacgatacgacagtaagaacggtaacggtaacgttcttttagacttcggtcgtacggggaccgaaacgggactacgtacggtccgtccgttccttacttaccgacgtccccgtacccgaaccggtaacggacccgtacgttcccggttccccgttccccgtcggcccgtcccgtcgaccctccgaacggaccgtaccgaccgtaccgacgtacgccgacgacggcccggtacccggtcgtaccgtcgtccgtacggacgtaaccggtaccttaccgtaccgtacccggtacgtagtcgtcgtggtacggg

SEQ ID NO: 189290 - DNA, 814 bp, Homo sapiens
  misc_feature: GYAE6OF01EIM1E.22.86.H09.1.454.CMB.1.raw
  modified_base (208)..(208): a, c, t, g, unknown or other
  misc_feature (208)..(208): n is a, c, g, or t
  modified_base (349)..(349): a, c, t, g, unknown or other
  misc_feature (349)..(349): n is a, c, g, or t
tcagacatacgcgtcacgaccggtgctcgatttagtgctatagacttgggtttgggggctttgcctgggctctgctcctcctcagcctcctcactcgagggcacaggactccgtgggctcagtctcgccctgactcacgtcctcgctcagtcggtccggtctccgtggacagtcacgtcacctacttcctacctacacgtcggaaccngcctagtgagttggttggttagttaataacgtatcgttcctaccgtacgtaaccaagacgccaaccgaggaccaaccgccccagacctacacttctattgtcgtcgtatacgaaacgtcggccgccgtacggtcgggtccngtactccgtcttcgtcgtcgtactacgtacgtcgtacgaccaaccgtccgtcctaccacgtaccgtacgtccgttcggcggtacccgtacgtacggtagttaaacggagtcggtagtacccggtaacttaggtttaaccttaacgtttcccgtcggttaccgttaccgttacctttacgtttacggtaccggtacccggtaccgtaccccggtttacgtttaacccgggttcggggtttacgggttacccggggttaccgggggacccggaaaccgggttaacctccggggttcccgtaaacccgggttcccgtaaccggggtaaccgtaacccgtaccccgggaccggtaccccgggttcccggttaacccccggtccccggtttaccggttacccctttaccgttcccccggttaaccccgtcccccctaaccgtttacccgcccgggtaactttacccgggg

SEQ ID NO: 189291 - DNA, 760 bp, Homo sapiens
  misc_feature: GYAE6OF01EFUHE.22.86.H09.1.454.CMB.1.raw
  modified_base (213)..(213): a, c, t, g, unknown or other
  misc_feature (213)..(213): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggngcgtgtccagccgtgggagtccctgacgactctcctgtgcagcgtctggacttccaccgttcagtgctagtggcatgccacgtcggcctcccggaccgacgggccgtccgggcgaaggggtctgggaggtgggtggactaagttagtagttggtataggagtagggtaaaagttaagtaaacgtactaagttggttaacggaccgtttaccggtaagggaaccgggtacccggtactttacccgaccgtacttaccgtacccgaagtaaccgaacaaacccgtacccgaaacgtaacctaccgtttacttaccgtttaccgtaaaccctaaagttaccgaaacgtacccggtacgttaacggggaacgggtaacgggaccggtaaacgggaacccggaacgggtaccgttaacgggttaacggttttaaccgtttaacgggttcggttacgggaacgggtacggtaaacgggtaaccttacccggtaaacgtaacccggttaaacggtaaacccggggtttaaacgggtaaaaccggtttttccggg

SEQ ID NO: 189292 - DNA, 645 bp, Homo sapiens
  misc_feature: GYAE6OF01ASVXX.22.86.H09.1.454.CMB.1.raw
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggaggtccctggacgactctcctgtgcagtcgtctggatttccacctttcaggtggctagtggcagtcgcacgtggctccgcaggccgtccgggcgaaggggctcgggaggtggtctcgagtcgttggttacggtgggtgggttgaaggtttgggtacggcctaacgtactaccgtaacggtcaacggtacccttccgggtaggaacggggtcccggttaccacccgtacttcctaccgacgtaacgactaacgttcccaaaagaacctaccctaatactatcgaacaatacgaacacgtacctagacggaacgaccggaaacgtaccgaaccgggtacccgttaataacccgtacgtcggtacggcgggaaacggggtcgtacgtacgtacggacgacggcgtacgttaccg

SEQ ID NO: 189293 - DNA, 811 bp, Homo sapiens
  misc_feature: GYAE6OF01BJYU4.22.86.H09.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
tcagacatacgcgtcacgaccggtgctcgatttagtgctatagacttgggtttggggctttgcctgggctctgctcctcctcagcctcctcactcaggcacaggactccgtgggcctcagtctcgccctgactcacgcctcgctcaggtcgtccggtctccgtggacagtcacgtccacctatcctacctacacgtacggaaccngctagtgtacgttggttggtagtaataactntcgtctcctacgtaaccacgcgccaccgagaccaacgccccgagaccgtcagtacttagttactgtacgtcgtactaaacgtaccgtcccggtacccgtcggtaaccggggttcccctagtacccgttcggtacctttccgtccgtccggtacccgttaaccgtacggttccggaccgtaacctaaacccggtccggtaccccttcccggacgttaccctaccggttccgtaccggtaccgtccttacccggaggtcctaacgggtagtcggttacggacggttacgtacgttaagttttaccgtcgtacgtcgtcgttaccgtcgtttaacgttcgaccggtaccggtcctacccgtagtaccgggtttcgggtcgggtacccgggtcgggtaaacccgggtacgtaccgttacggtacccgtacccgggttactacccggggtacctaacccgggtacccccgtaacgggttccccgtaacccccgggttccccggtacgttaccccgttcgttaccccgtttacccccgttaccccgtcccccgtaaccgttcccggtacccggtttaccgg

SEQ ID NO: 189294 - DNA, 794 bp, Homo sapiens
  misc_feature: GYAE6OF01EVQUY.22.86.H09.1.454.CMB.1.raw
  modified_base (175)..(175): a, c, t, g, unknown or other
  misc_feature (175)..(175): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcgttttaagnggtgtccagtgtcaggtgcagcgtgggtggaggtcggtggggggaggcgtggtccgaggtccgtggggtacggtccctggacgtacctcctccgtgtgcgagtcgtgtgattcctacttcaggtgctagtcgcagtcgctacgtcggcccgtcccgaccggacgggtccggtacccggggaggaacgggggtccgtaggggtagggttcggggtcggtaacttaaggttaagttaggttaggttagtagggaaaggttaaggtaaaaggttaaaacgttaaagtacgttaagttcgggtaacggtaccggttaccgggtaagggtaacccggggtaccttaacgttacccaccgtaacccttccgaaccggtaacgaacgaaccgtaacccgtaacccgaaactaacccgttacctttccgttaacgtttaccctaacctaaacgtaccgtaaaccgacgtacccggtaaggtaacgggaccggtaaccggaacggacccggaacggtacgttaacgttacgttaacgttacggtacggtaggaacggtaacggaaacgtcgtaaacgtaaccggtaggttaaccggtaaacggggttaaagggttacgtttaacccgg

SEQ ID NO: 189295 - DNA, 699 bp, Homo sapiens
  misc_feature: GYAE6OF01D89TY.22.86.H09.1.454.CMB.1.raw
tcagacatacgcgtcacgaccggtgctcgatttagtgctatagacttgggttgggggctttgcctgggctctgctcctcctcagcctcctcactcaggcacaggtactccgtggctcagtctcgcctgactcacgcctcgctcagtcgtccggtctccgtggactagtcacgtcactactctcctactacgtcggaaccagcctaaggtcgtacgttggttggtaggttaactaacgttgtcgtccgtacgttaccggaaccaagcgtaccaccggacggacaaaccgccccagccgtactacgtctacttatcggtcctaggtaactaacgtaccggtccggtaacccgtcggtaacggggtccctagtaccgtcggttaccttcgtccgttagccctcgtaacggtcctacgggacctaacgccggtacctccgacgactgttccgtcggcgtaccgtcgacggtactaggaaactggtagtacgtcttacggttacttacgtacgttcgtacctggtccttacgtgtttacgacggtacgggtacctacgttcggtaacgggtttcgggtacgtacgggacgtacggtacgtacgtccgtaacgtccgtacgtacggaccgtacggtaccgacgtccgtaccggaccccgtcgtaccgtcgtaccgtcccgtaaccctacctccgttcgcgtaccg

SEQ ID NO: 189296 - DNA, 785 bp, Homo sapiens
  misc_feature: GYAE6OF01C6YQR.22.86.H09.1.454.CMB.1.raw
tcagacatacgcgtcacgaccggtgctcgatttagtgctatagacttgggtttggggagaggagcccagcactagaagtcggcggtgttccattcggtgatcagcactgaacacaagaggtactcaccatggtagtttgggctgagtcgttcgggttttcctcggttgtctttacgttttaaggacggttcgttccgtaggtcgttacgaggtgccgtaggcggttgggtgggacggttcgggtgggggggtacggtccggttcggtaccgacggtccgggtacggggtccggttcccggtaggaaccgtccgttcgttccggttagtggaccgtacggttcgttcgttacggtacttccgtaccgtttacggcgggttcggtacttacggtcggtactacggtcgccttacggccggtccctccggcggtaccggtccggtaccggggcgtagggtccgtaggggcgggtcggtacgtacttagttacgtaggttgtagtacgtaggtacgaaattaagaagtgtaggtcgtacggcttaacgggacgggtacgtaccttagtccaacgtcgtaccgtacgaacgtaccgaactaaccacgaaccttaccgtcttacgtttaccttacaactaacgtacaaccgtacgcgtaggggtaccgtacgggacgtaaccggcggtaccgtaacgtggttaaccgttagtcgtacgggttggaacggttaacggtgaaccgtacggttaaccgtaggaaccggtttaacgggacgtttaacgttacggg

SEQ ID NO: 189297 - DNA, 815 bp, Homo sapiens
  misc_feature: GYAE6OF01C6NVZ.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagtcgttgggttttcctcggttagtcttacgtttttaaggaggtgtccgaggttgtccgagggtgcgaggtcgtgggtgggtacggtcgggtgggggggacggtccggttcgggtacccgaggcccggttgggggtaccggttccccgtggacggtaccttccgtccgtggtcgacgtacggtccgttcgtaggttactttccgtaccgtttacgaggttcgggtaccttaggtcgggtactacgtcgacccgtacggttccgggaccctccccggccggacgggtcccgggtaccggggacggggtaacgggtccgtaggggacgggttcgggtacgtaacttaagtttacgtggttaacggggtatacgggtaaaggttaaagtaaaacggttaaagtaaacgttagtcggttagggtaccggttaaccggttccgggaacgggtaccgggtaccttactacccgtaccgtaacgttcccaaccgagtaaaccgaacctaacccgtacgaaacgtaaccttaccgtttcttaaccggtttacaaaccgtacgtactaaccggacgtccggtaggacggacgggtccgaacggtacggaccgtgtaagtccgttagtacgtggacgagagacgtacacgtacttagggacgtaaaccggtgggttcttacgg

SEQ ID NO: 189298 - DNA, 164 bp, Homo sapiens
  misc_feature: GYAE6OF01DHAYU.22.86.H09.1.454.CMB.1.raw
  modified_base (156)..(164): a, c, t, g, unknown or other
  misc_feature (156)..(164): n is a, c, g, or t
tcagacatacgcgtcacgaccggtgctcgatttagtgctatagacttgggttttgggggaagaggaagactgacggtcctagcacagcggccctgggctgcctggtcaaggactacttcacgcgtatgtctgagcgggctggcaaggcgcagtagnnnnnnnnn

SEQ ID NO: 189299 - DNA, 747 bp, Homo sapiens
  misc_feature: GYAE6OF01AZWUN.22.86.H09.1.454.CMB.1.raw
  modified_base (691)..(691): a, c, t, g, unknown or other
  misc_feature (691)..(691): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggtttcctcgttgctcttttaagaggtgtccagtgtcaggtgcagcgtggtggagtcgtgggggaggcgtggtccagcctggggaggtccctgacgactcgtcctgtgcagcgtctggattcacctttcgagtcggctagtggactagtcgaccacgttcgggaccttcccggacccgtaacgggtcccgttaccccggggggacaaagggggggccttaggggtaccgggtacgggggtttgggacctaaaagttttggtaacgttggggtttaatggtaaacggttaggtaaaggttaaaagtaaaacgtacgttaaagtggttagggaacccgttcggttagggaacggggcccgtatttaccgaaccctagttaccttacccgaacggtacgaaccctaaaccgtaccctaaaacgaaccgtaaccttaccgttacggttttacccaacccttaaaagtacgtaaaccaacggtcccgtaagggacggtaacggaccgggtaagacccggtaaggccgtaagggttacgtaagttaccgngttacgcggtaacgacgtaagtcgtaacgtagaggtaaccgtagggaaagtttccg

SEQ ID NO: 189300 - DNA, 915 bp, Homo sapiens
  misc_feature: GYAE6OF01D6I7P.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgttgggttttcctcgttgcttcttttaagaggtgtccagtgtcgaggtgcagtcgtggtggagtcggtgggggacggcgtgtccgagccgtgggacgtccctagacgtactctcgtgtcgcgacgtcgtctggtacttccgtaccttcgaggttcggctagtcggctaagtcgctacgtcgggcctccggccgaggtccgtacccgggacggtaacgggggtctagggtacgggtgggtcggtactaaagttaagtagtagggtaataggtaaggtaagggtaaaagtaaaacgttaaaggtacgttaaggttacggtacggaacccgttacgggttaacgggaaacggggtaccccgttaagttaccccgtaaccgtaacgttacccttaaacccggaaacggtaacccgtaaaaccgaaacccgttaaacccgaaaacggttaaacccttacccgttttaccggttaaccgttttttaacccgaaaccgttaaaaccggttaccggaaaaaccggttacccgggtaaccggttaacgggaaacggggttaaaccggggacggaaaacccggggttacccgtaaacccgggggtacgttaaaccgggtttacgggttttaaaccctttaccggggtaaggggtttaaccgggaacggttaaaacgggaacccggtttaaacggttaaacccgggtaacttaaacggggttaaacccggggtttaaacccgggttaaaaacggggggttaaacccgttttttaacccggg

SEQ ID NO: 189301 - DNA, 927 bp, Homo sapiens
  misc_feature: GYAE6OF01B4ATK.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccagtggtagtttgggctgagtcgttgggttttcctcgttgtcttacgtttttaaggaggttgtcctaggttgtcagggttcgacaggtcgttgggtagggtaggtccgggtggggggacggtccggtcggtaccgacgggtccggtagggggtaccggttccccgtaggaacgtacccttccttccgtggtcgaccgacggtccggttctcgggtaacttttccctaccgttacggacggttcggacttacgtggactacggtcgaccgtacggtcgggtccctcccggaccgtaccgggtcccggtacccggggacggtaaccgggggttccggtaggggttaacgggttcgggggttacgtaaccgtttaaaagtttacggttaacggttaagggttagttacgggtaaacggttaaaggttaaaaacgtaaagttaaaaccggtacgttagggttacgggttacggtaacccgttcggggaacgggaaccgggtacccttacttacccgtacctacgtccgtaaacggaacgtaaccggtaacctaacccgtaacgtaaacgtaacgtttaacccttttccgttacgtttaaccctaacgtaacgtaacgaacgtacccggtacggaggtaacgggaccggtaccggaaccggtaccggtaccggtagttaaccggttaacgtacggttttacgggtacgtagggtaaccggaacgttaacgggttaccacgggttaaaccctaacgggttaaacccgggttaaacgggtttaacccggtaaaggtttttaccccggg

SEQ ID NO: 189302 - DNA, 853 bp, Homo sapiens
  misc_feature: GYAE6OF01AU3N7.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagttgggctgagctgggttttcctcgtgtctctttaagagtgtccagtgtcaggtgcagctggtggagtcggtggggaggcgtggtccaggccgtggggacgggttccctaggacgtaccgtcgttccctagggtcgtccaacggtccggtccttacggggtactttaccgtaccccgttttacgaacggtttcgggtaccgtttaaggttcggggtaccttaacggttcggtaccgttaccgttccgggtcccgttaccccggtaccccggaaccggggttcccgggttaccccgggggaacccggtaaacggggggtccgttttacgggggacgggtttaccggggggtacgggtaccgtttaaaagttccgtttaaaggttcggggtttaagtagtaagggttaagggtaaagttaaaacgttaaaacggtagtaaagttcgggtacgggttaaaccttcgggttaacgggtaacggtcccgtaattacccggaacttacgtccctaacgtaggaactaaacctaacgacccaaaggtaaccctactttacgttccgttaacctacctaaaagtcgaaaccctagtacccgtagacgggtaacgtacggaaccgtaaccggacggtagtacggtaattacggtttaagtcggtagggacgtaggaacccgtaggtaactaccgttaggtaccgaagggttaaaccgggtaggttacccg

SEQ ID NO: 189303 - DNA, 945 bp, Homo sapiens
  misc_feature: GYAE6OF01CUBNE.22.86.H09.1.454.CMB.1.raw
  modified_base (930)..(930): a, c, t, g, unknown or other
  misc_feature (930)..(930): n is a, c, g, or t
tcagacatacgcgtcacgaccggtgctcgatttagtgctatagacttgggtttggtggaggcgtggtccagcctgggaggtccctgagactctcctgtgcagcgtcgtggtacttccaccttcgagtggctagtggcatgcacgtggcctcccgccgacggccgtccgggacggaacggggtcgtagggagggttggggtcggacttaaagtttaagtagttagggttagtaggtaaggttaagggaaaagttaaaataaaacggtactttaggtcggtaccgggtaaccgttaccgggtaagggaaaccggggtacctacttacccaacctcttacccgaccgaaagaacgtaaaccaacctaaaccgaaaacgtaaccttacctttcgtttaaccgttaccaactaaaacgtccgaaaccgtacggtaccgtaaggaacgggacgggtaccgggaacggaaccgtacgggtacgtaaggtttacgtttaacgttacggtgggtacggaacgtaaggacgttaacgaccgtaacgtacggtaacggtaaacgggttaaacgggtaacgttttctttacggtaacgttccggtacggggtaaccgggtaaccgtaacggtaacgttccggtacggttacccgttcccgtttccgttaccgtcccgtacccggtaaccccctaacggggaaccccggtaccgggtacccctttacccggtttccccggttaccccccggttcccgttccgggcccccgtacccgttccggtaaccccggtaaccgaccggggtacccctacccggtacccggaaccgttaacggccccgacggtaacccggcccgggttccccgggcttccgggggtctcccgggttaagtttacccggaacgtaaccgtttcccttaccggacctaaggttccgtttacncgggtacggtacggg

SEQ ID NO: 189304 - DNA, 791 bp, Homo sapiens
  misc_feature: GYAE6OF01DPJX1.22.86.H09.1.454.CMB.1.raw
  modified_base (203)..(203): a, c, t, g, unknown or other
  misc_feature (203)..(203): n is a, c, g, or t
  modified_base (519)..(519): a, c, t, g, unknown or other
  misc_feature (519)..(519): n is a, c, g, or t
tcagacatacgcgtcacgaccggtgctcgatttagtgctatagacttgggtttgggggctttgcctgggctctgctcctcctcagcctcctcactcgagggcacaggatccgtgggctcagtctgccctgactcagcctcgctcgagtcgtccggtctcgtggacagtcacgtccacctatcctacctacacgtacggaaccngctaggtgtagttcggttggtagttaactactattcgtacctccgtagtaaccagacgacccaaccggacggaccctaaaccgcccccgtaatactactacgttacttatttacgcgtactacgtaacaacggttaccggcccggtccgtacggtaccggtcctagtcctcgtcttccgtcgtacgcctacggtagtccgtaccgaaccaaccgtcccgtcccttaccgacgtactacgttccgtcggtaccgggtccacggtggtaccgtaggaaacgtcggtggtacggtactttaacgttacgtttcgtacgngttacctggtttaccgttcgttaacggttcggacccgtacgggtaccctttacgtttaagggttccggggtttcggggtacccgggtaacgggacccggggtaaacgtacccgacgggtacccttacccggggtaaccgttcgggtacccggtaaccgaccccggtaaaccgttcccggccccggttaccccggtaccccggtttccggacgtttcccccgttacccggttcccccgtacccgggccctaaccggttcccgggacgttacgg

SEQ ID NO: 189305 - DNA, 798 bp, Homo sapiens
  misc_feature: GYAE6OF01DGD6R.22.86.H09.1.454.CMB.1.raw
tcagacatacgcgtcacgaccggtgctcgatttagtgctatagacttgggtttggggggaggcgtggtccagcctgggaggtccctgagactctcctgtgcagcgtctggattccaccttcagtggctatggcatgcactgcctccgccaggctccggggacgaaggggctgggagtgggtgactaattatagtggtatggattaggaaagtaaataaagctatgtcgactcggtgaaggctatcactatctacagacacaactaccaaagacacttcttcgtttacctaccaaagtacgaaacgacggtacctaggaacggacgggacgaacggaaccgaaccggcgtaggttagtacgtttacgtggtagcggaagtagtactaccgaactagacggtaaaccgtaggggtaaactttcgttttaacggcttaccggtcgggtaccggggaaccgtaaacgggtaccgtaacggtttcgggtacccgttacccggtttccgttaccttacgaacccgttacccccgtaaccggaaacccggtaacccgggtaccccgttaccggttcccccggttttacccccgttccccccggtcgggttcccccgtccccgtccggtacccgtacccgggtaaccggacccgtaccccgtaaccccgggtacggaaccggccctaaccgggcccggttacgggcccccggttcggtccgggaccgtcggggtaccgtacggtaacccggtaacgtccccgtttacggcccgttacgttaccgtgtaccggtggccgggtaccgg

SEQ ID NO: 189306 - DNA, 887 bp, Homo sapiens
  misc_feature: GYAE6OF01A4FIH.22.86.H09.1.454.CMB.1.raw
tcagacatacgcgtcacgaccggtgctcgatttagtgctatagacttgggtttggggagaggagcccagcactagaagtcggcggtgtttccagttcggtgatcagcactgaacacagaggactcacatgggagtttgggctgagtcgttgggtttcctcgttgctttacgttttaaaggaggttcgtcctaggtcgtacgaggtcgcgtaggtcgttgggtaggtaggttccgggtaggggggcggtccggttcgggtaccccgaggtccccgggtagggggtaccggttccccgttagggaacctcccgtttccgttccggttggttaacgccgtacggtccgttacgttacgggtaactttcccgttaccttaccggtaggttccggtacgtttacggtacgggtctaagttccggccgtaccggtccgggtacccgtcccccggacggtaaccgggcccgggttacccggggacggggttaaaacgggggtcggttacgggggttaacggggtttcgggggtaaccggttaacttaaagtttacggtaggttacggttagtagggtaacggttaaagggtaaacgttaaaagtaaagttacgttacgggttaggtacggttaaccggttcggggtaacggtacgggtacgttaccgtacctaaccgtacgttaccgtaccgtaaagaaccgtaactaaaccgaccgtaaaccggtaactccgtttacttccgtacgtaccttaaagtcgaacgtacgtacggtacgtacgggaccgtcggaaggtaccgtagacggttagtaacgttacgttacggtaggtaggagtaacgggacgtacggaactacgtaacgtacgggtaaccgtaaagggttcgtttacgg

SEQ ID NO: 189307 - DNA, 761 bp, Homo sapiens
  misc_feature: GYAE6OF01AHZZ9.22.86.H09.1.454.CMB.1.raw
  modified_base (284)..(284): a, c, t, g, unknown or other
  misc_feature (284)..(284): n is a, c, g, or t
tcagacatacgcgtcacgaccggtgctcgatttagtgctatagacttgggtttggggagagggagcccagcactagagtcggcggtgtttccattcggtgatcagcactgaacacagaggactcaccagtggtagttttggctggagtcgttggggtttttcctcggttgcttactttttaaggaggtgtccaggtgtctagggtgcagcgtcggtggagtcgtgggggagtcggtggtccaggccgtggggacgtccctgacactctccgtgtcgcaggcgtntggacttccgacttcgaggttcggtcttaagtggctacgtcgaccacggtcggccctcccggaccgtacgggtccgtaccggggacgtacgggggtccgttagggaggttgggtcggtacttaaggtttaagacggtttagggtacttgggtaacgtaaagggtaaagttaaagtaacgtaacgttagggtacggtagggaccggttaacggtagggaaccggggtacctacggtacccgtaccgtacctccgtaacgtaacgacgaaacctaacgacccgtaaacgtaactacgttacttactttaccgtaactaaaggtacgaacgtagtaccggtaaggtaggtaaccgggcgtaaccggtaccggtaacgaggttacgttaacgttacggttacgtacgggtaggaacggacgttaacggccgtaacggtaacgttacggtaaacgggtaccggttaaagggtcgtttacggg

SEQ ID NO: 189308 - DNA, 663 bp, Homo sapiens
  misc_feature: GYAE6OF01ANEA0.22.86.H09.1.454.CMB.1.raw
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
tcagacatacgcgtcacgaccggtgctcgatttagtgctatagacttgggttggggctttgcctgggctctgctcctcctcagcctcctcactcgagggcacaggactccgtgggctacacgtctcgaccctgacctcacgcctcgctacagtcgtccggtctcgtggacagtcagtcacctagtcctacctactacgtcggaaacccagcagttcgtattgggttaggtacgttaataacctntcgtcctccgtacgtaccaaacncgaccaccggagaccaaaccgccccagactcatcgttacttancgtactcgtactaacgtacggcccggtaccgttcggaccggggttccctaggtcgttccggttccttccgtacgtccggtacctacgtacgttcgtacggaccttacccggaccgtcccgtcgacgtaccctgtaccgtggtccggtacctcgacggtcagtagtcgcgggtactacgtnttattacgttnctacgctactattcgtcgcgtacggccttactaggttcgtcgggttcaaccgggcgtacggtacacgtcgcccgtacgccggtagaccgaccgccgcgtacccgtccggtccctcgtcccgtccttaccggtcccctacccttccgccgtttacgcgttccg

SEQ ID NO: 189309 - DNA, 740 bp, Homo sapiens
  misc_feature: GYAE6OF01E17UD.22.86.H09.1.454.CMB.1.raw
  modified_base (139)..(139): a, c, t, g, unknown or other
  misc_feature (139)..(139): n is a, c, g, or t
  modified_base (720)..(720): a, c, t, g, unknown or other
  misc_feature (720)..(720): n is a, c, g, or t
tcagacatacgcgtcacgaccggtgctcgatttagtgctatagacttgggtttgggggctttgcctgggctctgctcctcctcagcctcctcactcgagggcacaggatccgtgggctcagtctcgcctgacctcgacncctcgactctagtcggttccgggtctccgtaggaccagtccgacgtccaccgtacttcctacctacaccgtacggaaccagcgtagtcgtagtggttacggttagttaactacgtagttccgttccgtaccgtacgtaaccaacgtccgaccgaccgtaccggacctaaaccgcccaacgtaccgtacctacgttcttaagttcgcgtactacgtactaacgtaccggccgtaccgtacggtacgggtacctgtaccggtccgttctaccgtcgtacgaccttcggtaacgtccgaccgacctaacccggccggtcccgtaccgttagaacccgttcggtcccgttccggtcggtaccgacccggttaggcgttacgggaattaccggtgggaccttaggcgtttaattcgttacgtaccgtcgtaaccgtgttccgttagccgtcggaccttcccggtacttacggtgggttcgggttccggacgggtaccgacgtaaccgtcgcgtcccgtacgtacgtacgtccgccgtacgtccggtccgccgttcccggtaaccgtctacccgttccgttaccccncttacccgctcgtacgttcg

SEQ ID NO: 189310 - DNA, 767 bp, Homo sapiens
  misc_feature: GYAE6OF01A74ZN.22.86.H09.1.454.CMB.1.raw
  modified_base (213)..(213): a, c, t, g, unknown or other
  misc_feature (213)..(213): n is a, c, g, or t
  modified_base (296)..(296): a, c, t, g, unknown or other
  misc_feature (296)..(296): n is a, c, g, or t
  modified_base (549)..(549): a, c, t, g, unknown or other
  misc_feature (549)..(549): n is a, c, g, or t
tcagacatacgcgtcacgaccggtgctcgatttagtgctatagacttgggtttgggggcttttgcctgggctctgctcctcctcagcctcctcactcagggcacaggatcctgggctcagtctgccctgactcagcctcgctcagttcgtccgggtctccgtggacagtcagtcaccatcctcctacactcggaaccagcagtgatggttggntaattactaactatcgtctccgtagtaaccacgcgaccacgacgacaaacccgccccaagtacctctaactacttaatttacncgacttacgtaacctaaagtaccggcccggtccctacgggtccgggttacccgtagtaccgttacccgttctttccgtcgtaccgggtccctaaccgttaacggtcgtaccggaaacccgaccgtaccccggtccctacccgtaactaaccctacgttccttaccgggtccgggtaccctacggtacgcgtaaggaagtacggacggggtactacggtttacgttaacgtttacgtacgtacgacggttaccncgtaacggttacgtacggtacgggacgtaacaccgggttaactaaggtttcgggtttgggtaaccgggtcgggggtaccgggaaacggtaccgaacggtcgtaccgggttacctacggttacggaccctacccgggtaaccggaccggtaccctccccggtcccgtaccgtactaacccggttccttaacccctccccgtccccttccggtaacccgg

SEQ ID NO: 189311 - DNA, 740 bp, Homo sapiens
  misc_feature: GYAE6OF01E4L51.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctgttgctcttttaagaggtgtccagtgtcaggtgcagcgtggtggagtcgtggggggaggcgtggtccagccgtgggacgtccctgagctcgtcctgtgcagcgtctggacttcaccttcagtggctagtggcagtgcactggcctccgccgaggcccgtccgggtacgaacgggggtctaggggaggttggggtcggtactaaaacgtttagtaagttgggtaatagggaacgtagggaaaagttaaagtaaaagtacttagtggtacggtaccgtccggtagggaaaccgggtccgtaattacccgaacccgtagttacccgttaaccccgaaaggaaaccggtaaaccctaaaacccgtaacccgtaaaaacgtaaacccgttaaccctttaccgtttaccgttttacccctaaacccgtaaaaagttaccgaaacctaaccggaccccgttaaggaacgggaacgggtccggaaacggtaccgaacccgggtagtaaggttacgtaagttaccgtggtacggacggaagtaacgtacgtacgaacgtagtaacgggtaaccgtaacgggtaaatttccgg

SEQ ID NO: 189312 - DNA, 719 bp, Homo sapiens
  misc_feature: GYAE6OF01CQDXI.22.86.H09.1.454.CMB.1.raw
  modified_base (603)..(603): a, c, t, g, unknown or other
  misc_feature (603)..(603): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatgggagttgggctgagtcgttgggttttcctcgttgcttacgttttaagaggtgtccagtgtcaggtgcagtcgtgggtggagtcggtgggggagcgtggtccaggccgtgggacgtcctgacgactcgtccgtgtgcagcgttcgtaggtattcctaccttcgaggtcggactagtcggactagtcgcctacgtcggtcctccgaccgtacggccgtaccggggacggaaggggtctaggggtaggtacgggtacggaacttaagttataggttcggtaagtaggtaagtaagggtaaaacgttaaaataaacggacttaggtagggtacggtaacccggtttccgggaaagggtaaccgggtaaccgttaacttacccgaaccctactacccgaacccaaggtaaaccgaacctaacccgtaaccaaacgtaacccttacgttcttacgtttaccaacgtaaactcggaaacngtaccgtagggacgacggtacgaaggacgacggtacgtaggtacgttacgttagtacggagaacggtaggacgtagaaccgtaagtaacgtaggaaacggtacggtaagtttaccg

SEQ ID NO: 189313 - DNA, 772 bp, Homo sapiens
  misc_feature: GYAE6OF01BVZH3.22.86.H09.1.454.CMB.1.raw
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (345)..(345): a, c, t, g, unknown or other
  misc_feature (345)..(345): n is a, c, g, or t
  modified_base (689)..(689): a, c, t, g, unknown or other
  misc_feature (689)..(689): n is a, c, g, or t
tcagacatacgcgtcacgaccggtgctcgatttagtgctatagacttgggttgggacgaggagcccagcactagaagtcggcgtagtttccattcggtgatcagcactgaacacagtagacctcacatggagtttgggctagagtcgttggttttcctacgttgtacttacgtttttaaaggnggtgtaccgagttcgtacgaggttgatggctgggtagtagtcgggnggggcgtcgtacggtcacggcgtacgggacgttccctggaacgtccttccgtcgtgtagccagtcttacgtgtacttccgtactgaccgtggtactggtgactcgtcgcgtccggnggccctaaccggccgaacggtcccgacggggtcgtaaggccggtaggtagggtcggtataaccgttagttacgaggttacgtagtaggaagtaaacgggtaaataaactaacggtacttagtacggttccggacccgttagggtaacggtacgggtactctaaccgaccttacgtacgacctaagtaaccgtaaaccgtaccgtaccgaaaacgttccctacgtttacctttaccttaaaccgtaacgtaacgttaacggaacccgttccggttaaacgacgggtaacggaccgggtacggtacgtacccggaaaccggttgttaccgttaacttaacccggtntcggggttaagacggtaacgaacgtaaccgttaccggtaattaacgggttaacccgtaaggtaaccgggttagttttaacccg

SEQ ID NO: 189314 - DNA, 828 bp, Homo sapiens
  misc_feature: GYAE6OF01CIHR7.22.86.H09.1.454.CMB.1.raw
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
tcagacatacgcgtcacgaccggtgctcgatttagtgctatagacttgggtttgggggagaggagcccagcactagaagtcggcggtgtttccattcggtgatcagcactgaacacagaggactcaccatgggagtttgggctgagcttgggttttccncgttgcttcttttaagnggtgtccagtgtcaggtgcagctgggtggagtcggtgggggacgcgtggtccaggccgtggggacggttcccctggacgaccttctccgtggtgccaggtcgttcgtggtactttccaccctttgaggttcggtcctaagtcgggactagttggacccgtacggtccggcccgtccccggacccggtaagggtccccggtttaccgggggaccggaaggggggttccttaagggggacgggtttgggggtacggacttaaagttttacggaggttcgggttaaagttagggaagttaaagggggtaaaatttaaaaacgtaaacggtaaccggttagtacgggtcgggttaaacccggttccggggaacggtaaaccgggggcccttaacgttacccgaacccgttacgtttaaccccgaccggtaaacggtacctaaaccggtaaacccttaacccgaaaaccgtaacccgttaccgtttaccgttttaccggttttaaccaacccgtaaaagtaccgtaaaccgacggttccgaaggtacgggacgggaaccggtagaaccgcgggtaacctagggttataacgtttacggaggttcggacggagtacggactacggactaggttagaaccggtttaaggaagttttccg

SEQ ID NO: 189315 - DNA, 791 bp, Homo sapiens
  misc_feature: GYAE6OF01B2O79.22.86.H09.1.454.CMB.1.raw
  modified_base (702)..(702): a, c, t, g, unknown or other
  misc_feature (702)..(702): n is a, c, g, or t
tcagacatacgcgtcacgaccggtgctcgattttagtgctatagacttgggtttgggggagaggagcccagcactagaagtcggcggtgtttccattcggtgatccaggcactgaacacagaggactcgaccagtggagtttgggactgagcttgggttttcctcggttgcttacgttttaaggaggtgtccaaggttgtcgtagggttgccaggtcgtgggtcggtaggtccggtaggggggaggtccggtgggtacccgaggtcccggtcggggacgttcccgaggacgtacctcgtcgtgtacgcaggtccggtcgtacggtacttccgaccctttagacggttcggacttacgtggactacgtcggacctacggtccggtcccgtaccgggtaccgtagggtcccggttaccggggacggtaagggggtccgtgggggtacggttcggggtacgtacgttaagttacggtaggtacggtagtacgggtaagtaacgggtaaagttaaacgtaacggtctttagggcggttacggaccttacgggaggtaccggtccgttactaccctacgtacgttcccgaacgtagaaccgttaactaaccgaaccgtaacggttaacctaccgtttcgttaaccgttaaccaacgtaacgtaacgaacgtaccgtaccggtagggtacggtacggacggtaacggngaaccgtgtacggttacttacggtaggcgttaggacggtaacgagggtaactcggaacttacggaacggaaccgttaaggtcttacggg

SEQ ID NO: 189316 - DNA, 533 bp, Homo sapiens
  misc_feature: GYAE6OF02HDY3J.22.86.H09.1.454.CMB.1.raw
  modified_base (410)..(410): a, c, t, g, unknown or other
  misc_feature (410)..(410): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgtggtttcgtcgtaggctctttaagaggtgtccagtgtcaggtgcagctggtggagtctgggggaggcgtggtccagcctgggaggtccctgagactctcctgtgcagcctctggattccccttcagtgacttctacatgaattggatccgccaggctccagggagggctggagtgggtttcatacattagtggtagtggtattttaaatacgcagactctgtgaagggccgattcaccatctccagggacaacgccaagaactnactgtatctgcaaatgaacagcctgagagtcgaggacacggccgtgtattattgtgcgggagagggatcgggacaggttatgtctttcggacccgttggggcccaggggtaccctggtacccg

SEQ ID NO: 189317 - DNA, 155 bp, Homo sapiens
  misc_feature: GYAE6OF02IU9S3.22.86.H09.1.454.CMB.1.raw
  modified_base (155)..(155): a, c, t, g, unknown or other
  misc_feature (155)..(155): n is a, c, g, or t
tcagacatacgcgtcacgaccggtgctcgatttagtgctatagacttgggtttgggggaagaggaagactgacggtcctagcacagcggccctgggctgcctggtcaaggactacttccacgcgtatgtctgagcgggctggcaaggcgcatagn

SEQ ID NO: 189318 - DNA, 499 bp, Homo sapiens
  misc_feature: GYAE6OF02GF0TD.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagccaaggctcgcccctggtccactctcgttcccaccctcctccacgtcg

SEQ ID NO: 189319 - DNA, 572 bp, Homo sapiens
  misc_feature: GYAE6OF02I1X77.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcactcaggcaaagcccccagactcatcatttatgctgtcaataagccggccctcgacggggtccctgatcgcttctctggctcagtctggcaacacggcctccctgaccatctctgggctccgaggctagaagatgaggctgtattattactgctgccttctagtttgcgacggccgtacctacgtacgtttggggtcgtttccgggacgggtacgggaccaagtccgtcggtaacccgttcgtacgggtccgacggacccgaagggtcctccggtccccccgttcgggttacctaccgttccgttcccgttccccaccccttccgtcccgaccgg

SEQ ID NO: 189320 - DNA, 499 bp, Homo sapiens
  misc_feature: GYAE6OF02JNUKE.22.86.H09.1.454.CMB.1.raw
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagccccagactcatcatttatgctgtcaataagcggccctcgaggggtccctgatcgcttctctggctccaagtctggcaacacggcctcctgaccatctctgggctccaggctgaagntgagctgattattactgctgctnatttgctaggcncctanacgttggtcgttcggcggaggccaagcgtcgacgtccgtagccgagcccaaggcctcgcccctcggcacgtctcgtcccacctcctcacgtcg

SEQ ID NO: 189321 - DNA, 168 bp, Homo sapiens
  misc_feature: GYAE6OF02H7T9G.22.86.H09.1.454.CMB.1.raw
  modified_base (158)..(168): a, c, t, g, unknown or other
  misc_feature (158)..(168): n is a, c, g, or t
tcagacatacgcgtcacgaccggtgctcgatttagtgctatagacttgggttttgggggaagaggaagactgacggtcctagcacagcggccctgggctggcctggtcaaggactacttccacgcgtatgtctgagcgggctggcaaggcgcagtagnnnnnnnnnnn

SEQ ID NO: 189322 - DNA, 156 bp, Homo sapiens; identical to SEQ ID NO: 189154
  misc_feature: GYAE6OF02FSQSS.22.86.H09.1.454.CMB.1.raw
  modified_base (156)..(156): a, c, t, g, unknown or other
  misc_feature (156)..(156): n is a, c, g, or t

SEQ ID NO: 189323 - DNA, 506 bp, Homo sapiens
  misc_feature: GYAE6OF02JB730.22.86.H09.1.454.CMB.1.raw
  modified_base (235)..(235): a, c, t, g, unknown or other
  misc_feature (235)..(235): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngcacccaggcaaagccccagactcatcatttatcgctgtcaataagcggccctcgaggggtccctgatcgcttctctggctcaagtctggcaacacggcctcctgaccatctctgggcctccaggctagaagntgaggctgtattatactgctgctntatttgcaggcncctacncgttggtgttcggcggaggacagcgtgaccgtcgtagtcagtccgaggctcgccccgtcggtcaccgtcttcgttccccgcccttccgtcacgtcg

SEQ ID NO: 189324 - DNA, 495 bp, Homo sapiens
  misc_feature: GYAE6OF02IHRRQ.22.86.H09.1.454.CMB.1.raw
  modified_base (269)..(269): a, c, t, g, unknown or other
  misc_feature (269)..(269): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttangctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgacgtctagtcagccaaggctgcccctggtcacgtctcgttcccaccctctccacgtcg

SEQ ID NO: 189325 - DNA, 500 bp, Homo sapiens
  misc_feature: GYAE6OF02HEPK5.22.86.H09.1.454.CMB.1.raw
  modified_base (235)..(235): a, c, t, g, unknown or other
  misc_feature (235)..(235): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngcacccaggcaaagccccagactcatcatttatgctgtcaataagcggccctcagggtccctgatcgcttctctggctccaagtctggcaacacggcctcctgaccatctctgggctccaggctgaagntgaggctgattattactgctgctcatttgcaggcncctacacgttgggtgttcggcggaggaccaagctcgaccgtcgtagtcacgccgaggcctcgcccctggtcctacgtctcgttcccaccctcctcacgtcg

SEQ ID NO: 189326 - DNA, 576 bp, Homo sapiens
  misc_feature: GYAE6OF02HV0Q4.22.86.H09.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
tcagacatacgcgtcacgaccggtgctcgatttagtgctatagacttgggtttggggaggcggtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactcgtgaaggcgattcacatcncagagacaactccaaagaacactctgtttcaccaaaatgaaacagcctgagaggcgagacacggctagtgtattaacngtgcagagactcgaacatgaactaacgggaaatcttttaggatctagtgggggccaaagggacacgtggtcaccgtntacgtcagccctcaaccgaacgggccaatcggttcccttcccccgnggccctcccgtagcctaccgacggtaccgaccgtaacccgccggaagaccgacgaacaacggcccgtaccggtcggcgtcgccgtaggtacgaaaccgtacgttacctaccgtacgtaccgtatcgtacgtggacgg

SEQ ID NO: 189327 - DNA, 504 bp, Homo sapiens
  misc_feature: GYAE6OF02FOV5J.22.86.H09.1.454.CMB.1.raw
  modified_base (420)..(420): a, c, t, g, unknown or other
  misc_feature (420)..(420): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggtcgattcaccatctcagagacaactccaagaacactctnttctccaaatgaacagcctgagaggcgaggacacggcagtgtattacgtgtgcgagagatcgacagtgacgtacgggaagttcg

SEQ ID NO: 189328 - DNA, 564 bp, Homo sapiens
  misc_feature: GYAE6OF02I44EI.22.86.H09.1.454.CMB.1.raw
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccggtctcctggacagtcagtcaccatctcctacactggaaccagcagtgatgttggtgttataactatgtctcctggtaccacagcacccaggcaaacgccccagactcatcatttatgctgtcaataagccggccctcgacggggtccctggactcgcttctctcggctccaagtctggccaacaccggcctccctgaccatctcgtcggctccaggctgaagntagagtctntattattacgtgctgctntatttgcacggcncctacgtacgttgggtcggttcgggcggtaacgggaccgtaacgcgtacgacccgttacgtacggtccacgacccgaaggtcctccggcccccgtggtaccctaccgttccgttcccggttcccccgaccccgtcccgtacccgaccgtcg

SEQ ID NO: 189329 - DNA, 501 bp, Homo sapiens
  misc_feature: GYAE6OF02F2QOW.22.86.H09.1.454.CMB.1.raw
  modified_base (404)..(404): a, c, t, g, unknown or other
  misc_feature (404)..(404): n is a, c, g, or t
  modified_base (475)..(475): a, c, t, g, unknown or other
  misc_feature (475)..(475): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcgaggggtccctgatcgcttctctggctccaagtctggcaacacggcctccctgaccatctctgggctccaggctgaagatgaggctgattattactgctgctctatttgcaggcncctacacgttgggtgttcggcggagggaccagctgaccgtctaggtcacgccaggcctcgccccgtcgtcnctctcgttccccgcctcctcgcgtcg

SEQ ID NO: 189330 - DNA, 519 bp, Homo sapiens
  misc_feature: GYAE6OF02H4K9P.22.86.H09.1.454.CMB.1.raw
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagccggccctcaggggtccctgatcgctttctctggctccaagtctggcaacacggcctccctgaccatctctgggctccaggctgaagntgaggctgtattattactgctgctctatttgcaggcncctacacgttgggtgttcggcggagggaccaagctgaccgtcgtacgtcacgcccgaaggcctccgccccgtcgtccaccgttctccgttccccaccctcctccgaccgtacg

SEQ ID NO: 189331 - DNA, 550 bp, Homo sapiens
  misc_feature: GYAE6OF02JEGFR.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactcgtgaagggccgattcaccatctcagagacaactccaagaacactctgtttctccaaatgaacagcctgagaggcgaggacaggcagtgtattactgtgcgagagatcgacatgactacgggaaatctttagatcgtcgtggggacccaaagggcaacgttggtaccaccgtctcttcacgcctccgacaacgggccctatccggttccttcccccgtaggcccgtccctcgcctaccgaggacgtccaccctccgaagacgcacgacgccgacctcgggctcggcctggtacaacggacctacgtccgacgtcgtactcgtactggacgg

SEQ ID NO: 189332 - DNA, 603 bp, Homo sapiens
  misc_feature: GYAE6OF02JCL4D.22.86.H09.1.454.CMB.1.raw
  modified_base (264)..(264): a, c, t, g, unknown or other
  misc_feature (264)..(264): n is a, c, g, or t
  modified_base (464)..(464): a, c, t, g, unknown or other
  misc_feature (464)..(464): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtgactcgtgaaggccgattcaccatctcagagacaactccaagacactctnttctccaaatgaacagcctgagaggcgaggacacggcagtgtattacgtgtgcgagagtcagacagacgtaacggaaggtaactttgtagtactcgtagggtaccgaacggaacgacgtcggtacgtaccgacctttcgtactacgcctacccgtacgaaacgggcccactcgttccgttccccctcgccggcctcgtcnccgtacggaggacctccccgtaccgagtacgcgaaccaggtacccggcccgtacggcgtccgtaacgtcggttacggtaacggacgttaacccgttcccgaccgtaaccggttttacgggtacctggaacggtccgggg

SEQ ID NO: 189333 - DNA, 679 bp, Homo sapiens
  misc_feature: GYAE6OF02GGFTN.22.86.H09.1.454.CMB.1.raw
  modified_base (548)..(548): a, c, t, g, unknown or other
  misc_feature (548)..(548): n is a, c, g, or t
  modified_base (565)..(565): a, c, t, g, unknown or other
  misc_feature (565)..(565): n is a, c, g, or t
  modified_base (664)..(664): a, c, t, g, unknown or other
  misc_feature (664)..(664): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctcgtggtacttcgtaggtttggacgtccttacgtgtctagtacggtttcgggtcccgacggacggtccctaccggaaggggggaacgggtccgtagggtagggttggggtcggaccgaggactacgtaaccgaaaacggaacggaaccggaactaaaggtaaagggttaatttttagaggtcggtaccttgttggtaagggaacggggcctaacgtttacccgaacctacgttccctaaccgaaggaacgaaaccgtaacgtacgaaacgtacctacctacgtttacgtttcncgacagtacgcggaacncgtccgtcggacgtacgccggaacgtaccgaccggtcgttcgtactttacgtttcgtggtcggtcaaggtacggacgtagtaattacctagtaacgttnttacttagcgtaacg

SEQ ID NO: 189334 - DNA, 527 bp, Homo sapiens
  misc_feature: GYAE6OF02HR3JZ.22.86.H09.1.454.CMB.1.raw
  modified_base (234)..(234): a, c, t, g, unknown or other
  misc_feature (234)..(234): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaanagcacccaggcaaacgcccccagactcatcatttatgctgtcaataagccggccccttcgacggggtcccctggatcgcttctctggctccaagtctggcaacncggcctccngaccatctctgggctccgaggctgaagntgaggctgattatactgctgctnatttgcaggcnctacacgttgggtcgttcggcggtagggaccaagctacggaccgtcgtaggtcacgaccgaacggtcctcggccccctggtcctaccgtcttccgtccccacccgtcctccgacgtcg

SEQ ID NO: 189335 - DNA, 525 bp, Homo sapiens
  misc_feature: GYAE6OF02HILXV.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggcctccgccaggctccgggcaaggggctgggagtgggtggcaattatatggtatgatggaaagtaataaagactatgtaggactcggtagaagggcgtattcacatctcagacgacaactaccaagaaccactctgtttctaccaaatgaacagcctagagaggcgaggacacggacagtagtattacgtggtcgcgaagagagtcgacagtaggaacgtacgggtaagttcg

SEQ ID NO: 189336 - DNA, 554 bp, Homo sapiens
  misc_feature: GYAE6OF02F1R39.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaaagaacactctgtttctccaaatgaacagcctgagaggcgaggacacggcagtgtattactgtgcgagagatcgacatgactacgggaaatcttttgatctcgtgggggaccaagggacacgtggtccaccgtctcttcagcctccaccaacgggcccagtccggttccttcccccgtggccgccctcgcctccgaggcgccacctccgagacgcacacgccgcccgtgggcctcggcccgtggtaccgaacggtaccttaccgttccgaccggtccgttatcggtcgtggacggg

SEQ ID NO: 189337 - DNA, 646 bp, Homo sapiens
  misc_feature: GYAE6OF02F0SXT.22.86.H09.1.454.CMB.1.raw
  modified_base (314)..(314): a, c, t, g, unknown or other
  misc_feature (314)..(314): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgtggttttcctcgttgctcttttaagaggtgtccagtgtcaggtgcagctggtggagtcgtgggggaggcgtggtccagcctggggaggtccctgagactctcctgtgcagcgtctggattcaccttcagtggctatggcatgcactggctccgccaggccgtccgggnaacggggctgggaggtgggtggctaagttatagtggtatggatagggaaagtaaataaagactagtgtaggtaccgtccggtaggaacgggtccgtaagtttccgaacctacttccgtaccgaaggtaacgaacctaaccgtaacccgaaacgaaaccctacttccttacgtttcctaaccgtaaacgtacgaaaccacggccgtagaacggacgggacgtaacggaaccgacgggacctaggttgttaacgttacgtcggttacggaccggtaaggtaacgagtaccggaacgtagtacgggtaaccggttaacggggtaaacgtttacgg

SEQ ID NO: 189338 - DNA, 529 bp, Homo sapiens
  misc_feature: GYAE6OF02G4OE0.22.86.H09.1.454.CMB.1.raw
  modified_base (343)..(343): a, c, t, g, unknown or other
  misc_feature (343)..(343): n is a, c, g, or t
  modified_base (523)..(523): a, c, t, g, unknown or other
  misc_feature (523)..(523): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaacgcccccagactcatcatttatgctgtcaaataagcggccctcgacggggtccctgactcgcttctctggctcagtctggcaacacggcctcccngaccatctcgtgggctccgaggctgaagatgacgctgtattattactgctgtctctatttcgcaggcctcctactacgttgggtcgttcgggcgggaggaccaagcgtacggaccgtcgtaggtccacgccgaggcctcgccccgtggtcctacgttctccggttccccgccctccgtcnccgtcg

SEQ ID NO: 189339 - DNA, 514 bp, Homo sapiens
  misc_feature: GYAE6OF02FZL65.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactagtgtggactccggtagaagggccgattcaccatctccagacgacaactccaagaacactctgtttctcaaatgaaacagcctgagacggcgaggacacggcagtgtattacgtgtgcggaagagatcgacagtagacgtacgggaattcg

SEQ ID NO: 189340 - DNA, 551 bp, Homo sapiens
  misc_feature: GYAE6OF02GHNLA.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagtcttttgatctcgtggggccaaggacacgtggtcaccgtctcctcacgcctccaccaacggcccactccggttccttcccccgtcggccacccctcctaccaacgacgaccaccgtcgtcggggccacgcgccggcccgtgggcctcgccgtcggtcgaacggacctaccttccgacgcgtatcgtcgtcggacggcgggtcg

SEQ ID NO: 189341 - DNA, 510 bp, Homo sapiens
  misc_feature: GYAE6OF02H7KUI.22.86.H09.1.454.CMB.1.raw
  modified_base (233)..(233): a, c, t, g, unknown or other
  misc_feature (233)..(233): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccanagcacccaggcaaagcccccagactcatcatttatgctgtcaaataagcggccctcgacggggtccctgatcgcttctctgctcaagtctgcaacacggcctcctgaccatctctggctcngctgaagntgagctgtattattactgctgctctatttcgcacggcncctacgacgttgggtcgttcgggcggacgggacaagctcgaccgtccgtagtcacgcccaaggcctacgcccctggtccacgtctcgttccccgccctcctccgacgtcg

SEQ ID NO: 189342 - DNA, 505 bp, Homo sapiens
  misc_feature: GYAE6OF02JC5NZ.22.86.H09.1.454.CMB.1.raw
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcaccttcagtggctatggcatgcactggctccgccaggctccgggcaggggctgggagtgggtggcaattatagtggtatgatggaataataaagctatgtgactcgtgaagggcattcacatctccaganacactcaagacactctgttcacaaatcgaacngacctgagaggcgagacacggcagtgtattacgtgtgacgagagacgtcgactagtcgacgtaacgggatcgtttacg

SEQ ID NO: 189343 - DNA, 576 bp, Homo sapiens
  misc_feature: GYAE6OF02FUD1P.22.86.H09.1.454.CMB.1.raw
  modified_base (288)..(288): a, c, t, g, unknown or other
  misc_feature (288)..(288): n is a, c, g, or t
tcagacatacgcgtcacgaccggtgctcgatttagtgctatagacttgggtttggggagaggagctcagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcnctggcctccgccagggctccggggcaaggggctgggagtggggtgctaattatatggtatggatgggaaataagtaaagactagtggtaggacctccggtaggaacgggccgtaagttccaacctatcctccgaagacgaaccaacctaccaaagaacctacttctcgtttaccacctaaatacgaaccagcccgtagacggacgcgaaggaacgacgggctaggtagttaacgttcgtaggtacggcgtagaggactcggaactagtacggtacgtaacgggtaacg

SEQ ID NO: 189344 - DNA, 515 bp, Homo sapiens
  misc_feature: GYAE6OF02HJ6E2.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtgcaagttatagtgggtatggatggaaagtaataaagctatgtggactcgtgaacggcgatcacatctcagacgacaactcaagaacactctcgttcacctaaatcgaacagacctagagaggcgaacggacacggcagtgtattacgtgtgacgagacgatcgactagtgaacgtacggaagttcg

SEQ ID NO: 189345 - DNA, 502 bp, Homo sapiens
  misc_feature: GYAE6OF02JISSC.22.86.H09.1.454.CMB.1.raw
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcgacggggtccctgatcgcttctctggctccagtctggcaacncggcctccngaccatctctgggctccagctgaagntgagctgtattatactgctgctntattgcaggccnctacgcgttgggtgtcggcggacggacaagctgaccgtctaggtcacgccgaggcctcgccccgtcggtccacgtccgtcgtccccacctcctcgacgtcg

SEQ ID NO: 189346 - DNA, 564 bp, Homo sapiens
  misc_feature: GYAE6OF02HN0ME.22.86.H09.1.454.CMB.1.raw
  modified_base (347)..(347): a, c, t, g, unknown or other
  misc_feature (347)..(347): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgacacgggaaancttttgatctcgtggggccaagggacacgtggtcaccgtctcttcagccctccacccgaagggccccagtccggttccttcccccgnggcccnccctgcctccaggacnccgaccccgtcgacgacgccacgcggccgccggtcggcgtccggtccgtcggtacgaacggtacccttacccgttaccgaccggtcttacgtcgttcgtaggtacggg

SEQ ID NO: 189347 - DNA, 156 bp, Homo sapiens; identical to SEQ ID NO: 189154
  misc_feature: GYAE6OF02IR0B2.22.86.H09.1.454.CMB.1.raw
  modified_base (156)..(156): a, c, t, g, unknown or other
  misc_feature (156)..(156): n is a, c, g, or t

SEQ ID NO: 189348 - DNA, 515 bp, Homo sapiens
  misc_feature: GYAE6OF02FU34Z.22.86.H09.1.454.CMB.1.raw
  modified_base (368)..(368): a, c, t, g, unknown or other
  misc_feature (368)..(368): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagccacccaggcaaagcccccagactcatcatttatgctgtcaataagcggccctcaggggtccctgatcgcttctctggctccaagtctggcaacacggcctccctgaccatctctgggctccaggctgaagntgaggctgattattactgctgctctatttgcaggccgcctacgtacttgggtcgttcgggcggacgggaccaagcgtgaccgtcctaggtcagcccgaaggcctcgcccctcggtccncgtctcgttccccncctcctccgacgtcg

SEQ ID NO: 189349 - DNA, 604 bp, Homo sapiens
  misc_feature: GYAE6OF02HONU6.22.86.H09.1.454.CMB.1.raw
  modified_base (311)..(311): a, c, t, g, unknown or other
  misc_feature (311)..(311): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgagactctcctgtgcagcgtctggattcaccttcagtggctagtggcatgcactggctccgcaggcctccgggnaaggggctgggagtgggngcaattanagtggtatggatagggaaataagtaaagtactagtggtaggactccggtaggaacggggcctagttccaacctatccaccgaagaacgaacaacctaccgaaacgtaaaccacttaccgttcgtttacctaccaaacgttacgaaacctacggacctaggaaggacgggacgaacggaccgaacgggctaaggtacgttaagtttacgtggttacgacggaaggacgtagtacgacgaagtacgtaacggtaacgggtaagttacgg

SEQ ID NO: 189350 - DNA, 542 bp, Homo sapiens
  misc_feature: GYAE6OF02G0PNX.22.86.H09.1.454.CMB.1.raw
  modified_base (310)..(310): a, c, t, g, unknown or other
  misc_feature (310)..(310): n is a, c, g, or t
  modified_base (379)..(379): a, c, t, g, unknown or other
  misc_feature (379)..(379): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggnaaggggctgggagtgggtgcaattagtatggtatgatggaagtaataaagactagtgtaggacttcggngaacgggccgattcaccatcctaccagacgacaactaccaagaacacttctcgtttactaccaaatacgaactacgacctagacggacggacgaaggacgacggcgaggtgtattacgtgtagcgaagagagtacgacgtagtacggacgtacgggaagttcg

SEQ ID NO: 189351 - DNA, 504 bp, Homo sapiens
  misc_feature: GYAE6OF02JJB31.22.86.H09.1.454.CMB.1.raw
  modified_base (336)..(336): a, c, t, g, unknown or other
  misc_feature (336)..(336): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagttttggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattanatggtatgatggaagtaataaagactatgtggactccggtgaagggccgattcacatctcagagacaactcaagaacactctgttctaccaaatgaacagcctagacgaggcgaaggacacggcagtgtatacgtgtagcgagagatcgacatgacgtacggaagtcg

SEQ ID NO: 189352 - DNA, 641 bp, Homo sapiens
  misc_feature: GYAE6OF02JJWW7.22.86.H09.1.454.CMB.1.raw
  modified_base (275)..(276): a, c, t, g, unknown or other
  misc_feature (275)..(276): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagacatacgcgtcacgaccggtgctcgatttagtgctatagacttgggtttgggggcgtttgtccgtgggctctgctcctcctcagcctcctcactcaggcacaggatcctggctcagtctgccctgactcagcctcgctcagtgtccgggtctcctggacagtcagtcaccatctcctacactggaaccagcagtgatgttggtggttataactatcgtctcctggtaaccacagcacccgaggcaaacgcccccagactccaatcatttannctgtcaataagcggcctcgagggtcccngactcgcttctcncggctacctaagtctggacaaccgcggccctccncgaaccctntcctctcggggtacctcccgaaggccttacggaagtgtacggacgggtccttaggtaacttttagttaacgttcggtctacggtcccttactagtttcgacgttaacgggccaccttacgtctttaggggtcggtttaccggcggggtaaccgggaaccgtaacggtccgtacggtacccgttccggtaggtccctacggcccgtaaggcccgttacgccccccggttagacccgtacttccgttccggttaccccccaccgttcccgtcgacccgtaccg

SEQ ID NO: 189353 - DNA, 595 bp, Homo sapiens
  misc_feature: GYAE6OF02H77VW.22.86.H09.1.454.CMB.1.raw
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggcctagtggcatgcactgggctccgccaggcctccgggcaggggctggagtgggngnattatatggtatgatggaagtaataaagctagtgtggactccggtagaagggccgtattccacctatctccagacgaccaacctaccgaagaacctacctcttcgtttaccctacctaaagtacgaacgacgtacccgtaggaacggacgggacggaacgggaccgaacgggacgtagttggttaacgttaccgtgggttcggacggaacggagtaacgtacgtacgtaagttacggaaccggttacggggaacgtttacgg

SEQ ID NO: 189354 - DNA, 580 bp, Homo sapiens
  misc_feature: GYAE6OF02GA27H.22.86.H09.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagccacccaggcaaacgcccccagactcatcatttatgctgtcaatagcgccctcgaggggtccctgactcgcttctctggctcagtcngcacncgcctccngaccntctctgggctccgaggctgaggatgaggtctgatttacgtactgccttacgtcattagtcgcgtaggccggtactaaccgttcggttggggttcggtttaccgggcgggtacggggaacctaacgggtcgttacgacccggttctacgggtccacggaccccgaaggtccgttaccggcccccgttaggtcccaccgttccgttccggttacccccacccgtccctaccgacggtcccg

SEQ ID NO: 189355 - DNA, 668 bp, Homo sapiens
  misc_feature: GYAE6OF02I5ZE3.22.86.H09.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (390)..(390): a, c, t, g, unknown or other
  misc_feature (390)..(390): n is a, c, g, or t
tcagacatacgcgtcacgaccggtgctcgatttagtgctatagacttgggtttggggcgtttgcctgggctctgctcctcctcagcctccgtcactcagggcacaggactcctgggacttcagtctgcccttgactcacgcctcgctcaggtcgtcccggctccgtggaccagtcagtcaccatctcctacactggaaccngcagtgattggttggtaggttactaacgtatcgtcctcctggtaccaacncgcacccaggccaaacgccccgagactcactctatttacngtcttgtacaattaacggccggtaccctcggacgggtccctgactccgtcttcgtcgtcggcctacgaagtcgtcggacaacgccgtcctcctgacctntcgtacgtcgggtactaccgtaaggtactaggaacgtctacggtacgtcttagtaagtttacgttacgtcgtacgttcgtacctacgttacgtttacgacgtacggtcctacccgttacgtacggttggggttaccggttccgggacggtaacgggaccaacggtcgtacggtacccgttcgtacggtccaccggaccggtaacggtcccgtcccggtaccccgttagtcctacccgttcgtacccggttaccccaccctcccttacgaccgttaccg

SEQ ID NO: 189356 - DNA, 524 bp, Homo sapiens
  misc_feature: GYAE6OF02HT5OI.22.86.H09.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngcacccaggcaaagcccccagactcatcatttangctgtcaataagcggccctcaggggtccctgatcgcttctctggctcaagtcnggcaacacggcctccngaccatctctggcttccaggtctgaagntgaggctagtattacttatgctagctacatagtggaggcagcgaanaagtttggtgttcggcgggaggaccaagtccagaccgtcctaggtccacgcccggaaggcctacggccccctcggtccacgtcctcgttaccccctacccgtcctcgtaccg

SEQ ID NO: 189357 - DNA, 510 bp, Homo sapiens
  misc_feature: GYAE6OF02ILANE.22.86.H09.1.454.CMB.1.raw
  modified_base (331)..(331): a, c, t, g, unknown or other
  misc_feature (331)..(331): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaggggctggagtgggtgcaatntatggtatgatggaagtaataaagctagtgtggactcggtagaacggccgattcacatctcagacacaactccaagacactctagttctaccaaatgaacacgcctagagaggacgaggacacggcagtgtattacgtgtcgacgagagtacgcgacagtacgacgtacgggaagttcg

SEQ ID NO: 189358 - DNA, 581 bp, Homo sapiens
  misc_feature: GYAE6OF02G4BPO.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagactctcctgtgcagcgtctggattcaccttcagtggctatggcatgcacgtggcctccgccaggccgtccgggcaagggggctgggaggtggggtggactaaagttatagttggtatgatagggaaagtaaataaaagactagtggtaggactccggtaggaacgggccgattcaccatcctaccagacgaacaactaccaaagaacctactcttacgtttacctacctaaatcgaaactacgccgtagacggaggacgacgggacaacggctaggtagttagttacgtggtacggacggaagacggtatacgactagtacggaacgtacgggaattcgg

SEQ ID NO: 189359 - DNA, 507 bp, Homo sapiens
  misc_feature: GYAE6OF02HC1II.22.86.H09.1.454.CMB.1.raw
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (502)..(502): a, c, t, g, unknown or other
  misc_feature (502)..(502): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctctggtaccaacngcacccaggcaaacgccccagactcatcatttangctgtcaataagcggccctcgaggggtcccngatcgcttctctgctccagtctggcaacacggcctcctgaccatctctcgggccttccgaggcctagaagatggacggctgattattactgctgctcatttgcngccgctactcgttgggtcgttcgggcgtagggaccaaggctcgaccgtcgtagcacgccaggcctcgccccgtgtcactcgtcgtcccgccctccgtcncgtcg

SEQ ID NO: 189360 - DNA, 595 bp, Homo sapiens
  misc_feature: GYAE6OF02IXTN1.22.86.H09.1.454.CMB.1.raw
  modified_base (235)..(235): a, c, t, g, unknown or other
  misc_feature (235)..(235): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacngcacccaggcaaacgcccccagactcatcatttatggtgtcactcgtcggccctcgaggagtctctcatcgcttctcaggctccagtctggcaacacgcctaccctaacactctcgtgggcctccgagtttggaggtacgtagtccttactttattactgtctacgtttacctttaaagttggtaccgtccctacttcgttcggttcgggttttcggccgggtaggccgaccggaagtcgtaccgtccgtcggtcacgtcccgaacggtcctacgcccccgtcggtcctaccgtccttaccgttcccctacccttcccgtccgaccggtccgttacgtcggtccgtaggtacggtccggg

SEQ ID NO: 189361 - DNA, 502 bp, Homo sapiens
  misc_feature: GYAE6OF02HX5QB.22.86.H09.1.454.CMB.1.raw
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtggctatggcatgcactggctccgccaggctccgggcaaggggctgggagtgggngcaattanatggtatgatggaaagtaataaagactatgtgactcgtgaggcgattcacatctcaganacaactcaagaacactctgttcaccaaatgaacagcctagagaggcgacggacacgacagtgtactacgtgtgacgagagatcgacagtacgaacgtacggaattcg

SEQ ID NO: 189362 - DNA, 530 bp, Homo sapiens
  misc_feature: GYAE6OF02I76ND.22.86.H09.1.454.CMB.1.raw
  modified_base (398)..(398): a, c, t, g, unknown or other
  misc_feature (398)..(398): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggctccgggcaaggggctgggaggtgggtggctaaagttatagtggtatgatagggaataataaagactatgtgactcgtagagggcatcacatcncagacgacaacctacaagaacactctgttcctacaatcgaacgctagagaggacgacggacgacgcgagtgtattagtgtggacgaggagacgtacgactagtacgaacgtaacgggtaacgtagtttacgg

SEQ ID NO: 189363 - DNA, 533 bp, Homo sapiens
  misc_feature: GYAE6OF02IJUL2.22.86.H09.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (519)..(519): a, c, t, g, unknown or other
  misc_feature (519)..(519): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaacgcccccagactcatcatttangctgtacaataagcggccctcgacggggtcccngatcgcttctctggctccaagtctggcaacacggcctccctgaccatctctgggcctccgaggctgaagatggaggctgtattattactgctgtctctagtttcgcagggcctaccgtactacgttggggtgttcgggcgggtacgggaccaagcctaggaccgtccgtagtcacgcccgaggcctcgccccgtcggtccacgtcctcgttccccnccctcctcacgtcg

SEQ ID NO: 189364 - DNA, 671 bp, Homo sapiens
  misc_feature: GYAE6OF02HIPZW.22.86.H09.1.454.CMB.1.raw
  modified_base (231)..(231): a, c, t, g, unknown or other
  misc_feature (231)..(231): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccaangcaccaggcaaacgccccagactcatcatttatgctgtcaataagccggcctcgacgggtccctgatcgcttctctggctccaagtctggccaacgccggcctcctcgacctatcctcgtcgggcctccgaggtcctagaacgagtcggacggtctaggtaatttacgttacgtgcttcggccttacgtatttcggaccgtacgggtcccgtacccttacgtaccggttttcggggttccgggtttaccgggggaccggggtaaaccgggggtaacccgtaacgggtccgttaccgggtaccccggttaccgttacggggtaccaaccgggtacccccgtaacgggtccccgttacccggtccccccggttacggtacccaacccgtttcccgttcccgttacccccgaccccgtttcccgtacccgaccggttacccgg

SEQ ID NO: 189365 - DNA, 598 bp, Homo sapiens
  misc_feature: GYAE6OF02ISEZG.22.86.H09.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (264)..(264): a, c, t, g, unknown or other
  misc_feature (264)..(264): n is a, c, g, or t
  modified_base (391)..(391): a, c, t, g, unknown or other
  misc_feature (391)..(391): n is a, c, g, or t
  modified_base (546)..(546): a, c, t, g, unknown or other
  misc_feature (546)..(546): n is a, c, g, or t
  modified_base (577)..(577): a, c, t, g, unknown or other
  misc_feature (577)..(577): n is a, c, g, or t
tcagacatacgcgtcacgaccggtgctcgatttagtgctatagacttgggtttggggctttgcctgggctctgctcctcctcagcctcctcactcagggcacaggatcctgggctcagtctgccctgactcagcctcgctcagtgtccgggtctcctggacagtcagtcaccatcctacctacactggaccagcagtnatgtggtgtatactatcgtctctggaccaacngccaccnggaccaacgccccagactcatcattangctgacaatagccggcctcgacgggtccagctccgtcttctcgtcgctaccgtagtcaggacaaccgcggcctccgtagacctactcgtcgtcgggccttccgaggtcctagaacgtgtagacggtntacggtatttacttacgtgtccgtgtcctactcgttgccgaggtccctacgtagtccggttgggtccggttaggcccgggtaagggaaccctggtccgtaccggtaaccgtccgttacggaccaccgtacccgtaggtccctaccggttaccccnggttaccctcgttccgtacccgtttcccccncccgtacccgtagtaccgtcg

SEQ ID NO: 189366 - DNA, 555 bp, Homo sapiens
  misc_feature: GYAE6OF02F44H0.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttaataactatgtctcctggtaccaacagccacccaggcaaacgccccagactcatcatttatgctgtcaataagcggccctcaggggtccctgactcgcttctctggctccaagtctggcaacatcggcctcctgacccatctctgggcctccgaggctagaagtataggacggctgtaatttacttactgctgcttcatttgcaggcacctactcttgtgttggttcgggcggacgggaccaaggcgtacgaccgtccggagtccgacggtcccgaacggtccgtaccgcccccgttacggtcctaccgttcccgttccgtttacccccacccgttcccgtaccg

SEQ ID NO: 189367 - DNA, 511 bp, Homo sapiens
  misc_feature: GYAE6OF02HLOSK.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcgtctggattcaccttcagtggctatggcatgcactggctccgccaggctccgggcaaggggctgggagtgggtggctaattatagtggtatgatgggaaagtaataaagactagtgtggactcgtgaggcgatcacatctcagagacaactaccaagaacactcttcgttctaccaaatcgaacagcctagagagacgaggacgacgcagtgtattacgtgtgacgagagatcgacagtagacgtacggaagtcg

SEQ ID NO: 189368 - DNA, 539 bp, Homo sapiens
  misc_feature: GYAE6OF02IA95J.22.86.H09.1.454.CMB.1.raw
  modified_base (233)..(233): a, c, t, g, unknown or other
  misc_feature (233)..(233): n is a, c, g, or t
  modified_base (312)..(312): a, c, t, g, unknown or other
  misc_feature (312)..(312): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaangcacccaggacaaagcccccagacctcatcatttatgctgtcaataagccggccctcgaggggtccctgactcgcttcnctggctccaagtctggcaacaccggcctcctgaccatctctgggcctccgaggctgaagatgaggctagatttattactgctgctctatttgcgacggccacctacgtacgttgggtcgttcgggacggaggaccaagctacgcccgttcgtagccacgacccgaaggccgtccgcccccgtggtcccacgttccgtccgttaccccacccgtcctccgacgtaccg

SEQ ID NO: 189369 - DNA, 502 bp, Homo sapiens
  misc_feature: GYAE6OF02FTCN5.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtgggtggcaattatatggtatgatggaagtaataaagactatgtggactcgtgaagggcgatcacatctcagagacaactccaagaacactctgttctaccaaatgaacagcctgagaggcgaggacacggcagtgtatacgtgtgcgagagatcgacagtagacgtacgggaattcg

SEQ ID NO: 189370 - DNA, 523 bp, Homo sapiens
  misc_feature: GYAE6OF02GWWSV.22.86.H09.1.454.CMB.1.raw
  modified_base (349)..(349): a, c, t, g, unknown or other
  misc_feature (349)..(349): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtatactgtgcgaagggcgtgatagcagcagctgttacngtatacttcagtcgttgggcaggcacctggtcaccgtctcctcacgcctccaccaacggccacgtccgtccttccccgtcgccaccctcctaccacgacgacgacctcgcgggcacgacgccgccgtcggcgtcgtccgtggtcaacggctactccgacgcgtactcgtctcgg

SEQ ID NO: 189371 - DNA, 513 bp, Homo sapiens
  misc_feature: GYAE6OF02FU6HW.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgccaggcctccgggcaagggggctgggaggtggggtggctaattatagtgggtatggatgggaagtaataaagactatgtgactcgtgaggcatcacatctcagagacaactccaagaacactcttgttctaccaaatgaacagcctagagaggcgaggacacgcagtgtatacgtgtagacggagagagtcgactagtagacgtacggaagttcg

SEQ ID NO: 189372 - DNA, 606 bp, Homo sapiens
  misc_feature: GYAE6OF02IM7FQ.22.86.H09.1.454.CMB.1.raw
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (443)..(443): a, c, t, g, unknown or other
  misc_feature (443)..(443): n is a, c, g, or t
  modified_base (564)..(564): a, c, t, g, unknown or other
  misc_feature (564)..(564): n is a, c, g, or t
tcagacatacgcgtcacgaccggtgctcgatttagtgctatagacttggggtttgggggctttgcctgggctctgctcctcctcagcctcctcactcagggcacaggatcctgggctcagtctgccctgactcagcctcgctcagtgtccggtctcctggacagtcagtcacatctcctacactggaaccagcagtgactgttgtgttatactntgtctctggtaccaacacaccagacaacgccccaatcatgattangaggtcactaagccgccctgacggggtcctagactcgcttcncgtgctcagtctgacacgacgctccngacgtcncgtcggctcgagtctgacgngtgacggctgtatttactacgtgactacgtctacgacgttaggacggtacgcacggtacgtaacgttaagtttcgggtacgtaccgggngggaaccggtaacctagggtccgttacggacccggtttccgtaagggtccaaccggcccgtaacgggtcccttaccggtaccccccgtaggttaccctaccggttccgtcccggtttcccnccccgttaccggccgtaaccggtcccgttagtcccggttccg

SEQ ID NO: 189373 - DNA, 649 bp, Homo sapiens
  misc_feature: GYAE6OF02IQPU4.22.86.H09.1.454.CMB.1.raw
  modified_base (250)..(250): a, c, t, g, unknown or other
  misc_feature (250)..(250): n is a, c, g, or t
  modified_base (359)..(359): a, c, t, g, unknown or other
  misc_feature (359)..(359): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggacgtccctgagactctctgngcagcgtctggattcaccttcagtggctagtggcatgctacgtggcctccgccgagggccgtccggggcgaagggggtctaggggacggttggggtcggactaaagttntacgtggtatgagtacggaaataagtaaagactagtgtacggtactccggtagtaagggtacgtacttacaaccacgtcctaccgagtaagaacctaaccgtacccaaagaaaccctacgttaccttcgtttaacctaacccaaagttacgaacgtacgtaccgtaaggacggaagggccgaacgggaacgtaccggacgtaacggttacgttaactttacggtacgttaggaccggtaagaacggacttacggactaacgtacggtaaccggtaacgggtaagttacgg

SEQ ID NO: 189374 - DNA, 663 bp, Homo sapiens
  misc_feature: GYAE6OF02IBXEB.22.86.H09.1.454.CMB.1.raw
  modified_base (164)..(164): a, c, t, g, unknown or other
  misc_feature (164)..(164): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctccgtggacngtcagtcacctatctacctacacgtggaaccagcagtgatgttaggtagttataactatgtctcgtacgaaccaacacacagacaaacgccccaaatcactagtatttagacgacggttacaactaacggccgtaccctggaacgggtccctagtacgtcgtcttctcgtggcctaccgtagtcctacggacctaacgaccggtcctaccgtcgtaccgtcgtacggtcgtccgttacgacgtcgtagacgtacgtggacgtctagtaacttatcgtacgcgtatccgataggtacgaggtacgcgtaacgtaccgaattacgggtttcggtgacccggggaggtaacgggacctaaggtcgtaccgtaaccggttctacgggtacacccgggacctaaggtcccgttacccgaccccggtttagaccttccggtccccggtttacgtaccccccgaacttccccggaacgttaccggtacgttacgtcgtaacccggg

SEQ ID NO: 189375 - DNA, 526 bp, Homo sapiens
  misc_feature: GYAE6OF02JGVD9.22.86.H09.1.454.CMB.1.raw
  modified_base (340)..(340): a, c, t, g, unknown or other
  misc_feature (340)..(340): n is a, c, g, or t
  modified_base (424)..(424): a, c, t, g, unknown or other
  misc_feature (424)..(424): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgcaggcgtctggattcaccttcagtggctagtggcatgcactggctccgccaggcctccggggcaaggggctgggaggtgggtgcaattanagtggtatgagtaggaagtaaataagactagtggtaggactccggtagaacgggccgtattccgacatcctaccagagacaacnccaagaacacttctgttcaccaatgaacagcctgagacggcgaggacacggnagtgtatcgtggngacgagagactacgacagtacgacgtacggtaattcg

SEQ ID NO: 189376 - DNA, 638 bp, Homo sapiens
  misc_feature: GYAE6OF02FXTAS.22.86.H09.1.454.CMB.1.raw
  modified_base (274)..(274): a, c, t, g, unknown or other
  misc_feature (274)..(274): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggacggtccctgagactctcctgtgcagcgtctggattcaccttnagtggctagtggcatgctacgtcggcctccggccgagggccgtcccgggggacgaacggggggtccttggggagggttggggtacggacgtaaagtttagtagttagggtatggaagtagggaaagttaaactaaagacttagtggtacggaccttccggaggaacgggccgtattaccacctatcctaccagaacgaaccaacctaccgaaacgaacctacttacttacgtttacctaccgtaaactacgaaccacgacccgtaggacggacggacgaacggacgacggacgagttacgtacttacgtcggtacgacggtagagtacgtacgaactagtacggtaacgtaacgggtaattcgg

SEQ ID NO: 189377 - DNA, 662 bp, Homo sapiens
  misc_feature: GYAE6OF02G6MTR.22.86.H09.1.454.CMB.1.raw
  modified_base (269)..(269): a, c, t, g, unknown or other
  misc_feature (269)..(269): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttaataactatgtctctggtaccaacagcaccgaggacaaacgccccagactcatcatttangctgtacaataacgccggccctcgacggggtccctgactcgtcttctctcggctacctaagtctacggaccaaaccgaccggtccctccctacgaacccacttctcgtcgggccctaccgaggcctaggaacgtagtaggaacggtccttagtaacttttaacgttacgtcggtacttcgtaccttccgtagtttcgcgtaacgggtcctacccgttaccgtacggtttggggttcggttaccgggacggggaacggtaaccgaagtccgttacggtacccgttccgtaacgggtccacggtacccgaacgggtccctacccggtcccccgttacgggtaccctaccgttcccgttacccgttcccccacccctcccgttaccgacgttaccg

SEQ ID NO: 189378 - DNA, 983 bp, Homo sapiens
  misc_feature: GYAE6OF02IY2LU.22.86.H09.1.454.CMB.1.raw
  modified_base (166)..(166): a, c, t, g, unknown or other
  misc_feature (166)..(166): n is a, c, g, or t
tcagacatacgcgtcacgaccggtgctcgatttagtgctatagacttgggtttgggggctttgcctgggctctgctcctcctcagcctcctcactcagggcacagggactccgtgggctcagtctcgccctagacctcacgcctcgctcagtcggtccggtctcgnggacagtacagtacacctatcctacctacacgtacggaaccagtcgaggtgagttggttggttaggttacttaactattcgttcctccgtacgtaaccaacgacgacccaacccggaggaaccaaacccgcccccaagtacctactacttactagtttacgtcgtcttacgtaacaagttaaccggcccggttaccccgtagggttaccggggttcccgttagggtaccttccggttaccttttccgtccggttaccgggtaccttaaccgtaacggtttcccggtaccgggaaccaacccggtacccggtcccctttaccggtaccgtaaccctcgtttacccgttcgggtacccggggttaccctaccgggtaacgggttacctaacgggtaaacgtaacggttacgggtaaccggtttaccgttaacggtttaaactttttaaaccgttacccgttcggttaccgttacccgttacccgtttaacgtttacggttttacggacccggttaacccggggtcccttaacccgtttaaaccgggttttccgggtttacggggggttccgggtttaaccggggaccggggttaaaccggaacccgttaaccggggttacccgttaacccggggttaccccgttaaccgggttacggttacccggaacccgggttccccggtaacccgggttccccgtttcccccggggtaccccccgttttagggaaccccgtttacccggtttaccccggtttaccccccggttttaccccccggtaccctttacccccgggttaccggtaaccccgggtttcccgg

SEQ ID NO: 189379 - DNA, 646 bp, Homo sapiens
  misc_feature: GYAE6OF02GQBWF.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcgtctggattcaccttcagtggctatggcagtgcacgtggcctcccgccgaggccgtccgggcgaaggggccgtgggacggttggggtcggacgtaaagtttagtagttgggtattggaagtagggtaaagtaaaagtaaagacttagtaggtacggtaaccgttccgggtaggaacgggacccgtaagttacccgaacctagttcccgtaccgaagacgaaacctaaccgtaccaaagaacctacttacgttacgtttacctaaccgtaaattacgaaacgacgtaccctaggacggtacggacgaacggacgacggactacggtagttacttacggtgtacggacgtaagagtacgacgtacgagtacggacggtaacggaagtttcg

SEQ ID NO: 189380 - DNA, 642 bp, Homo sapiens
  misc_feature: GYAE6OF02F9BWH.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcacgtggcctccgccgaggccgtccggggacgaagggggctgggaggtggggtggacaagttagtagttggtatggagtaggaaagtaaagtaaagactaagtggtaggacttccggtaggaacggggccgtaattccgaacctattccgtaccgaagaacgaaccaaacctaccaaagtaaccaccttcttacgtttaccaacctaaagtacgaaacacgaccgtaggaacggacgggacggaacggaccgacgggacgtaaggttgttaacgtttaccgtaggtacggacggtaaggacgtacgtaccggaacgtaagtacggtaaccggttaaccggggaaagttttaccgg

SEQ ID NO: 189381 - DNA, 576 bp, Homo sapiens
  misc_feature: GYAE6OF02GUWZO.22.86.H09.1.454.CMB.1.raw
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaccacngccaccagcaacgccccagactcatcatttangctgtacaatacgccgcctcgacgggtcctgactcgcttctctcgctcaagtctgcaacgccgcctccncgacctatctcgtcggcctccgaggctagaacgtgtcggaggtctagtaatttacgttacgtcgtctcgtcctacgttagtttcggaccgtacggtcctaccgttacgtacggtttcgggtacgttacgggacggtacggaaccagtccgtacggtaccgtcgtacgtccacgtaccgacggtcctcccggccctggtcccacgtttccctccgttcccctacccgtctaccgtaccggtacg

SEQ ID NO: 189382 - DNA, 693 bp, Homo sapiens
  misc_feature: GYAE6OF02JHWYN.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtcgatgttcggtggttaactactagtcgtactccgtggtaacccaacaaccacccgaggccaaaacgcccccaaatcatacgtactttagagacgtcaacgtaacgcgccctcgacgggtcctgactcgtcttactcgtacggcctaccgtaacgtcgtacggaccaacgtaccggtccctccgtacgaccgttctcgtcgggactccgacggtctcggacggtactacgggacggtccgttaggtaacgtttacttaccgtcggactacgtccgttactagttacgtacgggaacggtcgacgtacgtaacgttaaggtttcggtacggtttccgggacgggtacgggaaccaaggtccgtacggtacccggttactacgggtaccaaccgggacccgtaaggtccttccggaccccgttgggttacccaccggtttcccgtaccgttccccgacccgttccgtaccggtaccgtccggtttacgtccgttaccgg

SEQ ID NO: 189383 - DNA, 677 bp, Homo sapiens
  misc_feature: GYAE6OF02IHSM0.22.86.H09.1.454.CMB.1.raw
  modified_base (314)..(314): a, c, t, g, unknown or other
  misc_feature (314)..(314): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgataggaagtaataagactatgtggactccgtaggaaggcgtattcacatctcagagacaactccaagaacactcttagttcctacaaatcgaacagtcctaggagaggacgacggacacggnagtgtattacgtgtagacgagacgacgtacgacatacggaacggtaacgggtaagttcgtttagacttcgtaccggtggggaaccgaaggggtaacctcgtacgggtacctacccggttcttaccgttacgaccgtccctaaccgaaccgaacggggcccctagttcccggtaccctttccccgaggtccccgtccgtccgccgttacccgaggtaccgtacccaccgtcccggaagccgaaccgtaccggaccgcccgggtcccgtcgggtacctccggtaccgttacggaaccgtaaccggttaccttaccccgttaccgaacggttcccgtaaggtttcggtaccgtacgggtaccgggg

SEQ ID NO: 189384 - DNA, 627 bp, Homo sapiens
  misc_feature: GYAE6OF02I7OCN.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtcgtgggggaggcgtggtccagccgtgggaggtccctgagactctcctgtgcagcgtctggacttcaccttcagtggctagtggcatgctactggcctccgccagggcctcccggggcaaagggggctggggaggttggggtcggactaagtttatagttgggtaatggagtagggtaaagtaaataaaggacttagtaggtacggacctcgggtaggaacggggcgtattaccaacctactcctacgagaacgaccaactaccaagaactctaccttgttaccacctaaatacgaacacgtaccgtagacggacgggacgaacgggaccgacgggctaggttagtaacgttagtcggttacggacggtaaggaacgacgtacggacgtacgtacgggtaacggttaacggggtaaggttaccg

SEQ ID NO: 189385 - DNA, 641 bp, Homo sapiens
  misc_feature: GYAE6OF02H04PP.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctgggaggtccctgagactctcctgtgcaggcgtctggattcaccttcagtggctatggcatgcactggctccgcaggcctccgggcaaggggctgggagtgggtggcaattatactggtagtgagtagggaagttaaaacgtaaagactaagttggtaggtactccggtaggaacggggccgtaagtttccaaccgtatcctaccgagtaacgacgaacttacccaaaaggaactaaccttacttacgttttacctacctaaaacgttcgaaaccgaaggtacccttagggaaacgtacggggacgaacgggaacaaccggggacctagggtacgttaagtttaacccgtggttacggcggtaaggaacgtacgtacggacgaagttaggaacgtaacggggtaaactttacgg

SEQ ID NO: 189386 - DNA, 690 bp, Homo sapiens
  misc_feature: GYAE6OF02H4BEX.22.86.H09.1.454.CMB.1.raw
  modified_base (280)..(280): a, c, t, g, unknown or other
  misc_feature (280)..(280): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctccgtggacagtcagtcaccatctcctacactggaaccagcagtgatgttggtgttataactatgtctccgtaggtaaccaacacgccaacccgaggaccaaaccgccccagactcatacatttangctgtacaagtaagcccggtcctacgacggggtccctagtacgtccgcttcgtcgtcgtacctccaacgtcgtacggacctaacgaccggtccctccgtacggacctacgttccgtcgtcgggtaccctaccgacgggtacgtagtaacggagttaggacggtctagtaactttacttacgtgtacctcgtctcgttagttcgacgtacggtccgtaccgttacgtacggttcggggttcggttaccggggcgggtaacgggaaccgtaacggtccgtaccgggtacccgttccggtaaccggtccgaccggtacccgtaacggtcccggtacccggtccccgttacggtaccctcccgttccgttccccggttaccccctaccccgttaccgtcccgtaccgttacccg

SEQ ID NO: 189387 - DNA, 683 bp, Homo sapiens
  misc_feature: GYAE6OF02JDPY4.22.86.H09.1.454.CMB.1.raw
  modified_base (269)..(269): a, c, t, g, unknown or other
  misc_feature (269)..(269): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagccaccaggcaaacgcccccagactcatcatttangctgtcaataacgcggccctcgaggggtccctggactcgcttctctgcctcaagtctggcaacaccggcctccctgaccctatccgtacgtcgccggggtaccacgggcctggaaagtacgtggtaacgggtctagtaacgtttaacgtttaacctggtccttggtacctcgttaagtttcggacgtaacgggtcccgtacccgtacgtaaccgggtttcggggtcggtttccgggacgggtaacgggaaccgtaaacggtcgttacggaccccggttaccgtaacgggttaccaccggtaccccgaaaccgggtcccgttaaccccggcccccggttaccgtacccgttaaccgttccccgtttcccggtttacccccggcccctttacccgttacccgaccggttaacccgg

SEQ ID NO: 189388 - DNA, 563 bp, Homo sapiens
  misc_feature: GYAE6OF02I2QKV.22.86.H09.1.454.CMB.1.raw
  modified_base (348)..(348): a, c, t, g, unknown or other
  misc_feature (348)..(348): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaancttttgatctctggggccaagggacactggtcaccgtctcttcagcctccaccaacgggccccatccggtcttcccccgtggccgccctgcctccgaggacgccacctccgagacgcaccgagccggccctcggggcctaggcccttagggtccaaacgggaccttaacccgtttcccgaaccggtccggttaacgtcggttccgtggtaccggg

SEQ ID NO: 189389 - DNA, 774 bp, Homo sapiens
  misc_feature: GYAE6OF02FLVQP.22.86.H09.1.454.CMB.1.raw
tcagacatacgcgtcacgaccggtgctcgatttagtgctatagacttggggtttgggggcgtttgcctgggctctgctcctcctcagcctcctcactcagggcacaggatcctgggctcagtctgccctgactcagcctcgctcagtcgtccgggtctcctggaccagtcagtcaccatctcctacacgtcggaaccaggcagtgattggttggtggttactaactagtcgtctccgtaggtaccaacaaccacccgaggacctaaacgaccccccaaactctagtcgtaatttactggtacggtcaacgttaacgccggtccctacggacggggtccctaggactccgtccttcgtcggtcggtcctaccgtaaggttccgtacggtaccgtaaccgtaccgggtcccttacccgttacggtaacccgttacgttccggtaccgggtccttacccggacgggtaccttacgggaacgggtacgtacgggtaaccgggccttaggttaacctttaacgttaccgtacggacgtaacggtaccttaccgaagtttacggtagggacggtcgtacggtaccgtaacgttaaggtttcggtacggttcgggacgggtaacggtaaccgtagtccgtacggtacccgttacgtacgggtaccgaacggtacccgtaaggtcccgtacccggtccccggttaggtacctaacccggtccgttacccgttccccgtacccgttccgtaccggtaccgttaccggtcgttacggtacccgg

SEQ ID NO: 189390 - DNA, 557 bp, Homo sapiens
  misc_feature: GYAE6OF02GG7MK.22.86.H09.1.454.CMB.1.raw
  modified_base (192)..(192): a, c, t, g, unknown or other
  misc_feature (192)..(192): n is a, c, g, or t
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (348)..(348): a, c, t, g, unknown or other
  misc_feature (348)..(348): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccngcagtgatgttggtgttaatactatgtctcctggtaccaacngccaccaggcaaacgccccagactcatcattangctgtacaataacgcggcctcgacggggtcctgactcgtccttctctggctaccgagtctggacaacgacgcctcctaacntctcgtcggctcagttcgagcgagtctacttatactgactagttcttaaagttcgcgtacctacttcgtacgttcggtttcggcggtacgcgacgtacgtcgaccgtccgtcgtacgacgtccgaacgctaccgtcccgtggctacgtccgtacgtcccgtcccgtcctaccgtaccgtcggttactccgtctcggacggtcggtccgg

SEQ ID NO: 189391 - DNA, 632 bp, Homo sapiens
  misc_feature: GYAE6OF02GK0RX.22.86.H09.1.454.CMB.1.raw
  modified_base (327)..(327): a, c, t, g, unknown or other
  misc_feature (327)..(327): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttatactatgtctcctggtaccaacagccacccaggaccaaacgccccaagactcatctatttatcgctgtacaatacgccggcctcgacgggtcctgactcgcttctctggctcagtcnggcacgcggcctccgtcgaccgtctcgtcgggcctccgaggtctaggacggtactgggacgtcgtagtaattacgttacgtgtaccttactactatagtcgacgacggcgtactaacgttcggtttgggtcggttcgggacgggtacggtaaccgtaggtcccgttacgggtacccgttaccggttacggtaccgaccgtacccggaagggtccccgttacccggtcccccggttacggtaccccgtacccgttcccgttacccggttccccctacccgttcccgtcccgtaccgtcgttacccg

SEQ ID NO: 189392 - DNA, 720 bp, Homo sapiens
  misc_feature: GYAE6OF02GBTJB.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggacggtccctgagacctctccgtgtgcagcgtctggacttcaccttcgagtggctatggacatgcacgtggcctccgccgacgggccgtccggggcgaagggggtctggggtacggtcggggtgacgtaagtttagtagttagggttatggaagttagggtaaaagttaaaacgtaaaagtaccttaagtgggtacgggtaaccgttcccgggtagggaaacgggggacccgttaacgttacccgaacccgtaacgttacccgttacccgaaaggaacgtaaacccgtaacccgttaaacccgaaaacggtaaaccctaaccgttccgttaacgttttaccctaaccctaaagttaacgaaaccgacgtacccgtagaacggacgggaccgaacgggaccaacggtaacgtagttacgttaactttacgtggtacggacggtaagacgtacgtacggacacgtaaggaaccggtaacgggtaacgttacg

SEQ ID NO: 189393 - DNA, 518 bp, Homo sapiens
  misc_feature: GYAE6OF02FR2H1.22.86.H09.1.454.CMB.1.raw
  modified_base (426)..(426): a, c, t, g, unknown or other
  misc_feature (426)..(426): n is a, c, g, or t
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattatagtggtatgataggaaagtaataaagactagtgtaggactccggtagaacgggcctattcaccatcctcagacacaactaccaagaacnctctcgttactaccaaatcgaacagctgaggaggcgaggacacggcagtgtatacgtgtagcgagagatcgacataggacgtagggaattcg

SEQ ID NO: 189394 - DNA, 611 bp, Homo sapiens
  misc_feature: GYAE6OF02GBWM6.22.86.H09.1.454.CMB.1.raw
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcagtgcactggctccgccgaggcctccgggcaagggggctgggaggtgggtggctaattatagtgggtatggataggaaagtaataaagactaatggtaggacttaccggtggaacggggccgtatccgacctatctaccaggacgaccaacctaccgaaagaacctactacttcgtttacctaccaaaagtcgaaacgtacgaccttaggaaggacgggacgaagggtaccgaacgggtcgtaaggttcgtaacgtttaacgtcggttaggaccggtaaggagtacgtacggaactaagtacggaacggttaacggggaagtttcgg

SEQ ID NO: 189395 - DNA, 553 bp, Homo sapiens
  misc_feature: GYAE6OF02FTCUQ.22.86.H09.1.454.CMB.1.raw
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (546)..(546): a, c, t, g, unknown or other
  misc_feature (546)..(546): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacngcctgagaggcgaggacacggnagtgtatactgtgcgagagatcgacatgactacgggaaagtctttagatctcgtggggccaagggccacgtggtaccaccgtctcttcgacgccctaccaccgacgggcccagtccggttccttccccgtggcccgccctcgcctccgaggacgccacccgtccgacgacgccacgacgccggcccgtgggcctcggcctcggacgaacggtactaccttccgacgtcgtatcggttcngtacggg

SEQ ID NO: 189396 - DNA, 765 bp, Homo sapiens
  misc_feature: GYAE6OF02JTG1C.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtggggacggtccctggacgactctccgtgtgcagcgtctggacttcaccttcagtcggcttagtggcagtcgcctacgtcgggccctcccggaccgagggtcccggtacccggggcggaacgggggtcgttaggggagggtggggtacggacgttaagtttaagtacggttagggttaataggtaagttaaggggtaaaagtttaaaacgtaaaaggtacttaagttcgggtaacgggtaccgttaccgggtaagggaacccggggtacccgtaaacgtttccgaaaccgtaacgttcccgtaaccgaaggtaacgtaaacctaaacccgtaccgaaaacgtaacccttaaccgttaccgttaccgtttaccctaaaccgtaaacgttacgtaaacctacggtaccgtaaggaacgggtaaccggtaacggaaccgggaccgaacgggtacgtaggttacgtaacgttacggtcggtaacggcggtaagaacggtacgtaccgtacgtaagttacggaacggtaacgggtagtttacg

SEQ ID NO: 189397 - DNA, 609 bp, Homo sapiens
  misc_feature: GYAE6OF02G9VCB.22.86.H09.1.454.CMB.1.raw
  modified_base (283)..(283): a, c, t, g, unknown or other
  misc_feature (283)..(283): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccattcaccatctccagagacaactccaagaacactctgttctaccaatgaacngcctgagaggcgaggacacggcagtgtattactgtgcgagagatcgacatgacgtacgggaaatcgttttagatcgtcgtggggacctaaggggacctacgtcggtccaccgttctcgtttccacgtccctacccgaaccgaacgggtccctacgttccggttccccttaccccccgtcgggcccgtccccgttacgcccgtcccgacggaccgccacccgtccggacgtacgaccacgacgccgggccctgggcctcggtccgtcggtaacctaacggtacccttacgttacccgacgtcgttacgtcggttacgtcggtacggg

SEQ ID NO: 189398 - DNA, 794 bp, Homo sapiens
  misc_feature: GYAE6OF02IETH0.22.86.H09.1.454.CMB.1.raw
  modified_base (388)..(388): a, c, t, g, unknown or other
  misc_feature (388)..(388): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggtttcctcgttgctctttaagaggtgtccagtgtcaggtgcagcgtggtggagtcgtgggggaggcgtggtccaggcctggggacggtccctgacgactcgtccgtggtgcagtcgtctggtacttccaccttcgagtcggctagtcggcatgccgactggcctcccggaccgaggccgtccgggacgaacgggggtctaggggagttggggtaggacgtaaagttagtagtagggttanaggagtacgggtaaagtaaataaggactaagtgtacgggtaaccgtccgggtaaggaacgggtacgtacgttacgtaccgtactaccgtaccgtaacgtaacggaacctaaacccgtaaccgtaaaaccggaaaccgttaacccgttaccgtttaaccgttttaaccgtaacccgtaaaaccgttaaccgtaaaccgtaaccggttaacccgtaacgggtaacggaaccgggtaaccgggtaacgggaaacccggtaaaccgggtaaccggtaaggttacgggttaaaccgttttaccggttaacggttacgggtaaccgggtaaaggtaacgggtaacgtaccggtaaccggtaaccgttaccggaaaacccgggtttttttaacgggaacggttttaaaccggg

SEQ ID NO: 189399 - DNA, 741 bp, Homo sapiens
  misc_feature: GYAE6OF02JO09Y.22.86.H09.1.454.CMB.1.raw
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
tcagacatacgcgtcacgaccggtgctcgatttagtgctatagacttgggtttgggggtagggcggtggtccagcctgggaggtccctgagactctcctgtgcagcgtctggattcaccttcagtggctatggcatgcactggctccgccaggctccgggcaaggggctggagtgggtggcaattatatggtatgatggaagtaataagactatgtgactcgtgaaggcgattcaccatctccagacgacaactccaagaacactctgtttcacaagtanaacagactgagaggcgaggacacggcagtgtattacngtagcgagtagatcggaactagtacgaacgtaacgggaaaagttccgttttagacgttacgtcgtacgggggtaccgaaacggggtacctaaccgtcgggttaccaccccggtttaccgttaccgtttaccgaccggtaccccgttaacccgaacccggaaacccggggacccctaccggttaccggttacccccgtttcccccgtaccgggtccccgttccccgttaccggcccgttacccgaagggacccgtaccgtaccccgtacccggaacggtaccgacccgtaacgaacccgggccgggtaccccccgtggggtacccgtcggtaccccgggttccggtaacggtaaacccggttacccttaccccgtacccggtaacggtcccgttaacggttccgttaccggacgggtacccgggg

SEQ ID NO: 189400 - DNA, 668 bp, Homo sapiens
  misc_feature: GYAE6OF02JTGXI.22.86.H09.1.454.CMB.1.raw
  modified_base (259)..(259): a, c, t, g, unknown or other
  misc_feature (259)..(259): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtgggggaggcgtggtccagccgtgggacgtccctgacgactctctgtgcagcgtntggacttcaccttcgagtggctagtggcagtcgcacgtcggcctccgccgacggtccgtccggggcgtaacggggcgttggggaggtcggggtcgactaagttagtaggtggtagtgtaagtacgggtaaagtaaagtaaacgatagtacggtacggtaacgtccggtaaggaacgggtaccgtacttaccgacctacgtccgtacgaaggaacgtaaccaaacctacccgaaaacgtaaccttacgttaccgtttacgttacctaaaccgtaaatacgaaacgcgtaccgaggtacggtaacgggacgtaacgggactacggacgtaggttacttaagttacgtggtacggaacgtaaggtagtaacgtcgtaacacggttaaccgacgggttaaggtacgttttacg

SEQ ID NO: 189401 - DNA, 608 bp, Homo sapiens
  misc_feature: GYAE6OF02FII7N.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcacctttcagtggctagtggcatgcacgtggcctccgccgaggccgtccggggcaagggggctggggaggtggggtggactaaattagtagtgggtatggagtagggaaagttaaataaaagtacttaagttggtaggtaccgttccgggtaggaacgggccgtaattaccacctagtcctacgacgaagaaccaaacctaccgaaagtaacctactcgttagtttacctacctaaatacgaaactacgtacgtacggaaggacgggacgaacggaaccgacgcgtagtgtattacgtgtcgacggagtacgatacgacagtagaacggtacggtagttacg

SEQ ID NO: 189402 - DNA, 633 bp, Homo sapiens
  misc_feature: GYAE6OF02JEEWK.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtggctagtggcagtgccacgtggcctccgccgaggccgtccggggcgaaggggctgggaggtggggtgactaattgtagtggtatggagtagggaaagtaaataagatagtggtagaccgttcggtaggacgggtccgtacttaccgactagtcctacgaagacgaacctaaccgtaccgaaagtaaccctacttacgttacgtttacccgtaacctaaaagttacgaaacgacgtacccgtaggaacggacgggacgaacgggaccgacgggtacgtaggttacgttaacgttacgtagggtcgaacggaagtaacgacgttacgaactacgtacggaacggttaacgggtaattcg

SEQ ID NO: 189403 - DNA, 657 bp, Homo sapiens
  misc_feature: GYAE6OF02I0OJV.22.86.H09.1.454.CMB.1.raw
  modified_base (254)..(254): a, c, t, g, unknown or other
  misc_feature (254)..(254): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctctttaagagtgtccagtgtcaggtgcagctggtggagtcgtggggagcgtggtccagccgtgggagtccctgagctctcgtgtgcagcgtntggattcaccttcgaggttgcttagtggcagtcgcacgttcggctcccgcgacggccttaccggggcaaggggctcggggaggtcggggtgactaagtttatagttgggtatcggaatacgggtaaagtaaactaaagaacgtagtggtacgggaacctttcgggaagggtaacggggtaccggtaacgtttacgaaccgtacgttaccgtaccgacggtaacgaactaaaccgtacccaaacgaaccgtaactaccgttcgtttaaccgtacctaaacgtacgtaaacgtacgtaccgtagaacggacggtacgaacggacggaacggacgacggtagttagtaacgttgtaggcggtaagacgtacgtacgtacgaacgtacgaacgtacggaagttacgg

SEQ ID NO: 189404 - DNA, 650 bp, Homo sapiens
  misc_feature: GYAE6OF02G9F3Q.22.86.H09.1.454.CMB.1.raw
  modified_base (201)..(201): a, c, t, g, unknown or other
  misc_feature (201)..(201): n is a, c, g, or t
tcagacatacgcgtcacgaccggtgctcgatttagtgctatagactttggggttttgggggagaggagcccaggtcactagaagtcggtacggtgtttccattcggtgatcagcactgaacgacagaggactcgaccatggagttgggctggagcctgggttttacctcgttgctctttaagaggtgtccagtgtcaggtnacagctggtgacgtcgtgggggacgcgtgggtccacggccgtggggacgggtccctggagtacgtctcctgtagcagcgttcgtggattcgaaccttcgaagtggacctagtggcagtcgctacgtgggccttaccgacacggcgtccggacgaaggggctagggagtcgggaggacctaaagttatagtaggtacaggtagtaaggaaagtaagtaaacgtactaggtacggtagggaccttccgggaggaaacggggtcctaattcgactagtctaccgaagacgaactaccacgaatactacttctagttccacaaagtcgaacgtgtaccgtacgacggacggcgaaccggtaagacggtactacggtcttaacgttaaccgtggtaccgacggtaagaccgtaaccgtcggaacctgttaccggaaccgttaagggactttccg

SEQ ID NO: 189405 - DNA, 651 bp, Homo sapiens
  misc_feature: GYAE6OF02JJ60G.22.86.H09.1.454.CMB.1.raw
  modified_base (229)..(229): a, c, t, g, unknown or other
  misc_feature (229)..(229): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcacatctcctacactggaaccagcagtgatgtgtgtataactatgtctctggtaccaacngcaccaggacaaacgccccagactcatcattangctntacaatacgccgcctcgacggggtccctgactccgtcttcctcgtcggcctaccgaagttccgtacgggaccaaccgaccggtcccttcccgtacgaccctagttccgtcggtcgggtcccttaccgacgggtcctaggaagtctacgggacggtacttaggtaactttaacgttacgtcgtccttcggaccttacgttagtttcggaccgtacggtcccgtaccttacgtacggtttcgggtcggttaccgggacgggtacggtaccgaggtcctaccggtacccgttacgtacgggtaccacggtaccgacggtcccgtaccgtccccgtacgtaccctacttccgtcccgttaccccctacccgtcccgtacgtaccgtacg

SEQ ID NO: 189406 - DNA, 667 bp, Homo sapiens
  misc_feature: GYAE6OF02FPQT8.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcagtgcacgtggcctccgccgaggccgtccggggacaacgggggctggggaggtggggttacggactaagtttagtagtgggtaatggacgttagggaaaacgttaagtaaaaggacttaagtggtacgggtaaccttccggtagggaaacggggtccgtaattccgaacctagttccgtaccgaagtaacgaacctaaacctaccgaaacgtaacctaccgttcgttacgttttaccaaccgtaaagttcgtaaaccgacgtaccctaggaaggacgggacgtaacgggaaccgacgggtactaaggttcgttaacttacggtggtacggtacggaaggtagtacgtacggaactacggtacggtaacggtacgggtaacttcg

SEQ ID NO: 189407 - DNA, 802 bp, Homo sapiens
  misc_feature: GYAE6OF02GZBQ1.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggacttcaccttcagtggctatggcatgcacgtggcctcccggccgaggccgtccgggcaacgggggctaggggaggtggggtaggactaagttagtagttagggtatggagtagggtaaagttaaaagtaaaacgtacttaagttaggtacggtaacccgttccgggttaagggaaccggggtacccgttaacgtttacccgaaacccctaacgtttcccgtaacccgtaacggtaaccggaaacccttaaacccgtaacccgtaaaacggaaacccttacccgttacctttacggttttacccttaaccctaaaaacgttacggaaaaccgtaccgggtacccgttaagggaaaccgggtaacggggtaacccgggtaaacggggtaaccgtaaacccgggggtaccgtaaacggggtttacgttaaaccggttttaaccggttcgggttacggaaccgggtaacgggtaacggtaaccgttaaccgggaaccttaagggttaacccggaaaccgggttaaccggggtaaacgttttaccgg

SEQ ID NO: 189408 - DNA, 705 bp, Homo sapiens
  misc_feature: GYAE6OF02JCTDT.22.86.H09.1.454.CMB.1.raw
  modified_base (272)..(272): a, c, t, g, unknown or other
  misc_feature (272)..(272): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagacctctcctgtgcagcgtctggattcaccttnagtgctagtggcagtgacacgtcggcctccggccgaggccgtccggggacaagggggtcctaggggacggttgggggtcggactaaagttagttacggtagggttactggaagttagggtaaaacggttaaagtaaaagactttagtcgggtacgggaccttccgggtagggaaaccgggtccgtaatttaccacctaacgtcctaccgtagaacgaacctaaacctacccgaaacgtaaacctacgttccgttacgttttaccgtacctaaaagttcgaaaacctacgtacccgttaggaacggtacgggaaccgtaaagggacctaacgggactaagggttacgtttaacttacggttggtacggtacggtaaggtaaggtaagttccggaacacggtttacgggaaccggtttaacggggaatttaccgg

SEQ ID NO: 189409 - DNA, 658 bp, Homo sapiens
  misc_feature: GYAE6OF02IKGVJ.22.86.H09.1.454.CMB.1.raw
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcacatctctacactgaaccagcagtgatgttgtgttataactatgtctctggtaaccaanagcacccgaggtaccaaacgcccccagactacatctaatttangtctagtacaagtaacgcgacctcgacgggtccngactcncttctcgtcgctaccgaagtcgtcgacaaccgaccgtcctccgtacgactactcgtacgtggcctacgagtctagaacgtatacggacgtctagtaactttacttaacgcgtactacgtaccgtctacgtttcgacgaacggtcctaccttacgtacgttcggggttcgttacgggaccgggtaacggacccgtaaaggtccgtacgggtaacccgttaccgggtaacggtccgtaaccgaaccccggttacgggcccttccccggaacccccggttacggtaccccgtaaccttccggttacccggttaaccccctccgtttacccgttaccgtacccggttacg

SEQ ID NO: 189410 - DNA, 817 bp, Homo sapiens
  misc_feature: GYAE6OF02II1OB.22.86.H09.1.454.CMB.1.raw
  modified_base (272)..(272): a, c, t, g, unknown or other
  misc_feature (272)..(272): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggaggcgtggtccagcctgggagtcctgagactctcctgtgcagcgtctggattccaccttnagtggctatggctatgcacgtggcctccggaccgacgggtccgtccgggggacgaaacggggggtccttagggggaaggttgggggtacggtacgtaaaagttttaagtacggttagggttaatagggtaagttaggggtaaaaagttaaaacgttaaaaagggtacttaaagttcggggttaacgggtaaaccccgttccggggtttaaggggaaaaccgggggtacccgtaacgtttacccgaaacccgtaacgtttaccccgttaccgaaacggtaaacggtaaaccctaaacccgttaacccgaaaaccggtaaaccctaaccgtttaccgtttaccgttttacctaaacccgtaaaagttaccgaaacccgttagaccccgttaagggaaccgggaaccgggaccggaaccggggtaaccgaaccgggtaccgtaacggttacgttaacgtttaccggtacggttacgggacggtaacggtacgtaacgttacgaaccgtacggttaaccggtaaccggttaaccgggtaaagtttcccg

SEQ ID NO: 189411 - DNA, 679 bp, Homo sapiens
  misc_feature: GYAE6OF02GOKSY.22.86.H09.1.454.CMB.1.raw
  modified_base (266)..(266): a, c, t, g, unknown or other
  misc_feature (266)..(266): n is a, c, g, or t
  modified_base (389)..(389): a, c, t, g, unknown or other
  misc_feature (389)..(389): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgtcctgactcagcctcgctcagtgtccgggtctcctggacagtcagtcaccatctcctacactggaaccagcagtgatgttggtgttataactatgtctctggtaccaacagcaccaggacaaacgccccagactcatctattntagctagtacaataacgcggcctacgacgggtccctgatccgtacttctctggctacctaagtctggactaacgacggtccctcctcgaacctacgtctacgtcgggtcctaccgagggtacnggtaaacgagtggtaaacggtcttacgtaatttacttaaccgtgtaccgttcgtcctagttacgttcgtaccgacgggacctcccgtaaccgttacgttacgggggtttcgtaccggggacgggaaccgggtaaccgtaaacggttccgtaaccggtaacccggttccgtaacggtccgaaccgggtccccgtaaacgggtccgtaccccgtacccccggttaggtaccccgttgtacccgttttacccgttaccccccgtacccgttccccgtaacgtaacggtaacgg

SEQ ID NO: 189412 - DNA, 547 bp, Homo sapiens
  misc_feature: GYAE6OF02FR6BI.22.86.H09.1.454.CMB.1.raw
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttaataactatgtctcctggtaccaacngccacccaggccaaaagcccccagactcatcatttangctgtcaataagcggccctgacggggtccctgatcgcttcnctggctccaagtctggcaacacggcctcctcgaccatctcgtgggccttccgaggtctgaaagntgagtctagtatttattactgctgctctatttcgcaggccgtcctactacgttgggtcgttcgggcgggaacgggtaccgaagtccgtgacccgtcgtaggtcacgccgaaggcctccggcccctcggtccaccgttcgtccgttccccaccctccgtaccgacgtaccg

SEQ ID NO: 189413 - DNA, 628 bp, Homo sapiens
  misc_feature: GYAE6OF02IUUEJ.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtcgcagcgtctggattcaccttcgagtggctagtggcatcggacacgtggcctccggccagggcctccggggacaagggggtcctgggaggtggggtcgactaagttatagtgtatgagtaggaaagtaataaagactagtgtagaccgtccgtaggaacgggtccgtattccaacctatccgtaccagaacgaaccaaccgtaccgaaaacgaaacctacgttaccttcgtttaccctaaccctaaagtacgaaaccgtacgtaccgtacggaaggacggggaccgaagggaccgaaacggcgtagttacgttaattaccgtggtacgacggaagacgtagtacgagtacgtaacggaacggttaacggtaagttacgg

SEQ ID NO: 189414 - DNA, 727 bp, Homo sapiens
  misc_feature: GYAE6OF02H09CC.22.86.H09.1.454.CMB.1.raw
  modified_base (306)..(306): a, c, t, g, unknown or other
  misc_feature (306)..(306): n is a, c, g, or t
tcagacatacgcgtcacgaccggtgctcgatttagtgctatagacttgggtttgggggctttgcctgggctctgctcctcctcagcctcctcacctcagggcacgaggatcctgggctcagtctcgccctgactcagcctcgctcagttcgtaccggtctcccgtaggaccagtcagtcaacctatcctcctacacgtcggaacccagccgtagtcgtacgttggtacgttaacaagttctcgtacctcgtacggtacccaacaccaccgagccacaccgacccccaaactcatacgtatttacgnggtacgtacacgtaacggccggtacctcggacgggttccctaggtctaccgtcttccgtcggtacgtcctacctaaggtcgtcggaccgaccgtaccggccttaccgccgtaccgttcgtacgtccggtctaccgacggtctacggaacggtcgtacggtccgtacgttagttaacttaccgttacgtacggtacccttaacgtacgtagtacgcggtacgacgggtaccgtacgttacgtttcggtttagggtccggtcgggaaccgggtacgggaaccacgggtccgtacgggtacccgtccggttacgacccgtaccggaccggtacgtcccgtacccggtcccgtaacggtcccttccgttacccttcccgtaccccgttcctaccgcctaccggtaccgttcgttcggcgtaccgg

SEQ ID NO: 189415 - DNA, 613 bp, Homo sapiens
  misc_feature: GYAE6OF02GN9ZR.22.86.H09.1.454.CMB.1.raw
  modified_base (293)..(293): a, c, t, g, unknown or other
  misc_feature (293)..(293): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagctctcctgtgcagcgtctggattccaccttcgagtcggctagtcggcagtnctacgtggcctccggccagggcctccggggcaagggggctgggaggtggggtggactaagttagtagtagggtatgtagtaggtaaagtaaagtaaagactagtggtaggtacctccgggtaggaacggggccgtaagttaccaccgtatcctaccgagacgtaacaacccgtacaaacgtaaacctcttaccgttgttcctacctaaatacgaaactacgccgtagaaggacggacggaaggacgacggtacaggttagtagttacgtggtagacggaaggtacgtacgtcgacagttacgacggtaacgggtagttcg

SEQ ID NO: 189416 - DNA, 765 bp, Homo sapiens
  misc_feature: GYAE6OF02JP699.22.86.H09.1.454.CMB.1.raw
  modified_base (123)..(123): a, c, t, g, unknown or other
  misc_feature (123)..(123): n is a, c, g, or t
tcagacatacgcgtcacgaccggtgctcgatttagtgctatagacttgggtttggggaggaggagcccagcactagaagtcggcggtgttccattcggtgatcagcactgaacacagaggacncaccatggagttgggctgagctgggttttctcgttgtctctttaagaggtgtcagtgtcaggtgcagctggtggagtcgtgggggagcgtggccagcgtgggaggtcccctggacgcctcgtaccgtggtacgcagtccgtcgttggacttcctaccttcgaacgttggacttacgtcgggcgtagtcgaccgtacgttggccctaccggaccgacgggccgttccccggggacgaacggggggtcctggggaacggttcggggcggacgtaagtttaacgtaggtaggttaatggtaacgttaggggtaaaagttaagtaaaacggtacgtaaggttacggttagggtacccttaccggggtagggaacgggtaccggtaactttaccgaaccgtaactccgtaccgaacggaacgtaacccgtaaactaccgaaaccggtaaacctaccgttaccgtttaccgtttaactaaccctaaagtaacgtaaaccgtaacgtaccgtaacgaacggaccgggaacgtaaacggaccgaaccggtagtaaccggtattaacggttaaccgtggttaaccgtaggtaaaggacggtaagtaccggaccgtaagtacgggtaaacggttaaccgggtaagtttacgg

SEQ ID NO: 189417 - DNA, 678 bp, Homo sapiens
  misc_feature: GYAE6OF02GBJPN.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattccaccttcagtggcttagtggcatgcacgtggcctcccgccgacggccgtccggggacgaacgggggtcctggggagggttcggggtcggactaaagtttagtagttgggttaatggagttagggaaagttaaataaaacggacttaagtggtacgggaccttccgggtaagggaaccggggtcccgtagttaccgaacctacgttacccgtacccgaagaacgtaaccaaaccctacccgaaacgaaacctaccgtttcgttacgttttaccctaacctaaagtacgaaaccgtacggtaccgtaggaacggacgggtacggaacggaaccgacggactaggttacgttactttacgtggtacgacggaagtagtacgtacggaactagtacggtaacggtaacgggtaattcg

SEQ ID NO: 189418 - DNA, 847 bp, Homo sapiens
  misc_feature: GYAE6OF02HIS62.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctgtaccaacagccaccaggacaaacgcccccagactcatactatttatgctgtacaataacgccggccctcgacgggtccctagactccgtcttcgtcgtcggtcctaccgtaacgtcgttacggacctaaaccgacccgggtcccttaccccgtacggaaccctaacgttccgttccggttacggggtccctacccggtaacgggtacccgttaaggtaaacggtacgttacggggaacgggttaccgttaaggttaaacgttttaaccgtttaaccgttacgggttaccttaccggttaccgttaccggtttaaacttttcgggaccggttacgggtccccgttacccgtttaaaccggtttaccggggttttacgggggtttaccgggtttacccgggggtaaccggggtaaccggggtaaacccgtaaacgggttccggttaacccgggtaaaccccggtttaaccggtaacgggtacccggtaacccggtaccccggtaaaccgggttccccgtaccccgggtacccccccggtttcggttaaccccgttaccctttccggtttaccccgttacccccccttaaccccggttcccgttaccggtacccggtttacccgg

SEQ ID NO: 189419 - DNA, 592 bp, Homo sapiens
  misc_feature: GYAE6OF02JGSIE.22.86.H09.1.454.CMB.1.raw
  modified_base (489)..(489): a, c, t, g, unknown or other
  misc_feature (489)..(489): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtctgggggagcgtggtccagcctgggaggtccctgagactctcctgtgcagcgtctggacttcacctttcagtggcttagtcggcatgcacgtggcctccgcaggcctccgggcgaacggggctggggtagtgggtggactaagttatagtggtatggtagtagggaaataataaacgactagtaggtcggacgttccggtagaacgggtcctattacacctagtctaccgagacgaaccaactaccgaaagtaaccacttcttcgtttaccaacctaaatcgaaacncgtacctaggtaggagggacgaggaccacgggctagttacgtattcgtggtacgacggtaagaactcggtacgagtacgtaacggacgttaacgggatttacg

SEQ ID NO: 189420 - DNA, 671 bp, Homo sapiens
  misc_feature: GYAE6OF02I4OO5.22.86.H09.1.454.CMB.1.raw
  modified_base (182)..(182): a, c, t, g, unknown or other
  misc_feature (182)..(182): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
tcagacatacgcgtcacgaccggtgctcgatttagtgctatagacttgggtttggggctttgcctgggctctgctcctcctcagcctcctcactcagggcacaggatcctgggctcagtctcgccctgactcagcctcgctcagtcgtccggtctcctggacagtcagtcacatctcctacnctcggaaccagcagtgagtgttggtgttataactatcgtctccgtagtaccaacagaccaccgaggaccaacgccccagtacctcaacgttctatttacncggtactcgtacaacttaacggccggccctacggtcggggtcctggactccgtcgttcctcgtcggtcctaccgtaagtccgtacggacctaacgcccggtccctccgtacgtaccncgtacgtccggtcggtcctacggacgggtacctacggaacgtcgtacggagtacgttagtacgtttacttaacgtcgtctagtcctcgtagtttccgacgtacgtcgcccttacgtacgtttcgggtcggttaccggggacgtacgggacctacgccgtacgtacccgttacgtacgactaccgaccgtacggtcccgtacccgtcccggtaccgtaccttccggttaccgtcccggttaccctacccgtcccggtaaccgtccgttaacgg

SEQ ID NO: 189421 - DNA, 717 bp, Homo sapiens
  misc_feature: GYAE6OF02HGEJ3.22.86.H09.1.454.CMB.1.raw
  modified_base (210)..(210): a, c, t, g, unknown or other
  misc_feature (210)..(210): n is a, c, g, or t
  modified_base (277)..(277): a, c, t, g, unknown or other
  misc_feature (277)..(277): n is a, c, g, or t
  modified_base (339)..(339): a, c, t, g, unknown or other
  misc_feature (339)..(339): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtggggnggcgtggtcagcgtgggagtcctgagactctcctgtgcagcgtctggattcaccttgagtggctagnggtcatgcacgtggcctccgccaggcctccggggcgaacggggtcctagggacggttggtcncgagtcgtggttaggtgggtaggtgtacgtgggtcggacgactaacgtaccgtacgacgtaggacccttacgggagggaaacggggttcccggtaccaacccgtattcccgtaccgaaggtaccggaaactaaaccgtttaaccgaaaaccgtaaaccctacccttaaaacgttaattaaccgtacgtaaaaccctaaaagttaccggaaaaccctaccggtaccgttaacggaaacggtaacccggaaacccgggaaacgtaacccgggaaccgggttaacccgttaacgtaacccgtttaccggtaggttacgggaacccgggtaaaggggtccggtaagtacggtaacggaccgaggtacccgtaggttacccgg

SEQ ID NO: 189422 - DNA, 664 bp, Homo sapiens
  misc_feature: GYAE6OF02HIBAS.22.86.H09.1.454.CMB.1.raw
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatggttggtgttatactatgtctcctaggaccaangaccaccgaggaccaacgcccccagactcatctattngtactgacataacgcgtcctacgacgggtccngactccgtcttctcgtgtacctacgagtcgtaggaccaaccggtaccgcccttaccgtacgacctacgttaccgtccgtacgggtcctaccggtacggtacgtaggaacgttagacggacggtcgttagtaaacttacgtttacgtcgtacgttcggtccttagttaacgtttcgaccgttaccggccgtaccgttacgtcggtttggggttcgtaccggggtaggaaccggaccgtaacggtcgtaaccgtacgtccggtacgtcccgaccgtccgtaacccggtcctacccggccccgttacgtcccctacggttcccttacccggtccccgttccccgtaccggttaccgcgttaaccg

SEQ ID NO: 189423 - DNA, 665 bp, Homo sapiens
  misc_feature: GYAE6OF02I8ZTO.22.86.H09.1.454.CMB.1.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatcctcctacactggaaccagcagtgattggttggtggttaataactagtcgtcctcctggtaccaacngccacccaggccaaacgccccagactcatcatttangctntacaataacgcggtccctcgacggggtccctagactcgtcttctctcgctccagtctgacacgaccgtcctcctcgaactctcgtcgtcgggcctaccgacggtctaggaagacgtggacggtcgtggtaactttaacgttacgttacgtcttacggtccttaccgttaacgttttcgacggtaccggtaccgtacccgttaccgttacgggtttccgggttacgggttccgggaccggggtaacgggtacccgaacgtccgttaaccggtcccggttaaccgtacggtaccgaccgtaccgaccggtcccgtacccgtacccccggtccgttccgtaaccttcgtcccgttcccccgtcccttacccgtcccgacgttccgg

SEQ ID NO: 189424 - DNA, 646 bp, Homo sapiens
  misc_feature: GYAE6OF02IM85Y.22.86.H09.1.454.CMB.1.raw
  modified_base (360)..(360): a, c, t, g, unknown or other
  misc_feature (360)..(360): n is a, c, g, or t
tcagacatacgcgtcacgaccggtgctcgatttagtgctatagacttggggtttggggagaggagcccagcactagaagtcggcggtgtttccattcggtgatcagcactgaacacagaggactcaccatggagtttgggctgagctgggttttcctcgttgctcgttttaagaggtgtccagtgtcaggtgcagctggtggagtcgtgggggagcgtggtccagccgtgggacgtcctggagctcgtcctgtgcagcgtctggtattcaccttcagttcggcttagtggctatcgctacgtggcctccggccaggcctccgggagaaggggtctgggaggttggggacgactaaagttnagtagtatggagtaggaaataagtaaagtactagtgtaggacctcggaggaacgggtctactacgacctatccgtaccgaagacaccaactaccaaagtaaccctacttcgttacgtttaccctaacaaacgttcgaaacctaggtccctaaggacgggaacggtacggaacggaaccgtaaccgggacttaagggttactttaacgtcggttaggacggtacgaaggtacgttacgtaccgtaacgtacgttaacgggtaacccggttaacgggtaatttaccgg

SEQ ID NO: 189425 - DNA, 699 bp, Homo sapiens
  misc_feature: GYAE6OF02JPCUX.22.86.H09.1.454.CMB.1.raw
  modified_base (154)..(154): a, c, t, g, unknown or other
  misc_feature (154)..(154): n is a, c, g, or t
  modified_base (563)..(563): a, c, t, g, unknown or other
  misc_feature (563)..(563): n is a, c, g, or t
  modified_base (604)..(604): a, c, t, g, unknown or other
  misc_feature (604)..(604): n is a, c, g, or t
tcagacatacgcgtcacgaccggtgctcgatttagtgctatagacttgggtttgggagaggagcccagcactagaagtcggcggtgtttccattcggtgatcagcactgaacacagaggactcaccatggagtttggctgagctgggttttccncgttgctctttaaggaggtgtccagtgtcaggtgcagctgggtgagtcggtggggagcgtggtccagcccgtgggacgtccctggacgacctcgtccgtgtcgctacggtccgtgtagggtaactttcccaccgtttacgaggttccggcttaacgtggacctagtcgacctcggtcgggtacctcccgaccgagggtcccgtaccggggacgaaggggtcctggggacggtcgggtacgacctaatttaccgagtcggtaacgtggacgttaaggggaaacttaaaggtaaacgttcgaagtttcggtacgtaccgttccgggtaaggaaccggtccgtaactcaaccgtagtcccgtacgaaggacctaacctaaccgacgaagtacctagtccgttattacccganaaatcgaaactccgtcgtagaggtacgcggtaacgaaccgngtccgtaagttcgttacttacggcggtagaccggtaaagtcgtaacgacccggtaactacggtaacgggtaacccgtaacgggttatttaccggg

SEQ ID NO: 189426 - DNA, 603 bp, Homo sapiens
  misc_feature: GYAE6OF02HEDRO.22.86.H09.1.454.CMB.1.raw
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (368)..(369): a, c, t, g, unknown or other
  misc_feature (368)..(369): n is a, c, g, or t
  modified_base (374)..(374): a, c, t, g, unknown or other
  misc_feature (374)..(374): n is a, c, g, or t
  modified_base (412)..(412): a, c, t, g, unknown or other
  misc_feature (412)..(412): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacacgtggaaccagcagtgatggttggtgttatactatcgtctctagtaaccaacganccaccgaggaccaaacgccccagacctcatctactttntgctgtacaagtacgtccgcctgtacgggtccngactcgtcttctcgtgctcagtcngcacncgctcngactncncgtgctcgngctagagnngcgtntagtacttacgtacgcgtctacgtctacttgttaccgngtacgggcctacgtacgtcgggttcggtacggttccgggacgggtacggtacccacggtccgttaccggtaccggtccgttaacggtacccgacgacccgggtacggtcccgtcccggttaccccgtcggttccctacggttcccgttacccggttccccccgtaacccctaccggtcccgtacgttccgg

SEQ ID NO: 189427 - DNA, 689 bp, Homo sapiens
  misc_feature: GYAE6OF02GG4EA.22.86.H09.1.454.CMB.1.raw
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
tcagacatacgcgtcacgaccggtgctcgatttagtgctatagacttgggtttggggctttgcctgggctctgctcctcctcagcctcctcactcagggcacaggatcctggctcagtctgccctgactcagcctcgctcagtcgtccggtctcctggacagtcagtcaccatctcctacactggaaccngcagtgatgttgtgttaatactatgtctccgtaggtaccaacngccaccgaggaccaaacgccccagactcatctatttangctgtacaagtaacgccggtccctacgacgggtccctagacgtccgtctttacgtcgtcggccttaccgaagtcctcggaccaaacgccggtccttccctagaacctagtccgttcgtacgggtcctaccgaggtcgttagaacgtacgtacggtaacggtcgtacggtactttaacgttaccgttacgtaccgttcgtccgttacgttaacgtttcgaccgtacggtacccgtaccgttaccggttacggtttcggggttaccggttaccgggtaccgggaaccggttaaccgtacgtccgtaccgtacccggttacctacgggtccaccggtacccgaacggtcccgtacccgtccccgtacgtcccgtaccgttcccgtcccgttccccgacccttcccgtacgtacccgttacg

SEQ ID NO: 189428 - DNA, 777 bp, Homo sapiens
  misc_feature: GYAE6OF02I8CFE.22.86.H09.1.454.CMB.1.raw
  modified_base (177)..(177): a, c, t, g, unknown or other
  misc_feature (177)..(177): n is a, c, g, or t
  modified_base (192)..(192): a, c, t, g, unknown or other
  misc_feature (192)..(192): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatcncctacactggaaccngcagtgatgttggtgttataactatgtctcctggtaccaacagcaacccaggacaaacgcccccagactcatcagtttatgctgtactaataagcggccctcgacggggtccctaggactcgtctttacctcgtcggtcctaccgtaagttccgtcggaaccaaaccgtaacccgggtcccttaccccgtacggtaaaccctaacgttccgtaccggttcggggtacccttacccgaacgggtcccttaagggaaacgtaaggtttacggaacggggttcttaacggttaaaacgttttacctttaaacgtcggtaccttgaccttaccgttaagtttcgacgtacggaccgtaccttaaccgtaccgggtttggggttaccggttacggggaccgggtaaagggtacccgaaacggtccggttaccgtaaccccggttaccgtaacgggttaccgaaccggtaccccgtaacgggtccccgttacccggtaccccccggtttacggtacccgttaacctttccccggtttaccccttacccccggtaacccccttcccggtttaacccgacccggtttaaccgg

SEQ ID NO: 189429 - DNA, 808 bp, Homo sapiens
  misc_feature: GYAE6OF02H4ZGW.22.86.H09.1.454.CMB.1.raw
tcagacatacgcgtcacgaccggtgctcgatttagtgctatagacttgggtttggggggagcgtggtccagcctgggaggtccctgagactctcctgtgcagcgtctggattcaccttcagtggctatggcatgcactggctccgccaggcctccgggcgaaggggctggaggtgggtggactaattatagtggtatgagtaggaaagtaaataaagactagtggtacggactaccggtaggaacgggccgtaattccaacctattcctaccgaagaacgaaccaacctaccgaaagtaacctactctttcgttacctaacctaaatacgaaccgacgtaccgtaggtacggaacggacggtaacggaacgacggactagtgttaacttacgtgtacggacgaaggacgacgtacgtacacgtacggaacggtaacgggtaagttcgtttagactcgttacgggacgggaaccgtaacgggtactacggttacggtacccgtaccgttcttaacccgttcgaccgtacccgttaccgaaaccgggaacccgggtacccgtacggttccccggttaccccctttaccccgggtcgggtcccctccgttaccgccccggttaaccggaaaccggggtcccacccgtacccggtaccggtaacggtacccgtcgaaacccggaccgggtacccgtaccccggggtcggtaccggttccggaccccgggttgggttaacccgaaaccggttaccccttaccggttacccggaacgttccggttaacggtccggtaaggtccgggtaaccggg

SEQ ID NO: 189430 - DNA, 674 bp, Homo sapiens
  misc_feature: GYAE6OF02I6U9J.22.86.H09.1.454.CMB.1.raw
  modified_base (403)..(403): a, c, t, g, unknown or other
  misc_feature (403)..(403): n is a, c, g, or t
tcagacatacgcgtcacgaccggtgctcgatttagtgctatagacttggggtttgggggctttgcctgggctctgctcctcctcagcctcctcactcagggcacaggatcctgggctcagtctgccctgactcagcctcgctcagtcgtccgggtctcctggacagtcagtcaccatctcctacacgtgaaccagcagtgatgttggtggttaataacgtatgtctccgtaggtaccaacagccaccaggacaaacgccccagactcatcatttatcgtctgtactaagtacgccgtcctcgacggggtcctgactcgtccttctcgtcgctaccgacgttcgacggactaccgccggtcctccgtacacctacgtctcgtcggcctccgaggtcaggtaacngtacgaggtctagtaactttctacgtgtctacgtccgtacgttacgttacgccggtacggtccgtaccctacgttaccggtttggggttaccggtaccggggtacggaccgggtaaaccgtacgggttccgttaaacgggacccgttccgtaacgggtacccgtaccgtacccgtaacggggcccttaccccgggtccccgttacggtacccgttccgttaccgttaccccggttccccttccccgtacccgttacccgacggttacccgg

SEQ ID NO: 189431 - DNA, 707 bp, Homo sapiens
  misc_feature: GYAE6OF02IODPQ.22.86.H09.1.454.CMB.1.raw
  modified_base (378)..(378): a, c, t, g, unknown or other
  misc_feature (378)..(378): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggaggcgtggtccaggccgtggggacgtccctggagactctccgtgtgcagcgtctggattccaccttgagtggctatggctagtgccacgtggcctaccgccgtaggcccgtccggggcgtaaggggcctgggacggtgggtggacctaagttacgtagtgggttanaggtaagtagggaaacttaaagtaaacggacttaggtaggtacggtacgtccggaaggtaacggggaccctaattaccgaacgtacttcccgtaccaggaaacgaacctaactaccaaacgaaaccttcgttaccgttacgtttacctaaacctaaagttaccggaaactaccggaccgtaaggaacgggtacggaacggtacggaaaccacggggtactaacggttaccgtttaagttaccgtagggttaggaaaccggtaggtaaacgttccgtaacggttaacgaaccggttaccggtaaaacgggttacggggtaaactttacgg

SEQ ID NO: 189432 - DNA, 841 bp, Homo sapiens
  misc_feature: GYAE6OF02I3FMW.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgtggttttcctcgttgcttcttttaagaggtcgtccagtgtcgaggtgcagcgttgggtggtaggttcgtggggggaggtcggtggtccaggcccgtggggacggtccctggagacctctcctgtcgcagcgtctggattccgtaccttcaggtcggctagtggactagtgccgacgttcggccgtcccggccgtacgggccggtccggggacgaaacgggggtcgtaggggaggttggggtacggactaaaagttttaggtaagttagggttaagttagggtaagttaacggggtaaaaaggttaaaagttaaaaggtaacttaagttagggtaccgggtaaccgtttccggaaggtaacgggggtaacccgttaactttacccgaactaacgtaccctacccgaaaaggtaaccgaaacctaaaccgttaacccgaaacgtaaaaccgttaccctttacccgtttcccgttttaaaccttacccgtaaaaattaccggtaaaaccctaaccggtaccgttaacgggaaacggggtaaccggggaaaccggttaaggggaaaccccgttaacgggggtaccttaagggttacggtttaacgtttaccgttaacgggtacggacggaaaggtaccggtaagttacccggaaacgtaggttaacggtaaacccgggttaaacggggtaacggtttcg

SEQ ID NO: 189433 - DNA, 570 bp, Homo sapiens
  misc_feature: GYAE6OF02I415E.22.86.H09.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggatttgggctgagctgggtttcctcgttgctctttaagaggtgtccagtgtcaggtgcagctgggtggagtcgtgggggagcgtggtccagcctgggaggtccctgagctctccngtgcagcgtcnggacttccgacttcagtgctagtggcntgcagtggctccgccaggctccggcaaggggctgggacgtggggtgactaagttatagtggtatggagtacggaaagtaaataaagcgtaatggtggaactccggtaggaacggggctattccgactatcgtaccagaagtacaaccgtaccaaagaactacctactacgtttcaaccaaagtcgaactagtccaggacgtaaggcgtaacgagtaccgactaaggtcgttataccgtggtagcgaagtacgatacggactagaccggtacgttaagggaatttcgg

SEQ ID NO: 189434 - DNA, 692 bp, Homo sapiens
  misc_feature: GYAE6OF02GJSLZ.22.86.H09.1.454.CMB.1.raw
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttgtgttatactatgtctctgtaccaacngcaccaggcaaacgccccagctcatcatttangctgtacaataacgcggccctcgacgggtccctgacgtccgctttcgtctcggcctacctaagtctcggtaccaaaccgtaccggtccctcccgtacgaccctatcctcgtcgggtcctaccgacggcgttacgaaaggtactacggaacggtccgttagtaacttttaacgttacgttcgtaccgttcgtcgttacttacgtttcggaccgttacgggcccgttacccgttacgtaccgggtttcggggttaccgggttccgggaccggggtaacgggaccctaacggtaccgttaccggtaacccgttaccggttacggtaccgtaccggtacccgtaacggtcccgtcccggtacccccgttccggttaccgtacccgtttccgttacccgttacccccgtcccttacccgtaccgtaccgttaccg

SEQ ID NO: 189435 - DNA, 669 bp, Homo sapiens
  misc_feature: GYAE6OF02HET1J.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggagcgtggtccagccgtgggacgtccctgagactctcctgtgcagcgtcgtggattcaccttcagtggctagtggcatggcacgtggcctcccgccgaggccgtccgggacgaaggggctagggaggtcggggtggactaagttagtacgtggtattacggagttagggaaaagttaaataaagcttaagtggtaccggtacgtccggaaggaaccgggtcctaacgttccaaccgtacttccgtaccgaagaaccgtaaccgaaccctaaccgaaaaggtaaccctaccgtttaccgttcgttttaacccaaccgtaaatacgaaaccgtcgtacccgtaggaacgggtaacggaccgaaccgggtaacgaccgggacgttaggttaccgtttaagttaccggtggtacgaccggaagtagaccgtacgactagtacgggtaacgtaacggtaattcg

SEQ ID NO: 189436 - DNA, 676 bp, Homo sapiens
  misc_feature: GYAE6OF02G3GF5.22.86.H09.1.454.CMB.1.raw
tcagacatacgcgtcacgaccggtgctcgatttagtgctatagacttgggtttgggggaggcgtggtccagcctgggaggtccctgagactctcctgtgcagcgtctggattcacctttcagtggctatggcatgcactggctccgccaggctccgggcaaggggctggagtgggtggcaattatatggtatgataggaagtaaataaagactagtgtggactccgtggaagggccattacaccatcctaccagagacaactccaagaacactctgtttctaccaaatgaacagcctgagaggcgaggacacggcagtgtattactgtgcggagagatcgaactagtgaacgtaacgggaaattcgttttagacgttcgtacggtacggggaccgaaagggaccacgttcggtacctaccggtccttccgttaccgaccggtcccctaccgaaccgaaccgggcccctacgttcccggttccccgtttcccccgtcgggtaccccgtcccgttcgccgtacccgaacgggaccgtccccgtaaccccgtccggaacgaccgccctaaaccggcgtccccgggacccgttcggggaccttccgggacccgttagggacccgtaaacggtaccttaccgtaccctacggtaccgtttaagccgttcgtagggtacggg

SEQ ID NO: 189437 - DNA, 815 bp, Homo sapiens
  misc_feature: GYAE6OF02JEQDV.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttggctgagctgggttttcctcgttgctctttaagagtgtccagtgtcaggtgcagcgtggtggagtcgtgggggagcgtggccaggccgtgggacggtccctggacgtcctcgtcctggtcgcagcgtcgtggtacttcaccttcaggtcggtcctagtcggctagtcgactacgtcgggacctcccgccgtacgggccgttaccggggacgaagggggtccgtggggacggttcgggggtacggaccgtaagtttagtaagttggggttaaacgtggtaagttacgggaaaagttaaagtaaaagggtatttaaggtaggtaccgggtaaccgttccgggtaagggtaaaccgggggtaccgttaagttacccgtaaccgtacttccggtaacccgtaacggaaaccggtaaaccgtaaacccgttacccgaaaacgggtaaacccttacccgtttaccgttaccggttttacccttaaacccgaaagttaccggaaaccgtacgtacccgtaggaacggtacgggaccgggtaaacgggaccgaaccgggtacgtaacgggtacgtttaacgttacggtaacgggttaccggaacgggtaaacggaacgttaacggttacccgggaacgttaacggtaacccgggttaacggttaaaccgggggtaagttttaccggg

SEQ ID NO: 189438 - DNA, 619 bp, Homo sapiens
  misc_feature: GYAE6OF02FNC99.22.86.H09.1.454.CMB.1.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccagccgtggggaggtcccctgagactctcctggtgcagcgtctggattcaccttcagtggctatggcatgcagtggccnccgccaggcctccggggnaaggggctgggaggtgggtgactaattagngtggtatggataggaaagtaataaagactagtgtacggtacctccggtagggaacgggtcccgattaccgacctagtaccgtaccgagacgactaaccaccaaacgaaacctacttcgttacgttacctaaccgtaatacgaacacgtacgtacgaaggacgggacggacggaaccgacggtacgtaaggttacgttactaggttcggtaggtacggaaggagtacggtaccgacgtagttaacggaacggttaacgggtaacgtttacg

SEQ ID NO: 189439 - DNA, 528 bp, Homo sapiens
  misc_feature: GYAE6OF02FX43I.22.86.H09.1.454.CMB.1.raw
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtgggggagcgtggtccagccgtgggaggtccctggacgactctcctggtgcagcgtctggattcaccttcagtcggctagtcggcatgctatggctccgcgagccgtccgggcaaggggctgggagtcgggtggacaattatagtgtatgagtaggaagtaaataaacgctaagtgtagactcgaggacggcgatcacatcacaganacacacgaanacactctnttcacaatgaacagcctagacgagcgacgacgacggacacgtagtactacgtgacgacgaggactacgactacgatacggacgtaacgggaatttacgg

SEQ ID NO: 189440 - DNA, 556 bp, Homo sapiens
  misc_feature: GYAE6OF02F0TVQ.22.86.H09.1.454.CMB.1.raw
  modified_base (403)..(403): a, c, t, g, unknown or other
  misc_feature (403)..(403): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccaggccctggggaggtccctgagactctcctgtgcagcgtctggattccaccttcagtggctatggcatgcactggcctccgccgaggcctccgggacgaaggggctgggaggtgggtggcaattatagtggtatgataggaagtaataaagatagtgtgactcgtggaacggcgatcacntctacagacgacacaccaagaacactctcttcctacaatacaacacgcctagaggacggacgacggaccgacggacgtagttagttacgttacgtcggtaggaccggaagtaggagtacgactagtacggaaccggttaacgggtatttacgg

SEQ ID NO: 189441 - DNA, 653 bp, Homo sapiens
  misc_feature: GYAE6OF02I7LU5.22.86.H09.1.454.CMB.1.raw
  modified_base (287)..(287): a, c, t, g, unknown or other
  misc_feature (287)..(287): n is a, c, g, or t
tcagacatacgcgtcacgaccggtgctcgatttagtgctatagacttgggtttgggggctttgcctgggctctgctcctcctcagcctcctcactcagggcacaggatcctggctcagtctgccctgactcagcctcgctcagtcggtccggtctccgtggacagtcagtcaccatctcctacactggaaccagcagtgatggttggtgttaactatactgtcctccgtggtaacccaacgacgtccaacccgagaccgaaaccgaccccaagacttcatctattangtctagtactatacgccggtaccctcggacggtcctgacgtccgcttcgtctcggactccacgtctacggaccaacgccgtccctcctacgacctctctcggtcgtcccgtacgtacggcttacggagtacgtacggtaggtacttagttaaccgttaattaccgtcgttcgtacgcgttacgacgttaggtggaccgagacgagtaccggttagttcgttagggtccggtacgggaaccggtacctcgggttacgacggttaccgtacgtacggtacgaccgtacggtaacccgccggttcccgtcccggttaccgtccgttacccgtcgttccccgtacccttcccgacccgtttaccgaccgg

SEQ ID NO: 189442 - DNA, 524 bp, Homo sapiens
  misc_feature: GYAE6OF02G8DUS.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggcctccgccaggcctccggggcaagggggctgggagtgggtggcaattatagtgggtatggattagggaaagtaataaagactatggtggactcggtagaagggtcattcactatctcagagacaactccaagaacactctgttcaccaaatcgaacacgcctagaggaggcgaggaccagggcagtgtattacgtgtcgcgagagatcgacagtcggaacgtacgggaattcg

SEQ ID NO: 189443 - DNA, 877 bp, Homo sapiens
  misc_feature: GYAE6OF02JXJMW.22.86.H09.1.454.CMB.1.raw
  modified_base (242)..(242): a, c, t, g, unknown or other
  misc_feature (242)..(242): n is a, c, g, or t
tcagacatacgcgtcacgaccggtgctcgatttagtgctatagacttgggtttgggggaggcgtggtccagcctgggaggtccctgagactctcctgtgcagctctggattcaccttcagtggctatggcatgcactggcctccgccaggctccgggcaaggggcttggagtgggtcggcaattatagtggtatgataggaaagtaataagactatgtgactccgtggaaggcatcacatcncagacacacacaagacactcgtcgtttctacctaatacgtaacacgtcccgtaaggaacgggtacgggacggtaaggacgtaaaccgggtccgtaaggttacggttaacgtttaacccgggttaggtacgggttaccggaagggtaaacgtacgttaaccggaaccggttagaacgggtaaccggttaaaccgggggtaaacgttttacccgtttttaagtaaccggttcgttaccgggttaccggggggaacccgtaaacgggggtaaccttaaccgggtttaccgggtacccgtttaacccgggttccctttacccgtttaaccgtacccgttacccggaacccccgtaaaccgggtaaaccccgggttcccccgttaaaccgtttcccggggttaaccccgttttccccccgggcgggtttacccccgggtaccctttacggaccccgttcccgggacccgggtaacgttaccccgtaacccgggtaagtcccggtaaaccgccgtaaccggaacccggcccggtacccggtccggccgtacccgggtcgtaaccggggttaccaaacccggtttacccgttaccgtcccgtaaccggtccgtttacgaccgtttccgggacggtacccggg

SEQ ID NO: 189444 - DNA, 1001 bp, Homo sapiens
  misc_feature: GYAE6OF02F3U5Y.22.86.H09.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagacatacgcgtcacgaccggtgctcgatttagtgctatagacttgggtttgggggctttgcctgggctctgctcctcctcagcctcctcactcagggcacaggatccgtgggctcagtctcgccctgactcagcctcgctcagtgtccggtctcgtggacagtcagtcaccatcctcctacacgtcggaaccngcagtgagttggttgggtggtttaactaactagtcgttcctcgtacggtaccaacncgaccaaccgtaggaccaaaccgccccagtacctactacgtacctaatttactacgggtgtacctaccgttacggtcccggacccgttaccggacgggtacgttacccgttccgtacgtaccgttaccgtacccgtttccttaccgaaccggttcccgttaccgtaaccggttcgttccggaacccgtaaacccggtacccgggtacccttaacccccgtaaaccgtaccgtttaccccgttccgggttacccgggggtaccttaaccccggtttaacgggtttacgggtaaccgggtaaccgggttaaccgtttaccgtttaacccgttttaaaccgtttaaccggttaccggtacccggttttaaaccgttttaaacccggttttaaaccggtttaacccggtaccccggtaccccttaccgggtttacgtttacccggggttttccggggttttacccgggggaacgggttaccggtaaccccgggtaccgttaaacggggttacccgggttaaccccgtttaccccggggttaccgtacccggtaaaccccgtccccggtaaaacgggttccccgtaccccggttacccccggttacccgggtccccgtaaccccggttttcccggttaccccgttttaccccccggtaacccccccgtttaaccctttaacccgggacccccggtttacggttaaccccggttttccggtacccgggttaccggtacccgggttaccccggggg

SEQ ID NO: 189445 - DNA, 638 bp, Homo sapiens
  misc_feature: GYAE6OF02HIAXS.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctggagacctctcctgtgcagcgtctggattcaccttcagtggctagtggctatcgcacgtcggcctccgaccaggccgtccgggcgaaggggctgggaggtgggtgactaattagagtgggtatgagtagggaaattaaagtaaagtactagtggtcggaccttcgggtaggaacgggccgtactaccactacgtcctacgagacgaactaacctaccaaacgtaacctaccttcgttacgtttaccctaaccgtaaatacgtaaccgacggtcccgtaggacggtacggacggaacggaccgaccgggtactacggttagttacgttacggtggtacggacggtaagaacgtacgtaccgtaagtacggtacggaaccggttaacgggtaatttacgg

SEQ ID NO: 189446 - DNA, 654 bp, Homo sapiens
  misc_feature: GYAE6OF02JHG3J.22.86.H09.1.454.CMB.1.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (414)..(414): a, c, t, g, unknown or other
  misc_feature (414)..(414): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagttgtccgggtctccgtggacagtcagtcactactcctcctacacgtacggaaccagcagtgacttggttggtgttaatactatcgtctcctagtaaccaanagccaaccgacggacaacgccccaaatcatntattagngtacgtcactagccgacctcgacgggtcctagntacgtcttcncgtcggacttaccgatcgtacgacaacgaccggccttaccgtacggtaccctctcggtacggtccgtcgtacggtcgacggtaacggngttacggacggtcgtacggtactttaacgttcgtacgtacggactccgtaatacgttaaggacggtaccgcgtacggtacgacgttagtttgggcggttacgggccgggacggtaaccgtacggtccgtacgtacctaccggtacgccgaaccgtaccgacgtccgtacccggtccctacggtcctacccgttcgttaccccgtaccgtaccccgtcgtaccgtacccgtagtaccgtcg

SEQ ID NO: 189447 - DNA, 881 bp, Homo sapiens
  misc_feature: GYAE6OF02IPLJ4.22.86.H09.1.454.CMB.1.raw
tcagacatacgcgtcacgaccggtgctcgatttagtgctatagacttgggtttgggggctttgcctgggctctgctcctcctcagcctccctcactcagggcacaggatcctgggcctcagtctgccctgactcagcctcgctcagtcgtccgggtctcctggacagtcagtcaccatcctcctacactcggaaccagcagtgatgttgtgtataactatgtctcctacggtaccacagccaccagacaacgccccagactcatactatttagtcgtactcgtacaacgtaacggtccggaccccgtcggtaacggggtcccgtgtacttccgtactttccgttacgtccggtacctaccgaacggttccgtacgggaaccgaacccggtacccgggtaccccttaccccgtaccggaacccttacgttaccgtttccggtacggggtaccccttacccgtacgggtaccgttaacgggtaacggtaacgttacgggtaacggggtacctttaagggttaacttttaaccgttaaccggtttcgggtaccgttaccggtaccgttttaccgttaaccggttttcggaccggtaaccgggtaccccgttaacccgtttaaccggttaccggggtttacggggtttccgggtttacccgggggtaccgggggtaaaccgaaccgggtaacggttccggttaacccgggtacccggtttaccggtaaccggttacccgtacccggtaacccggtacccgggtaccccgtttccccgggtaccccccggttaccggttaccccgttacccgtttcccggtttacccccgggttccccccttaacccccgggtttacccttacccgggtaacccgtttaacccggg

SEQ ID NO: 189448 - DNA, 714 bp, Homo sapiens
  misc_feature: GYAE6OF02HVU39.22.86.H09.1.454.CMB.1.raw
  modified_base (260)..(260): a, c, t, g, unknown or other
  misc_feature (260)..(260): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaaggaggtgtccagtgtcgaggtgcagctggtggagtcgtgggggaggcgtggtccagccgtggggacggtccccgagactctccgtgtncagtcgtgtggcttccacctttgaggttcggcttagtcggacagtcgactacgtcgggcctcccggccgagggcccgtccgggacgaaggggtcgtagggaggtgggtagacgtaaattagtagtggttatggtaagtaggaaattaaagtaaagtacgttagtggtacggaccgttcggtagggaacggtaccgtattaccgaaccgtagttcccgtacgaaggaaccgtaaacctaaacccgtaaccgtaaaacgtaaccctaccgtttccgtttacgtttaccctaaaccgtaaacgtaccgtaaaccgacgtaccgtaaggaacggacgggaaccgaacgggaaccgacggtaccgtaagttacgttacgttacgttacggaggtaacgtaggaacgtacgtaacgacgtaagtaccggtaacggtaacgggtaaccgtttcgttaacgg

SEQ ID NO: 189449 - DNA, 700 bp, Homo sapiens
  misc_feature: GYAE6OF02GXBG1.22.86.H09.1.454.CMB.1.raw
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
  modified_base (550)..(550): a, c, t, g, unknown or other
  misc_feature (550)..(550): n is a, c, g, or t
tcagacatacgcgtcacgaccggtgctcgatttagtgctatagacttggggtttgggggaggcgtggtccagcctgggaggtccctgagactctcctgtgcagcgtctggattcaccttcagtggctatggcatgcactggctccgccgaggctccgggcaaggggctggaggtggggtggctaattatatggtatgagtaggaaagtaaataaagactagtggtggtaccgttccggtggaacgggcctacttcacctatcctccaagacgaaccaaacctaccgaaagaacctacttctttacgtttaccaatcgaacncgtcctagaggcggacggacggacacggtnaaggtgttaacttacgtggtcggagtagacgtaactacgaacgtaatagaaccggtaaacgggttaacgttcgttttgaacgtttccgtacggtacggggaccgaaagggaccgttacgtcggtacccgcctccgttacttcgaccgtcccctaccgaacgtaccgggtccctaccggttcccgtcccctttacccggnggtaccccgcctcgcccgtaccggaaggccgccctaaccgccgaagtcgacaccggcgtcccggccgtcggtccgtcgtaccggtacggtaacgaaccgttccgaacccgttaccggacgttaacgtccgtggtactacgggacggtcgg

SEQ ID NO: 189450 - DNA, 685 bp, Homo sapiens
  misc_feature: GYAE6OF02JZSUB.22.86.H09.1.454.CMB.1.raw
  modified_base (172)..(172): a, c, t, g, unknown or other
  misc_feature (172)..(172): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
tcagacatacgcgtcacgaccggtgctcgatttagtgctatagacttgggtttggggtagaggagcccagcactagaagtcggcggtgtttccattcgtgatcagcactgaacacagaggactcaccatggagtttgggctgagctgggtttctcgttgctcttttagagtntccagtgtcaggtgcagctggtggtagtctgggggagcgtggccagcctggagcctgaagctccncgtgngcagcgtctggaattcgactttcagtggctagtggctatggctacncggcttcccgcacggntccgggactaaggggcaggcggtggtggctaaagttanccgttggggtaanccggatttagggaagttaaaagaaaccgtnttaaagtcgggttaaggtccngggtttacgaaaggggtccgaacggttctaccggtaatcctacctaacgggtacaaccgttaacctaccaaaccggttaaccctaagtaccctttccggttacttaacccggaaatttacggaacttaacggccttaccggaagacggaaccggttaacgggaacctacggaacccgtggttaacgttacgttaaaccggttcgttaggaacccgttacggtaaagaggttcccaaagtccggtttagaaacccgtttaggggaaaaccgttttcccgg

SEQ ID NO: 189451 - DNA, 663 bp, Homo sapiens
  misc_feature: GYAE6OF02GFZ5Q.22.86.H09.1.454.CMB.1.raw
  modified_base (273)..(273): a, c, t, g, unknown or other
  misc_feature (273)..(273): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacggtccctgagactctcctgtgcagcgtctggattcaccttnagtggctagtggcatgcacgtgggcctccggaccgaggtcccggtcccggggacgaacggggggtccttaggggacggttgggggtacggactaaagtttagtagttgggtaatggagtagggaaagttaataaaggacttagtcggtagggaccttcgggtaggaacggggtcctagttccacctagtcctacgaagacgactaacctaccgaaagaacctcttcgttacgtttacccaacgtaaagtacgaacgacgtcctagggacggtacgggaccggaaggaccgaccggggtacaggtttacgttaacgtttaccggtggtacggtacggaagtacggtactacggactacggttaacggaaccggttaacggggtaatttcgg

SEQ ID NO: 189452 - DNA, 651 bp, Homo sapiens
  misc_feature: GYAE6OF02JS2NG.22.86.H09.1.454.CMB.1.raw
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagacatacgcgtcacgaccggtgctcgatttagtgctatagacttgggtttggggagtaggagcccagcactagaagtcggcgtgtttccattcggtgatcagcactgaacacagaggctcaccatggagtttgggctgagctgggttttcctcgttgtctcttttaagaggttgtccagttgtcaggtgcagcgttggtggagtcgtggggagcgtggtccagccgtgggagtccctggagcctcgtcctgtnacngcgtctgaattcgaccttnagtgctatggctgcgtcacttcggcctccgacctggcccgtaccgggaccgaggggccgtgggacggtgggtacggactaaatttacggtagtgacgtttagacgtaggtaagtaaanaaacggtnttagagttccggaatccgggttagaacgggtacgtacgttcgacgtactccttaacgagaaccgaacgttaacccaaccgtaaactaaccgttaacctacgtttaccgtttaccttaaccaagtttaaccgaaactaccgtacccgtaaggaaccgcggtaagaacgaaccgacgtacgtacgttagtacgttacgtcgttaggacgtagacgtagttcgactagtacgacggtaaggagtttaccg

SEQ ID NO: 189453 - DNA, 682 bp, Homo sapiens
  misc_feature: GYAE6OF02G1GDR.22.86.H09.1.454.CMB.1.raw
tcagacatacgcgtcacgaccggtgctcgatttagtgctatagacttgggtttgggggctttgcctgggctctgctcctcctcagcctcctcactcagggcacaggactccgtggcctcagtcctgccctgacctcagcctcgctcagtgtccggtctccgtggactagtcacgtccaccgactccgtacctaacacgtacggaacccagacgtagtgacgttcggttggttagttaactaactagtcgtcctccgtacgtaacccaacaaccgtacccgagaccaaaccgaccccaatcatacgtacttagtaggacgtacacgtacgccgacctcgacggtcctagacgtcgtcttccgcgtcgtacctactacgtcgaccgacaaccgtccgccgtaccgtacgtaccgttcgttcgcggtaccgtcgtaggtcgtagaacggtcgtacggtacgtacgttacgtacgtttactcgtacgtacgaccgtctagtaacgtacgtacggacacgtacggtactaacggttcgttcggtcggtacggtcggtacgaccgtaggtaccgtaccggtaccgtcgttaccggaccgaccgaccggacgtccgacccgtcccgtaacggtcctaccggttcccgtacccgttccccgactcccttgacccgtcgtaccgcgtaccg

SEQ ID NO: 189454 - DNA, 928 bp, Homo sapiens
  misc_feature: GYAE6OF02IA0RQ.22.86.H09.1.454.CMB.1.raw
tcagacatacgcgtcacgaccggtgctcgatttagtgctatagacttgggtttgggggctttgcctgggctctgctcctcctcagcctcctcactcagggcacagggtcctgggcccagtctgccctgactcagcctccctccgcgtccggtctcctggacagtcacgtcaccatcctccgtgcaccgtaggaacccaagcgtacggtacggtaccggtttgggtacggtttaaccaaagttacgtcgtacctacccgttacgggttaacccaaaccacccgaacccgtaggacccaccgtaaccgacccccctaaaaatccgtaatacggttatttacggtaacggaccggttacaaccggtaacgggtaccggtccgttaccgggtaacggggtcccctaaggtacgttccgtcgtttacctcggtacggtaccctacgaacggttcgtacgggtacccacggtaacccggttccctaccggtccgtaccggttctcccgggtacgggtcctacccgggtgtacgtcggaacgggttagaccggggtaacgtaccggtaggtttaaaccttttacggtaccgtaccgggtaccttttacccgtaacgtttaaacgtcggttaaccgggacggtaccgggtacccggtaaccggttaacgggttccggggtttaccggggtttaccgggggtaacgggaccgggggttaccggttaacccgaacggggttcccgttaacccggggtacccgttaccgggtaacgggtccccgtaaccgggtacccggttacgggaccccgttacccggttacccccgtaacggggtcccttaaccggtccgtttcccccgtaacccgtaccccgttccggtaaccgtcccggttaccgtacgtccggttacggtacggacccgggttcgtacccggg

SEQ ID NO: 189455 - DNA, 746 bp, Homo sapiens
  misc_feature: GYAE6OF02GN8ED.22.86.H09.1.454.CMB.1.raw
  modified_base (156)..(156): a, c, t, g, unknown or other
  misc_feature (156)..(156): n is a, c, g, or t
  modified_base (190)..(190): a, c, t, g, unknown or other
  misc_feature (190)..(190): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttccncgttgctcttttaagaggtgtccagtgtcaggtncagctggtgagtcgtgggggagcgtggtccagccgtgggacgtccctgacgctctcctgngcagcgtntggattcacttcagtggctagtggctagtcgctacgtggccttccggaccgtaggcccgtccgggagaacggggtctgggagtgggacggctaatttagtagtggtaacgtgaagttacgggtaaagttaaacgtaaacggtactttaagttacggggtaggttaacccgtccgggtttaagggaaaccggggtacccggttaaccgtttacccgtaaaccgtacgttacccgttaacccgaacggtaaacgtaaaccgtaaacccgttaaaccgaaacgtaaaaccgttaccgttacccgtttaccgtttaaccctaaccgtaaaacgttacgaaaccgtacggtacgtacggtaacgtacgggaaccggtaacgaaccgtaaccggtacgtaacggttacgttacgttacgtggtaacggtaccgtaaggtacggtaacgtaacggtcgtaacgtaacggtaaccggttaacggggtactttacgg

SEQ ID NO: 189456 - DNA, 758 bp, Homo sapiens
  misc_feature: GYAE6OF02G6BWW.22.86.H09.1.454.CMB.1.raw
  modified_base (313)..(313): a, c, t, g, unknown or other
  misc_feature (313)..(313): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcgaccttcagtggctatggcatgcacgtggcctccgcaggcgtccgggnaacggggtctgggagtgggtgactaagttatagtggtatggtaatcgggaaattaacgtaaaaggacttaagtggtacggtaccttccgggtaaggaacgggtcccgtaatttacccgaaccgtaacgttcccgtaaccgtaaggtaaccgtaacccgtaaacccgttaccccgaaaaggtaaaacccttaaccgtttaccctttaacggttttttaacccaaaccccgttaaaagttacccggaaaaccgtaaccggtacccggttaagggaaaccggtaaccgggggtaaccgggaaaccgggtacccggaaacgggtaccgtaagggtttacgttaacgtttaaccgttacggttaacgggaccgggtaaggtaacggtaaccgttaaccgggtaaccttaacggttacggtaaaccgggttaaccgggtaaggttttaccg

SEQ ID NO: 189457 - DNA, 594 bp, Homo sapiens
  misc_feature: GYAE6OF02FTOIT.22.86.H09.1.454.CMB.1.raw
  modified_base (235)..(235): a, c, t, g, unknown or other
  misc_feature (235)..(235): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgattgttggtggttataactatgtctcctggtaccaangccaccaggcaaacgccccaagactcatcctatttatcgctgtacaataagccggccctcgagggtccctgactcgcttctctcgctcaagtctaggcaacgacggcctcctacaccatctctgggcctccgagctagaacgagtcgaggctgaatttactacgtgtctcgctctatttgacagccgtactacgtacgttgggttcgtcgggtacgggacggaacaacgcgtacggacccgtcgtaggtccaccggtacccgaacgggtccctaccggaccccccgtcgggttaccctaacccgttccgtttacccggttcccccgtccccttacccggtacccgtaccggttacccgg

SEQ ID NO: 189458 - DNA, 632 bp, Homo sapiens
  misc_feature: GYAE6OF02JJRMB.22.86.H09.1.454.CMB.1.raw
  modified_base (174)..(174): a, c, t, g, unknown or other
  misc_feature (174)..(174): n is a, c, g, or t
tcagacatacgcgtcacgaccggtgctcgatttagtgctatagacttgggtttgggggagaggagcccgagcactagaagtcggcggtgttccattcggtgactcagcactgaacacagaggactcaccatggagtttgggctgagctgggttttcctcgttgctcttttaagnggtgtccagtgtcaggtgcagctggtggagtcgtgggggagcgtggtccagcctggggaggtcccctgagactctcctgtgcagcgtctggattcacttcagtggctagtggcatgcacgtggcctccgcaggtcaccgggcgaaggggctagggacggtgggtcggactaattagagttggataggataggaaaggtaaataaaggactaagtggtacggacttccggagaacggggcctacgtacaccatctcgaagacgaacaaacctcgaaagaactacttactagttacctaacctaaagtacgtaacgacgtacccgtaggaacggtacggacgtaacgggaaccgaccggtaacgacggttacgttaagtaccgttcgggaggtaaccggtaagtaacggtaaccgttacgaactaaggtacggaaaaccggttacgggaagttttaccgg

SEQ ID NO: 189459 - DNA, 766 bp, Homo sapiens
  misc_feature: GYAE6OF02H9HC1.22.86.H09.1.454.CMB.1.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcggtgggggaggcggtggtccgagccgtggggacggtccctgagactctcgtgtgcagtccgtcgtggtacttccaccttcgnggtcggcttagnggacatcgctacgtcggcctcccggccgacggtcccgtccggggacggaacgggggtcgtcggggtagggtcggggtaggactaagtttagtagtagggttataggtaagtaagggtaaagttaaaagtaaaacgtcgttaagttacgggttacggtaacccgttacgggtacggggtaaaccggggcccgtaaaccgtttacccgtaaacccgtacgttcccgttaaacccgaaggtaaaccgtaacctaaaaccgttacccgaaaaacggtaaccctttaccgtttacgttaccgtttttaacccaacgtaaaacgtacgtaaacccgtacgtccgtaagggtaacggaacggaccgggaacggaccgacgggtacgtaggttacgttaacgtttcggcggtaggacggtaagtcggtaacgtccgaagtcggttaacggtaccggtaaacgggttatttacgg

SEQ ID NO: 189460 - DNA, 817 bp, Homo sapiens
  misc_feature: GYAE6OF02HNMBX.22.86.H09.1.454.CMB.1.raw
  modified_base (120)..(120): a, c, t, g, unknown or other
  misc_feature (120)..(120): n is a, c, g, or t
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
tcagacatacgcgtcacgaccggtgctcgatttagtgctatagactttgggtttgggggaggcgtggtccagcctgggaggtccctgagactctcctgtgcagcgtctggattcaccttnagtggctatggcatgcactggctccgccaggctccgggcaaggggctggagtgggtggcaattatagtggtatgatggaagtaaataaagactatggtaggactccggtagaaggcattcacatctcagagacaacnccaagaacactctgttctaccaatagaacagcgtgagaggcgaggacacggcagtntattacgtgtgacgagagatacgaacagtacgaacgtaacgggaaaacgttcgttttagaacgttcgtacgtacgggggacccgaaacggggtactaacgttcgggtacctaacccggttaccgtactttaccgtaccgtaccctacccgaacccggtaaaccggggacccctaacgggttacccggttaccccgtttaccccccggttaccgggaccccgttccccggttaccggtaccccgttacccgggaaaccggggtacccgtaccccgtaaaccccggttacccggaaacgggtaacccgtaaccggaaacccggaaccgggtaacccccgggttaccccggggtttaccggggtaccggtttaaacccgggtaccggtttaccggggttaaacccgtaaacccgggttaaaccccggttttaacccgttacccccggtaaaccggttaccggtttaacgttaccggggtttaccggttaaccgggtaacccgggggg

SEQ ID NO: 189461 - DNA, 719 bp, Homo sapiens
  misc_feature: GYAE6OF02IA4NT.22.86.H09.1.454.CMB.1.raw
  modified_base (201)..(201): a, c, t, g, unknown or other
  misc_feature (201)..(201): n is a, c, g, or t
  modified_base (328)..(328): a, c, t, g, unknown or other
  misc_feature (328)..(328): n is a, c, g, or t
tcagacatacgcgtcacgaccggtgctcgatttagtgctatagacttgggtttggggagaggagcccagcactagaagtcggcggtcgtttccattcggtgatcagcactgaacacagaggactcaccatggagttgggctgagctcgggttttccctcgttgtctcgtttaagaggtcgtcagtgtcaggtgcagctggnggtagtcgtggggagcgtggtccagccgtgggacgtcctgacgactcgtccgtgtgccaggtccgtcgtaggtacttccgacttcgaaggtcggtctagtcgcatcgactcgtcggcctcccggacngggtcccaccgggcgaacggggtcgtacggggtacggttacggggtccgtaacttaaagttcgttaacgtggttagtacggtaacgtacgggtaaaagtaaacgtaaaacggttctaaggtacggttccgggtaaacctacggggtacggtaaccgggtacgtaccgttacccgtaacgaccgttaccgtacccggtaacggtaacctaaaccgtaacgtaacccaaaccggtaaactaccgttacgttaccgttaccaaacgtaacgtaccgtaacgcgtaccgtaggaacggacggtacgacgggtaacgaccggtagtacgaccgttacgtaagtccgtaggccgtaagaccgtcgtccaagtcgtaacgtcggaacggagttaaccg

SEQ ID NO: 189462 - DNA, 675 bp, Homo sapiens
  misc_feature: GYAE6OF02JA8BL.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggacgtccctgacgacctcctccgtgtgcagccgtctggattcaccttcaggtggctagtggcagtcgctacgtggcctccggccacgggccgtcccggggacgaacgggggcgtggggacgggttggggtcggacgtaaagtttagtagttaggtaagtggtaaggtaggtaaagttaaaagtaaaagactttaagtagtacggtaccttccggtaggaacgggtccgtacttaccacctactcctacgacggaacgaaccgtaacctaaccgaaacgaacctaccgttactttcgtttacctaactaaacgtacgtaaacgacgtaccgtagacggacggacgaacggaccgacggacgtagtagttacttacggtaggttacgacggtagtaacgtacgtaccgacgtacgtacggtaacggttaacggtaagtttacgg

SEQ ID NO: 189463 - DNA, 757 bp, Homo sapiens
  misc_feature: GYAE6OF02GZ7WP.22.86.H09.1.454.CMB.1.raw
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
tcagacatacgcgtcacgaccggtgctcgatttagtgctatagacttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctgagactctcctgtncagcgttcnggattcaccttcagtggctagtggcatgccncgtggcctccgccgaggccgtaccggggcgaaggggcgtagggagggttggggtaggacttaagttacgtagttgggtaatcggtaagttacgggaaaagttaaaataaaggtacttaaggttggtacgggaccgtttaccgggtaggtaaacggggtacccgttaacttacccgtaaccctaagtaccccgttaccgaaaggtaacgaacctaaaccgtaacccgaaacgtaaccgtaccttttcgttacgtttaccctaaccgtaaaagttacgaaaacgttccgaccggtaagtaacggggacgtaacgggtaaaccggaccgtaacggggtcgttaacgggttacgtttaacgttacgggtttcgggttaggaacgggttaacgggtaacgttaccgggtacggtaacgtaacggtttaaccgggtaaccgggtttaaacggggtaaaccgttttacgg

SEQ ID NO: 189464 - DNA, 803 bp, Homo sapiens
  misc_feature: GYAE6OF02IP0MK.22.86.H09.1.454.CMB.1.raw
  modified_base (263)..(263): a, c, t, g, unknown or other
  misc_feature (263)..(263): n is a, c, g, or t
  modified_base (723)..(723): a, c, t, g, unknown or other
  misc_feature (723)..(723): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagcgttgggttttcctcgtttgcttacttttaagaggtgtccagtgtcaggtgcagctggtggagtcgtgggggaggcggtggtccagccgtaggggagtcccctgacgacctctccgtgngcagccgtcgtggactttccaccctttcagtggacctagtggacctagtgctacgtcggacgtcccggccgacgggtcccgtcccgggggacgaacggggggtcctggggaaggttcgggggtaggaccgtaaagttttgtacgttagggtacgttaggtaagttacgggaaaagtttaaaacttaaaaggtactttaaggtacgggttacggggtaaccctttacccgggggtagggtaacgggggtaaccccgtaaccgtttaaacccgaaccggtacctttacccggaacccaacgggaaaccgtaaaccgtaaacccgtaaaagaaacccggtaaaccctaacctttaccgttttaaccgtttaccctacccgtaaaagttacgaaacgtcgtaccgtaggaacggaggacccggaacggaaacgtccggactaaggtttacgttagtttaccggnggttcggaaccgtaaggaacgtaaccgttacggaaccgtaggtaacgggtaacccggtaacgggtaaaccggttttcggg

SEQ ID NO: 189465 - DNA, 620 bp, Homo sapiens
  misc_feature: GYAE6OF02ICDFI.22.86.H09.1.454.CMB.1.raw
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (529)..(529): a, c, t, g, unknown or other
  misc_feature (529)..(529): n is a, c, g, or t
  modified_base (543)..(543): a, c, t, g, unknown or other
  misc_feature (543)..(543): n is a, c, g, or t
tcagacatacgcgtcacgaccggtgctcgatttagtgctatagacttgggttttgggggctttgcctgggctctgctcctcctcagcctcctcactcagggcacagggtcctggcccagtctgccctgactcagcctccctccgcgtccgggtctccgtggacagtcagtcaccatcctcctgcactaggaccagcagtgacgttggtggtataactatgtctcgtgtaccaacaacaccaggacaacgaccccaatcatgtatttagagtacgtacaactacgccggtcctacgacgggtcctgactcgtcttacgtcgtgactacgatcgtcgacacgacgtcctcctgacctcncgtcggcctcgagctggaacggtcnggagtcgtagtacttagttaacgcgtacgagtcctaactagtacggtaggtacgagtacgaacgtacgtttaaggttcggttcggtacggacgggtaacgacgacggtcgtaccgacgtccgaggtcacgtaccgagtccgttaccnccggttacgtaccnccgttacgtccccggtccctacccgtcccgtacgaccggttctacggtaccgtccggtaggccccgggtggtaccgg

SEQ ID NO: 189466 - DNA, 591 bp, Homo sapiens
  misc_feature: GYAE6OF02IU4YK.22.86.H09.1.454.CMB.1.raw
  modified_base (286)..(286): a, c, t, g, unknown or other
  misc_feature (286)..(286): n is a, c, g, or t
  modified_base (521)..(521): a, c, t, g, unknown or other
  misc_feature (521)..(521): n is a, c, g, or t
  modified_base (533)..(533): a, c, t, g, unknown or other
  misc_feature (533)..(533): n is a, c, g, or t
tcagacatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctaccaaatgaacanacctgagaggcgaggacacggcacgtgtattactgtgacgagagatcgacatgaacgtagggaaatcgttttagatctcgttaggggaccaaaggggacacgtggtcctaccgtctcgttacacggtccctccaaccaaacgggtccccaacgttcccggtacccgtttccccctcgggcccgtcccgtcgcccgttaccgcggaaccgtccacccgttaccgacgacgacaccncgacccgcccgnggccgtcgccgtagtcgaacgtaccttaccgtccgacgccgtatcgtacttcggacgg

SEQ ID NO: 189467 - DNA, 832 bp, Homo sapiens
  misc_feature: GYAE6OF02FNYHG.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacgactctcctgtgcaggcgtctggacttcaccttcgagtggctagtcggctagtcggcacgtcggcctccgaccgacggtccgtaccggggtacgaacgggggtctaggggacggtggggtacggactaaaagtttagtagttcgggttaagtcggtaagttagggaaaagttaaaacgtaaaaggtaccttaaggtacggtacgggtaaccgttaccgggtaagggaaaccgggggtacccgtaacgtttaccgtaaaccgtacgttaccgtccgtaaacggaacggtaaaccaaaccgttacccgaaaacggtaaaacctaccgttaccgttaaccggttttccctaaacccgtaaaacgttacggaaaacccgtaaacggtaccgttaaccggggaaggttaaccggggaaccgggtaaacggggtaaacccggaacgggtaccgtaaggtttaaccggtttaaacggtttacgggtttaacgttaaccggggtaccgggtaaacgggtaacgggtaacgtttaaaccgggaaccgttaaacggttacgggtaaacccggttaaacccgggggtaaagtttttaacccgg

SEQ ID NO: 189468 - DNA, 838 bp, Homo sapiens
  misc_feature: GYAE6OF02JMK8Z.22.86.H09.1.454.CMB.1.raw
tcagacatacgcgtcacgaccggtgctcgatttagtgctatagacttgggtttggggaggaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggaggcgtggtccagccgtgggacggtccctggagactctcccgtgtgcgagccgtcgtggattccaccttcagtggtctagtgggcacgtgtccacgtgggtcctccggcccgtacgggtccggtcccggggtaccgaaagggggggccgttcgggggtaagggtttcggggggttacgggtaccgtaaaagttttaagtaggttaggggttaaagtttaggtaacggttaggggtaaaaagggttaaaaacgtttaaaagggtaaccttaaggttttagggtacgggggtaccgttacccgggttagggggtaaaccgggggtaccccgttaacgttttacccgaaccgttaacggttaccccttacccggaagtaacccggtaaacgtaaacccgttaacccaaacggttaaacccttaccgtttaccgtttaccgtttaacccgttacccgaaacgttacggtaaaccgaacgtaccgttacgggaaacggtacgggtacggaacggtaaccgacggtacgtaaccgggtttgttaacgttaccggttacggacggtaacggtaacggaacggtttagaaccggacgtaacgtaaggtaacccgggttaaggtaacggtttaacg

SEQ ID NO: 189469 - DNA, 666 bp, Homo sapiens
  misc_feature: GYAE6OF02J2YWD.22.86.H09.1.454.CMB.1.raw
  modified_base (181)..(181): a, c, t, g, unknown or other
  misc_feature (181)..(181): n is a, c, g, or t
  modified_base (197)..(198): a, c, t, g, unknown or other
  misc_feature (197)..(198): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
  modified_base (610)..(610): a, c, t, g, unknown or other
  misc_feature (610)..(610): n is a, c, g, or t
  modified_base (650)..(650): a, c, t, g, unknown or other
  misc_feature (650)..(650): n is a, c, g, or t
tcagacatacgcgtcacgaccggtgctcgatttagtgctatagacttgggttggggctttgcctgggctctgctcctcctcacgcctcctcactcgagggcacaggatccgtgggctcagtcgtgccctagacctcagcctcgctctagtcgtccgggtctccgtggacagtcagtccacntcactacacgtgaccnncagtgatggtgacgttanactatcgtntccgtagtaccatcgactaccaggaccaaacgtccccatcctaccgattcctaagttccgtntcgtacgtacgtaacgtacgtcccgtaccgtccgtacgggtcctggtacttccgcgttatccgtaacggctacgtacggtcaggtaccacgccggtacccnggtccacggtactcgtacgcggtcnccgtggactagacgtgacgtacgtcgttaatcgttaacgtcgtccgtcgttcggtaactcgttcgttacccgcgttaacccggggtccttacgtaacggttccggttcggggtacgtccggtaaagggccgttaaccgagtcccgggttacctcggtaccggtcgtaccgacccgttaccgtccggacccggttccncccggttacgacctaccggtccgttcccggacccgttccncccggttcaccggtcg

SEQ ID NO: 189470 - DNA, 780 bp, Homo sapiens
  misc_feature: GYAE6OF02G2HZ6.22.86.H09.1.454.CMB.1.raw
  modified_base (175)..(175): a, c, t, g, unknown or other
  misc_feature (175)..(175): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagacatacgcgtcacgaccggtgctcgatttagtgctatagacttgggtttggggagaggagcccagcactagaagtcggcggtgtttccgattcggtgatcagcactgaacacagaggactcaccatggagtttgggctgagcgtgggttttcctcgttgctcgttttaagnggtgtccagtgtcaggtgcagctggtggagtcgtgggggagtcgtggtccagccgtgggacggtccngacgtactcgtccngtcgcaggtcgtcgtggtacttccaccgttcaggtcgacttatcggatgtcgctacgtcggccttacccggaccgtacgggtcccggtaccggggacggtaacggggggtccctaggggtaacggggttcgggtacggtaaccgttaagttttaacgtacgttggggttaactagggtaacggttaacgggttaaaaagtaaaacgtttaaaaacgccgtttaggtttacgggtaccgggtaaccttacccggggtaagggtaaccgggtacccgttaaactttacccgaaactaacgtccgttaaacgaacgtaacgaaacctaaccgtaaccgaaacgttaaccttacgtttacctttacgttaacctaaacctaagtaacgtaaccgtacgtcgtaacgaacggtcgggaacgtaccggtaacgaacgtcggtaacgtttcgtaacgttacgtaggtacggtacgtaagtaagtaccgtaacggtacgtaagtaccggtaaacggttacggtaagtttacg

SEQ ID NO: 189471 - DNA, 626 bp, Homo sapiens
  misc_feature: GYAE6OF02FZ6M7.22.86.H09.1.454.CMB.1.raw
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (553)..(553): a, c, t, g, unknown or other
  misc_feature (553)..(553): n is a, c, g, or t
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtcgtccggtctcctggacagtcagtcaccatctcctacacgtggaaccagcagtgattgttggtaggttaataacttatcgttcctccgtacggtaccaacgtcgacccaccgaggaccaaccgccccagacctacgactactatttancgtctgtacaagtacgccggtacctcggtccgggtccngtactcgtcgttctcgtcggacctacgtagtcgtcgacctacgaccgtccctccgtacgacctacgtcgtccgtcgtcctaccgacggctagaacgtgtacggacggtacttagtaactttacgtcgtcgcgtacgtcctgttacttcggacgtcgtcctaccgtcgtcgggttggtccggtcgggacggacgacgtagcgtacgtccgtacgtacggaccncgtaccgaggttccacccgtcccggtacgttccaccggttcctcccgttaccccgcctaccgtccgaccgtcg

SEQ ID NO: 189472 - DNA, 640 bp, Homo sapiens
  misc_feature: GYAE6OF02JPOGZ.22.86.H09.1.454.CMB.1.raw
  modified_base (155)..(155): a, c, t, g, unknown or other
  misc_feature (155)..(155): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (364)..(364): a, c, t, g, unknown or other
  misc_feature (364)..(364): n is a, c, g, or t
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
tcagacatacgcgtcacgaccggtgctcgatttagtgctatagacttgggtttggggagaggagcccagcactagaagtcggcggtgttccattcggtgatcagcactgaacacagaggactcaccatggagtttgggctgagctgggttttccncgttgctctttaagnggtntccagtntcaggtgcagcttggngtagtcgtgggggacncgtgtccagcgtgggacggtcccnggacgctccacgtgnccaggcgttnggtacttccgactttgaggtcggtntagtcggactcgtcgtaccgacggtccgtaccgtcccggacgccgggtcccggggtaccggaacgggtaccggggtntaaggggttccgggttagggtccctaaagttaactaagttcggttaggtagttaacgtgggtaaaagttaaggtaaaactaacggtgttaggtacgggactacccgggtgtaacgggcggtactacgtacctaaactcgtccaagtanacgtaaacacccgaanaacgtacgttactcggttactactaacggatacagtcagtcgaggcgngacgacgntacgntatctagtggcctaggacttagctacgactagtacgaggaacgttcgttag

SEQ ID NO: 189473 - DNA, 864 bp, Homo sapiens
  misc_feature: GYAE6OF02H8WFP.22.86.H09.1.454.CMB.1.raw
  modified_base (490)..(490): a, c, t, g, unknown or other
  misc_feature (490)..(490): n is a, c, g, or t
  modified_base (560)..(560): a, c, t, g, unknown or other
  misc_feature (560)..(560): n is a, c, g, or t
  modified_base (600)..(600): a, c, t, g, unknown or other
  misc_feature (600)..(600): n is a, c, g, or t
tcagacatacgcgtcacgaccggtgctcgatttagtgctatagacttgggtttgggggctttgcctgggctctgctcctcctcagcctcctcactcgagggcacagggactccgtgggcctacgtagttctccgtcccgtagtaccgttcacgtccgtccgtaccttacggtaggttccggtcccgggttacctaccggtacggaaccgtacgttccgtaacgttacccaaccttacgttcccgtaaccttaaccgtacgtaccgggaaacctaggtacgtaaggttagtacgtttgggtttacggttacgtttaaactaaccgttcgttcgttacccgttacggttaaccggtaaaccaacgaccggaacccgaccggaacggtaaccaaacccgtccccgtaagtaccctacgtacgttactttacgttaagtcggtaacttagtaaacgtaaacgtccggccccgtacttacggggtaccggtaccngtaccgttccgtactttcgtacggacgaccctttacgcggttcgacgaacctacccgggtccgtttaccnccgtaacgtacctacgttcggtaccggtcggacctacggnggtaaccgaggtacgtacggtggtaccgttagttacgtttaagtacctaggcgttccgacttcgtacttaggtacgtcgaccgtaccttacggtacgttacgggttcgggttaccgggacggaccggtaacgtaccgtacgtccgttaccggaccttaccggttcggaaccgacccggttacgaccggttcccaacccgggtttccgaaccgttaccgtcggttacccgtcccggcccttacgttcccggacggtccgttaccg

SEQ ID NO: 189474 - DNA, 729 bp, Homo sapiens
  misc_feature: GYAE6OF02G0CZ6.22.86.H09.1.454.CMB.1.raw
  modified_base (155)..(155): a, c, t, g, unknown or other
  misc_feature (155)..(155): n is a, c, g, or t
  modified_base (163)..(163): a, c, t, g, unknown or other
  misc_feature (163)..(163): n is a, c, g, or t
  modified_base (302)..(302): a, c, t, g, unknown or other
  misc_feature (302)..(302): n is a, c, g, or t
  modified_base (441)..(441): a, c, t, g, unknown or other
  misc_feature (441)..(441): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggtttccngttgcttnttttaagaggtgtccagtgtcaggtgcagctggtggagtcgtgggggagcgtaggtcagccgtgggacgtccctgacgacctccgtcctgtacgcagtccgtaccgtggacctttcaccctttcgagttggtacttagngggaccagttcgaccgtacggtcggtccctcccggccggtacggcccgtaccgggggacggaacggggtcgtaggggcggttggggtcgaacttaaagttactaggtacggtaagtggaagttaagggaaagttaaaanaaacggtactagtagtacgggtaccggttacgggtacgggaacgggtccgtacgtaccaaccgtactaccgtacacgaacgaaccctaactaccgaaacgaacctacgttccttacgttacctaactaacaacgtaacgacgtaccgaggtacgacggggacgtaacgggaccgaaccgggcgttaaggttacgttaccggttaacgtcggttaacggagggtaacgaacggtaccgtaacgtcgtaaacggttaacggaaacgggtttacgggtaaacgttttccgg

SEQ ID NO: 189475 - DNA, 964 bp, Homo sapiens
  misc_feature: GYAE6OF02F7DTK.22.86.H09.1.454.CMB.1.raw
tcagacatacgcgtcacgaccggtgctcgatttagtgctatagacttgggtttggggggaggcgtggtccagcctgggaggtccctgagactctcctgtgcagcgtctggattcaccttcagtggctatggcatgcactggctccgctaggctccgggcaagggctggagtgggtgcaattatagtggtatgagtaggaaagtaaataaagactagtagtcggactccggtaggaaacgggtccgaatttccgaacctacttaccctaccgaaaggtaacgaaccgaaaccgtacccgaaaagtaaacctaccgttacctttacgttttacctaaacccgtaaaattcggaaaacctacgtacccgttaggaaacgggaacggggtacggaaacgggtaacccggaaccgggtaccgtaaggtttacggtttaacgtttaaccggtaggggttacggaacgggtaacggtaaggtaaacgttacccggaaacctaaggttaacgggtaaaaccggttaaaccgggggtaaaacgttttccggtttttaaggaaccgtttaccgttaccggggtaccggggggtaaaccccgtaaaaggggtaccccttaacggggttacggttaacccgtaacccccggttttcgtaaccgtttcccggtaacccgtccccgttaaacccggaaacccgggtaaacccggggtccccttaacggtttccccgggttaccccgtttcccccggtaccgggtccccgtacccgttaccggtcccgtaacccggtaacgggacccttaccccggtacccgtacgggaaccgtaccgaaccggtaaccggaccgggtacccgggtaccccggttgggtacccgtaccgggtacccggttacggttaacccggtaaaccgggttcccttaccgttaccccgaggttaccggttacgttacggtacgttacgggaccggg

SEQ ID NO: 189476 - DNA, 742 bp, Homo sapiens
  misc_feature: GYAE6OF02G81Z9.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggtccagccgtgggacggtccctgagacctcgtcctgtgcgagtcgtctggattccgaccttcgagtggcttagtggcatgcagtcggcctccggcaggccgtccggggacgaggggcctaggggaggttggggtcgtaacgtaattacgttagtgggttaatggaagtagggtaaactaaagtaaagtacgttaatgggttacggaccgttaccgggtagggaaccggggtaccttaacgttacccaaccgttacgttaccgtacccgaagtacgtaacctaaccgtaacccgaaacgtaacccttaccgttacgttaccgtttaccaaaccgttaaactacgtaaacgtaccgtaccgtaggtacggaaccggggttacgacccgggtaaacgaccggttacgtaaggtttagttaacgtttaccggttaggtaccgggtaacgtaaacgggtaccggtaacgtcggtaaacccggtaggttaacccgggtaaacggtttaaccggggtaacgttttaccgg

SEQ ID NO: 189477 - DNA, 677 bp, Homo sapiens
  misc_feature: GYAE6OF02JO10B.22.86.H09.1.454.CMB.1.raw
  modified_base (149)..(149): a, c, t, g, unknown or other
  misc_feature (149)..(149): n is a, c, g, or t
  modified_base (186)..(186): a, c, t, g, unknown or other
  misc_feature (186)..(186): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
  modified_base (572)..(572): a, c, t, g, unknown or other
  misc_feature (572)..(572): n is a, c, g, or t
  modified_base (618)..(618): a, c, t, g, unknown or other
  misc_feature (618)..(618): n is a, c, g, or t
  modified_base (658)..(658): a, c, t, g, unknown or other
  misc_feature (658)..(658): n is a, c, g, or t
tcagacatacgcgtcacgaccggtgctcgatttagtgctatagacttgggtttgggggaggaggagcccgagcactagaagtcggcggtgtttccattcggtgatcagcactgaacacagaggactcacatggaggtttgggctgacgngttgggttttcctgttgattacgttttaaggaggttntccgtagtcgtcaaggtgcaggtctgggtaggnggttccggngggggngcggtggtccaggtccgtaggggtcgtccgaggacgtacctccgtccgtggtnacggccttacggccttggactttccaccgttataggtggcttaaggccggtnaacgngtcgtacggtcgccgtccccggacgaccggtcggcccgggaggttaaccgggcggttaggcggtgggttagaccgttaagttaggtaccagggttntaggtagttaacggtaagaaaaccgttagtagtaacgtaggttaacgggccttacccggggaagcgggtaccgtacgtacggactaacgtcgttacgaacgcgtaaccacgtacaaacgactaactcgttanacccgtagaactagactaacgcgtagaacggagtacggagacggtnaggactagtacgttcgtggactagaagactgtaccgagtntacgacggtagtacgtacg

SEQ ID NO: 189478 - DNA, 818 bp, Homo sapiens
  misc_feature: GYAE6OF02F2STR.22.86.H09.1.454.CMB.1.raw
  modified_base (190)..(190): a, c, t, g, unknown or other
  misc_feature (190)..(190): n is a, c, g, or t
  modified_base (295)..(295): a, c, t, g, unknown or other
  misc_feature (295)..(295): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctgttgctacttttaagaggtgtccagtgtcaggtncagctggtgagtcgtgggggagcgtggtccaggcctggggacggtccctaggactaactccgttcctggtacgcacggcgttacgtggtacttacctaccgtttnaaggttgccgttacgtgggtacctaagttcggcctaacggtcggtacccgtcccggtacccgaaccgggtcccggttacggggacgtaaaccggggggtcgttacgggggtacgggttcgggggtacggtaacgttaaagtttaacgtaaggttacgggttaaattaggaacgttaaagggtaaacgttaaaacggttaaaaacgacgttaagttaccggttaacggtacccgttaccggtaagggaaccgggtaccgaagttttacccgaacgtaccgttaccgtaccgaacggtaaagaacccgtaaaccgacccgtaaacgtaacctacgtttacctttaccgttaaccgtaaccgtaaacgtacgtaaccgaacggttcgaaggacggacggaggtaaccgacgttaccggacgttaaccgtagtttaaccgtagttcggaacggtacggtaacggtaacgtaacggtacgtaccgttaacgttaacggaaccggtttaaccgggtaactttacccggg

SEQ ID NO: 189479 - DNA, 783 bp, Homo sapiens
  misc_feature: GYAE6OF02JI26S.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactcggaaccagcagtgatggttggtgtatactatgtctccgtagtaccaacgcgccacccgtaggaccaaaccgtccccgagtacctcgtaatcctagtttacgtcgtcttacggtactaaacgtaaccggccgggtccccgtacggtaaccggggttccccttaggacccgttaccggtccgttcttccgtcgggtacctacccggtaacgttccgtaccggacctaaaccggtccgggtaccccttaccccgtacgtaacccgtaattcccgttaccggtccgggtaccctacccggaggtcctaaggtaaccgtagtaccggagtaccgtacgtactttacgtacgtcgttaccgtcgtacccgtgttacgttcgacgtaccggtccgtccgtttaaccggtggtttacgggtaccgggttccgggaaccgggtacgggaacccttaacgggtccgttccggttacccgtaccggtacggtaaccgtaccgacccgggtacgttcccgttacccgggttccccggtaccgggttaccctaaccgttccgttacccccggtttccccacccgttcccggtaccggtcccgttaaccgg

SEQ ID NO: 189480 - DNA, 700 bp, Homo sapiens
  misc_feature: GYAE6OF02H0V4I.22.86.H09.1.454.CMB.1.raw
  modified_base (201)..(201): a, c, t, g, unknown or other
  misc_feature (201)..(201): n is a, c, g, or t
tcagacatacgcgtcacgaccggtgctcgatttagtgctatagacttgggtttgggggctttgcctgggctctgctcctcctcagcctcctcactcagggcacaggatcctggctcagtctgccctgactcagcctcgctcagtcgtccggtctcctggacagtcagtccactatcctcctacacgtacggaccagcagtnattggttcgtaggtactaacgtatcgtctacgtcggtaccaacagccaccgagtaccaaaccgcccccagactaccattcctatttactcgtcttacgtaactaacgtaacgcccggtacccgtacggtccggggtccctaggtacttccgtccgtttaccctcggttaccggtaccgtccgtaaacgtcgtacggaccaaccggtcccggtacccttccggtacggacccttacgttaccggttacggccggtaccctaccggtacgggtaccgtaagtaacggcgttacgggtacggtacctttaaggtactttacgtacgtagtccgtcgtccttagtacgtttcgacgtacgtccgtaccgtacgtacggttggtaccgtcgggacgtacggcctagcgtaccggtaccgtcgtacgtccgaccgtaccggcgtaccgtcccgccgttccgaccttcgtaccgttccgttcccctaccgtcctccgtaagttccg

SEQ ID NO: 189481 - DNA, 921 bp, Homo sapiens
  misc_feature: GYAE6OF02HLK4Y.22.86.H09.1.454.CMB.1.raw
  modified_base (215)..(215): a, c, t, g, unknown or other
  misc_feature (215)..(215): n is a, c, g, or t
tcagacatacgcgtcacgaccggtgctcgatttagtgctatagacttgggtttgggggctttgcctgggctctgctcctcctcagcctcctcactcagggcacaggatccgtgggctcagtctgccctgactcagcctcgctcgaggtcggtccggtctccgtaggacacgtcacgtccaacctactccttacctaacctacgtacggaaacccnggtacctaggtgtagttcgggtttacgggttagtttaacgtaaccgttattccggttaccgttaccgtacggtaaaccctaacgaccgacccgaacccggtaaggaaccctaaaccccggcccccgtaagtaaccctaccgtaacgttaccgttaagtttacgtcggttacctacgttaactaaacggttaaccgggcccggtaccccgtacgggtaccggggttaccctaggtaccttccggttaccttccgtccggttacgtacccgttacccgtaggttccggtacgaacctaaccggtcccgttacccgtaccgtacggtaaccttccgttcggtaccgggttccggtacccgttacggaacgggttactaacggacgttcgtacgggtcgttaacgtcggtttaactttacggttacgcggttccgtactccgtttacgtaggttccggtaccgtaccggttcccgtaaccgtttacggtccggggtttacgggtcccgggtacggggtacccgggtaaaccgggtaccgaccggttcgttaaccccgggttaccttacggggtaaccggccgttaacccgggacccggtcccggtccccgtttccccgggaccccgtttacggttaccccttaccgggtttacccccgtttacccctacccccggttaccccgtttaaccggtcccgttaaccggttcgg

SEQ ID NO: 189482 - DNA, 853 bp, Homo sapiens
  misc_feature: GYAE6OF02ILR4P.22.86.H09.1.454.CMB.1.raw
tcagacatacgcgtcacgaccggtgctcgatttagtgctatagacttgggtttggggagaggagcccagcactagaagtcggcggtgtttccattcggtgatcagcactgaacacagaggactcaccatggagtttgggctggagcgttcgggtttttcctcgtttgcttacgttttaagaggttgtccagtgtcgaggtgcagcgtggtggagtcgtgggggagtcggttggtccaggcccgtaggggacggtcccctggacgtaccttcgtcctaggtgctaggtcgtcgtggactttccacctttcagtggactagtggacctagtgccgtacgttcggccttacccggcgtacgggccgttaccccggggaggtaaacgggggtcttaggggacggtttagggggtcgaacgttaagtttaagttaggttgggttaatcggaagttaggggtaaaacgttaaagtaaaacggtacgttaaggtcgggttacgggtacccgtacgggtacgggtaaacgggccccgttattacccgaaccgttaccgttaccgtaaccgaaacggtaaaccgtaacccgtaaaccgttacccgaaaaacgggtaaccccttaaacccgtttcgttttaaacggtttacccctaaaccgtaaaacgttcggtaaacccgttacggtacccgtaagggtaacggaaccggggtaaccgtaaccgggggtactaacccgggttattaaccggggtttacgttaaacgttaccggttaggtaaccggcgggttaaacgaaggttaccggttacgaaaccgtttggttaaacggtaacccgggtaaggggttaacccgtttacgg

SEQ ID NO: 189483 - DNA, 817 bp, Homo sapiens
  misc_feature: GYAE6OF02JM2TI.22.86.H09.1.454.CMB.1.raw
  modified_base (93)..(93): a, c, t, g, unknown or other
  misc_feature (93)..(93): n is a, c, g, or t
  modified_base (178)..(178): a, c, t, g, unknown or other
  misc_feature (178)..(178): n is a, c, g, or t
  modified_base (787)..(787): a, c, t, g, unknown or other
  misc_feature (787)..(787): n is a, c, g, or t
tcagacatacgcgtcacgaccggtgctcgatttagtgctatagacttggggtttgggggctttgcctgggctctgctcctcctcagcctcctnactcagggcacaggatcctggctcagtctgccctgacccagcctgcctccgtgtctggatcatcgtggactagtcgtatcgacgntactttcctcgcaccggtacgggaccaacgtaggtcgtacgtagtttaggggttccttttgaccttctcggttccttccgttacggtaccaaacaacccgcccgaaccgggacccctaaaccccccctaacttacctacttaccttattttaggtacggttacgtccgtaaccgttcccggtcccggtaccccttaccggacgggttacttccttacctaccgtacttccggttcttccgtacggtaccggtccttaccgtaggtccgtacggaacctaccgtacccgtccctacccttactacgtctcggtaccggtccttaccgttacgttacgacgggtacgtacgtttcctttaactttacgtaaccgtcgttaacgttaaccgttttaaccgtttaacggtaccgtccgttaaccgttaccgtccggtttaggtttccgggggtttaccggacgggtacggaccgtaaccggtacggttaaccgcccgtttaccgacgggtacctaccggacccgtaggtccccgtaccgtccccgttacgacctttcccgtaccggtttcccgcccgtaccctccgtccgttaaccgtcgttacgttccggtntaccgggtacggtccgggtagttacccggg

SEQ ID NO: 189484 - DNA, 1006 bp, Homo sapiens
  misc_feature: GYAE6OF02IOGCT.22.86.H09.1.454.CMB.1.raw
  modified_base (207)..(207): a, c, t, g, unknown or other
  misc_feature (207)..(207): n is a, c, g, or t
  modified_base (519)..(519): a, c, t, g, unknown or other
  misc_feature (519)..(519): n is a, c, g, or t
tcagacatacgcgtcacgaccggtgctcgatttagtgctatagacttgggtttgggggagaggagccccagcactagaagtcggcggtgtttccattcggtgatcagcactgaacacagaggactcaccatggtagtttgggctgagtcgttgggttttcctcggttgcttacgtttttaaggaggttcgtccagtgtcgtagggtncgagtcgtagggtggagttcgggtaggggggacggtccggttcgggtacccgagggtacccgttgggggtaccgggttcccccttaagggtaacgtacccgtttccctacccggtaggttcgaccgtacggtccggtttcggttacggtaaccttttacccggtacccgtttaccggaagggtttccggtaccgttaaggttcgggtacctaggtccgtaccggtaccggtccgggtcccgtacccggacccggttacggggtcccggtaccgggggacgtaacgggggtccggtagggtagggttcggggngtaacttaagttagtacggttaaggtacgtaagggaagttaaacggtaaagttaaaacgtaaacgtcgttaggtacggtaacggtaccggttcgggaagggtacccggtaccgtaccttaaccaccgtttaaccggtaccgaaaccgaggtaaccctaacccgtaaccttaaccggaaaaccggttaccgttaacgttttcccgttttaaccggtaacccttaacggaaacccgggtactaaccccggtacctaaccggggtaccggtaaaccgggtacggggtaacccgaaaaccggggtcccggtaaaccggttacggggtttttaaccggtttagggttaaacccggttttaccgggaacgggtttaagggggtaaacccggaacgggtttaagtaacccccggtttaagggtaacccttaaccggggttttaaaacccgggggtaaacccggggtttaagggttaacccgggtttttacccgg

SEQ ID NO: 189485 - DNA, 692 bp, Homo sapiens
  misc_feature: GYAE6OF02GHHGX.22.86.H09.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
tcagacatacgcgtcacgaccggtgctcgatttagtgctatagacttggggtttggggagaggagcccagcactagaagtcggcggtgtttccattcggtgatcagcactgaacacagaggactcacatggagtttgggctgagctgggttttcctcgttgcttcttttaagaggtgtccagtgtcaggtncagctggngagtcgtgggggagcggtggtccaggcctgggtaggccctgaagcctctcgtgtcgnagcgttcgtaggtnttaccaccttgaggttcgcgtatcggnagtcgacacgtcgggacctcccgacgcgggccggtaccccgggnggtaacgggggtctccggggtagttcgggggtcacgttaagttactaggtcggaaacgttgacggtaagggtaaagttaaacgtaaagtacgtttagtacgggtacgggtaccgtccggtaaggggtaccgggaccgttagtaccgaccgtagtcctacgaaggacgacccgaatacgaacaaacgtcgttcgtacgttaccactaaatcggtaaactccggacgttacggaggaccgggtacgtaaccgggcgaaaccgtggtaacgtacggtttctaacggtcggtacgacgtaggaacgtcggtaacgagtaaccggttacgacgggttaaccggtagtttacccggg

SEQ ID NO: 189486 - DNA, 686 bp, Homo sapiens
  misc_feature: GYAE6OF02FW13T.22.86.H09.1.454.CMB.1.raw
  modified_base (156)..(156): a, c, t, g, unknown or other
  misc_feature (156)..(156): n is a, c, g, or t
  modified_base (176)..(176): a, c, t, g, unknown or other
  misc_feature (176)..(176): n is a, c, g, or t
  modified_base (278)..(278): a, c, t, g, unknown or other
  misc_feature (278)..(278): n is a, c, g, or t
  modified_base (319)..(319): a, c, t, g, unknown or other
  misc_feature (319)..(319): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttccncgttgctcttttaagaggtntccagtgtcaggtgcagctggtggagtcgtgggggagcgtggtccaggcctggggaggtcccctgagactctcctgtcgcaggcgtctggacttcgaccttnagtggctagtggcatgcacgtggctccgcaggctccggganaaggggctagggcggtgggtgactaattacgtagtggtatggtactagggaaagttaataaacgtactagttcggtaggtacctccggtaggaacggggtccgtaacgttccaaccgtcgttacctacccgaaggtaacgaacccaaccctaccgaaactaacccgacctttacgttacggtttacccaactaaacgttacgaaacctaacggtcctaacggggaacgtacggggaaccggaacggaccggtaaccggtacggtaaggtttaccggttaatttaccggtcgggacgggtacggaaacggtacggtacgtccgaacggttagtaccggtaaccggttaacggggtaacgttttcccgg

SEQ ID NO: 189487 - DNA, 707 bp, Homo sapiens
  misc_feature: GYAE6OF02HU45O.22.86.H09.1.454.CMB.1.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
tcagacatacgcgtcacgaccggtgctcgatttagtgctatagacttgggtttgggggagaggagcccagcactagaagtcggcggtgtttccattcggtgatcagcactgaacacagaggactcacatggagtttggctgagcttgggttttcctcgttgctcttttaaggaggtgtccagtgtcaggtgcagctggtggagtcgtgggggaggcgtgtccagccgtgggacgtcctgagactctctgngcagcgtcgtggtacttcacttcgnggtcgcgtagtcggacagtgactgcggcctccgacgcggccgtccgggacgaagggctagggaggtcgggngacgtaaattgtagtggtatgaaggtacgaaagtaataaacgtcgtagttaggccggtacgtacggtagggaacgggtcgaacgtttacgaaccgtacgttaccgacgtaaacgggaactaaccctaaaccgtaaccgaaaacgtaaccgtttacgttaccggttaacccgtttttaacaccccttaaaagggaaacgttaaacccgtaccgtacccggttaggtaaaccggacgggaaccgaaaccgggaccgtaacggggactaacggtttagttaactttaccgggtaacgtccggggaagacgttaaacgcccggttagacttaaggaaccggtaacgtaacggttacgtttaacgg

SEQ ID NO: 189488 - DNA, 865 bp, Homo sapiens
  misc_feature: GYAE6OF02FHQR6.22.86.H09.1.454.CMB.1.raw
  modified_base (156)..(156): a, c, t, g, unknown or other
  misc_feature (156)..(156): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttccncgttgcttcttttaagaggtgtccagtgtcaggtgcagcgtggtgacgtcgtgggggagcgtggtccaggtccgtagggacgtccctgacgctctacctgtcgcaggtcgtcgtaggtactttacaccgtttcgaaggttcggaccttaaggcggtacagttacgaccgacgttacggcccttcccggtaccgcgggtaccggtacccggggacgtaaacggggggccgttaggggaacgggtcggggtagtactaaagtttgtacggttaggtacgtaggacgttaagggtaaaagttaaacgtaaaggtaccgtaaggttcggtaagggtacccgttaccgggtaaaggaaccggggtcccgtaacgtaccgtaacctacgttacccggtacgaaacgggtaacgtaaccccgtaaaccgtaacccggtaaaacgtaacccgttaccggtttaccgtttaacgttttaccccgtaaaaccgtaaacgtttaacgggaaaaccccgttagggtaccccgttaaacggaacggggttaacccgggaccgggttaaaggacccccggaaagggttaccgttaacgggtttacccgttagttttaaccggtacgggtaaccggaacgggttaacggaaccgtttaacgtaaccccggtaaggtaaccgttaacgggtaaaaccgggttaacccgggtaatttttacccggg

SEQ ID NO: 189489 - DNA, 705 bp, Homo sapiens
  misc_feature: GYAE6OF02F5Q1O.22.86.H09.1.454.CMB.1.raw
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtccaccatctcctacactggaaccagcagtgatgttggtggttatactagtcgtctccgtacggtaccactagccaccgagacaacgccccagactcatcatttagcgcttcgtacaataacggccggccctcggaccgggttccgtcgacgttccgtcgtttccttacgtcggtcctacccgtagtcgtcgtaccaaccgacgggtcccctacccgtactaccgtacgtaccgtcgttacggggtaccctacccgtaggtccgtaagaacgacgtcggaacggtcgtacgtatttactttacgtaggtcttacggtcctacgttcgtttacgccgtaccggtacccgtacttaccgtacggttcgggttaggttcccggggtacggtaccgggaccgtacgggtaccgtaccggtaaccgttccggtaacgaccggtacgacccggtaccgtaccgtacccgtccccggtacggttccctacgtttccggttacccgttcccccgtaccccgtcccgttaccgaccgtttacccgg

SEQ ID NO: 189490 - DNA, 703 bp, Homo sapiens
  misc_feature: GYAE6OF02GJUC6.22.86.H09.1.454.CMB.1.raw
  modified_base (217)..(217): a, c, t, g, unknown or other
  misc_feature (217)..(217): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggaggngtggtccagcctgggaggtccctgagactctcctgtgcagcgtcgtggattcaccttcagtggctatggcatgcacgtggcctccgccaggccgtccgggacgaacggggcgtaggngggtgggtacggacaaagtttanagttaggggtactgggaagttagggaaaagttaaaagtaaaacggtacttaaggttaggtaacgggtaaccgtccgggttaagggaacggggacccgtaacgtttaccgaacccgttaacttccgtacccgaaaggtaacgtaaacccgaaaccttaacccgaaagtaaacctaaccgttacctttacgtttacccgtaacctaaaagtacgtaaacaccggtacctagggaagcgggtaaccggaacggaaccgaccgggactaggtacgttacgttacgtcggtagaccggtaagagttaacgtacgtaacgtagtacggtaaccggtaacgggtaatttacgg

SEQ ID NO: 189491 - DNA, 829 bp, Homo sapiens
  misc_feature: GYAE6OF02JPNPI.22.86.H09.1.454.CMB.1.raw
  modified_base (156)..(156): a, c, t, g, unknown or other
  misc_feature (156)..(156): n is a, c, g, or t
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
tcagacatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttccngttnctctttaagnggtgtccagtgtcaggtncagctggtggagtcgtagggggagtcgtggtccaggcctggggacggttccctggagaccttcttcccgtggtagacacgtcgtccttaggactttccgaccgtttcgaaggtcggaccttagtggacctagtcgtcctacgtcggccttccccgcgaggtcccgtccggggacgtaacgggggtctaggggagggtttacggggcggtaacctaagttttaaccgacggttaggggtacttaggggtaacgtaaggggtaaaacgtttaaaaggtaaaacgtaaccgttaagttcgggttaaccgaacggttacccggtaaggaaaccggggtcccgttaacgtaccgaaccgtacgttacccgtaaccgaaggaaccgtaacgtaaaccctacccgtaaaagtaaacccggtaccctagtttaacccggttttacaaacccgtaaacgttaacgaaaccggtacgttcccggtaaagggtaaccgggtaacgggcgggtaaacgggacccgtaacccgggagttaacggtagttaaccgttacgggttcgtaaccggtacggtaaaccggttagtaaacccggttaacccgaggtaaaccgttaaccggaacggttaaaccggggtaacctttaacggg

SEQ ID NO: 189492 - DNA, 658 bp, Homo sapiens
  misc_feature: GYAE6OF02IEZYL.22.86.H09.1.454.CMB.1.raw
  modified_base (498)..(498): a, c, t, g, unknown or other
  misc_feature (498)..(498): n is a, c, g, or t
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
tcagacatacgcgtcacgaccggtgctcgatttagtgctatagacttgggtttgggggagaggagcccagcactagaagtcggcggtgtttccattcggtgatcagcactgaacacagaggactcacatgggagtttgggctgagctgggttttcctcgttgctcttttaagaggtgtccagtgtcaggtgcagctggtggagtcgtgggggaggcgtggtccagtccgtggggaggtccctggagacctctcctgtgcgagcgtctgggtattccaccttcgaggtggctagtcggcatcgccacgtcggcctcccggaccgagggtcccgtaccggggcgaacgggggtccttagggggacggttcgggggtacggacttaaagtttagtacggtgggttatacggtagtaagggtaaagtaaaagtaaacgtctaagtggttacggacctccgggttaggaacgggtccgtattaccgactagtcctacagtaanaaccaacgtacaaagaacctacttcgttacgttaccctaacaaacgttacgaaccgacgtcctaaggacggacggacgaacggacgacggtanggttatcgttagngtacggagacgtaagtacgtcgaactagttacggaacggttaggtaagtttcgg

SEQ ID NO: 189493 - DNA, 807 bp, Homo sapiens
  misc_feature: GYAE6OF02F7H4D.22.86.H09.1.454.CMB.1.raw
  modified_base (161)..(161): a, c, t, g, unknown or other
  misc_feature (161)..(161): n is a, c, g, or t
  modified_base (283)..(283): a, c, t, g, unknown or other
  misc_feature (283)..(283): n is a, c, g, or t
tcagacatacgcgtcacgaccggtgctcgatttagtgctatagacttgggtttggggggaggcgtggtccagcctgggaggtccctgagactctcctgtgcagcgtctggattcaccctttcagtggctatggcatgcactggctccgccaggctccgggnaaggggctggaggtgggtggacaattatatggtatgagtggaataataaagactagtgtgactcgtagaacggcctattccacctatcctaccgagacgaccaactaccaaagaccacgttnttacgtttacaccaaattcgaaacgcgtacctaggaaggaggaccggaaggaaccgaaccgggctaaggtttagtaaactttacgttggttacggacggtaaggacgtacgtccgtaatagtacgtaaaccggttaaccggggtaaaattcgtttttaaggaccttaccggtttaccggggttacggggggaacccggaaaacggggttaccccgaacggttccggggttaaccctaaccccggtttccgtttacccgttccgtacccgtttcccccgtaaacccgtacccgggtaaaacccgggtccccctaacgggtttccccggtttacccccgttcccccgttacgggcccctaaccccgtcgtacccgtacccgaggtacccgtacccgtacccgtaccggacgttaccgacgaacccgtccggacccgtaccggccgggtctcccggtacggtacggttaaccggtaacgtaccctttaccgtaccgtacggtacgttatccggtacgtggtaccggg

SEQ ID NO: 189494 - DNA, 300 bp, Homo sapiens
  misc_feature: GYAE6OF01EPK06.39.54.E10.1.454.CMB.1.raw
  modified_base (298)..(300): a, c, t, g, unknown or other
  misc_feature (298)..(300): n is a, c, g, or t
tcagtcgcactagtcacgaccggtgctcgatttagatcgtagcagacacacaaaggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctcggtcactctgttcccgccctcctcactagtgcgactgagcgggctggcaaggcgcatagnnn

SEQ ID NO: 189495 - DNA, 302 bp, Homo sapiens
  misc_feature: GYAE6OF01CB7DG.39.54.E10.1.454.CMB.1.raw
  modified_base (297)..(302): a, c, t, g, unknown or other
  misc_feature (297)..(302): n is a, c, g, or t
tcagtcgcactagtcacgaccggtgctcgatttagatcgtagcagacacacaaagggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgcccctggtcactctgttcccgccctcctcactagtgcgactgagcgggctggcaaggcgcatagnnnnnn

SEQ ID NO: 189496 - DNA, 304 bp, Homo sapiens
  misc_feature: GYAE6OF01EBKA1.39.54.E10.1.454.CMB.1.raw
  modified_base (299)..(304): a, c, t, g, unknown or other
  misc_feature (299)..(304): n is a, c, g, or t
tcagtcgcactagtcacgaccggtgctcgatttagatcgtagcagacacacaaagggggacgggatccctgagcgcttctcaggctccagctctgggctgagcgccacctcaccatctccagcatccagtctgaggatgaggctgactattactgtcagacctggggcactggcattcatgtggtattcggcggagggaccaagctgaccgtcctgggtcagcccaaggctgccccctcggtcactctgttcccgccctcctcactagtgcgactgagcgggctggcaaggcgcatagnnnnnn

SEQ ID NO: 189497 - DNA, 303 bp, Homo sapiens
  misc_feature: GYAE6OF01ELW15.39.54.E10.1.454.CMB.1.raw
  modified_base (300)..(303): a, c, t, g, unknown or other
  misc_feature (300)..(303): n is a, c, g, or t
tcagtcgcactagtcacgaccggtgctcgatttagatcgtagcagaacacacaaagggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctcggtcactctgttcccgccctcctcactagtgcgactgagcgggctggcaaggcgcatagnnnn

SEQ ID NO: 189498 - DNA, 301 bp, Homo sapiens
  misc_feature: GYAE6OF01B3FUX.39.54.E10.1.454.CMB.1.raw
  modified_base (296)..(301): a, c, t, g, unknown or other
  misc_feature (296)..(301): n is a, c, g, or t
tcagtcgcactagtcacgaccggtgctcgatttagatcgtagcagacacacaaagggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgtcccgcctcctcactagtgcgactgagcgggctggcaaggcgcatagnnnnnn

SEQ ID NO: 189499 - DNA, 351 bp, Homo sapiens
  misc_feature: GYAE6OF01AED98.39.54.E10.1.454.CMB.1.raw
  modified_base (277)..(277): a, c, t, g, unknown or other
  misc_feature (277)..(277): n is a, c, g, or t
  modified_base (306)..(351): a, c, t, g, unknown or other
  misc_feature (306)..(351): n is a, c, g, or t
tcagtcgcactagtcacgaccggtgctcgatttagatcgtagcagaacgtacgacaaagggggacgggatcccgttgagcgcttcttcaggctccagctctgggctgagcgccacctcaccatcgtccagcctccagtctgaggatgaggctgactattactgtcagacctggggcactggcattcatgtggtattcggcggagggaccaagctgaccgtcgtgggtcagcccaaggctgccccctggtcactctgttcccgccctcctcactagtncgactgagcggtctggcgaagcgcatagnnnnnnnnnnnnnnnnnnnnnnnnnnnnnnnnnnnnnnnnnnnnnn

SEQ ID NO: 189500 - DNA, 454 bp, Homo sapiens
  misc_feature: GYAE6OF01ALJNP.39.54.E10.1.454.CMB.1.raw
  modified_base (426)..(427): a, c, t, g, unknown or other
  misc_feature (426)..(427): n is a, c, g, or t
  modified_base (429)..(454): a, c, t, g, unknown or other
  misc_feature (429)..(454): n is a, c, g, or t
tcagtcgcactagtcacgaccggtgctcgatttagatcgtagcagacacacaaagggggacgggatccctgagcgcttctcaggctccagctctgggctgagcgccacctcaccactctcacgtcctccactctggaggagtggacggtcgtcgtaacttaactttacgtcgtacaacgtaccgggtcggggacctacgtcggacttacttactagttggttaggttacgttccggggacggggaacggaaaccgaacggtctacggacccgttccggtgggtaccaccgacccgaaggtctcccgtcccccgtcgtaccaccttccttccggtcccccgtccccttaccctacctaacgttacggttcgacccgttacgtaggacgggtccgggccgtcggaaccggaacggccgaactaagagnngnnnnnnnnnnnnnnnnnnnnnnnnnn

SEQ ID NO: 189501 - DNA, 305 bp, Homo sapiens
  misc_feature: GYAE6OF01EX39R.39.54.E10.1.454.CMB.1.raw
  modified_base (300)..(305): a, c, t, g, unknown or other
  misc_feature (300)..(305): n is a, c, g, or t
tcagtcgcactagtcacgaccggtgctcgatttagatcgtagcagacacacaaagggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctcggtcacctctgttcccgccctcctcactagtgcgactgagcgggctggcaaggcgcatagnnnnnn

SEQ ID NO: 189502 - DNA, 353 bp, Homo sapiens
  misc_feature: GYAE6OF01ESOWD.39.54.E10.1.454.CMB.1.raw
  modified_base (132)..(132): a, c, t, g, unknown or other
  misc_feature (132)..(132): n is a, c, g, or t
  modified_base (325)..(353): a, c, t, g, unknown or other
  misc_feature (325)..(353): n is a, c, g, or t
tcagtcgcactagtcacgaccggtgctcgatttagatcgtagcagacacacaaagggggacgggatccctgagcgcttctcaggctccagctctgggctgagcgccacctcaccatctccagcctccagtcngaggatgaggctgactattactgtcagacctggggcactggcattcatgtggtattcgggcggagggaccaagctgaccgtccgtgggtccagccccaaggcctcgcccccctcggtcacctcctcgttccccgccctccctcactagtcgccgacgtgacggcggcgtggccaacggtcgcaaagttaggcnnnnnnnnnnnnnnnnnnnnnnnnnnnnn

SEQ ID NO: 189503 - DNA, 312 bp, Homo sapiens
  misc_feature: GYAE6OF02GZ7O7.39.54.E10.1.454.CMB.1.raw
  modified_base (299)..(312): a, c, t, g, unknown or other
  misc_feature (299)..(312): n is a, c, g, or t
tcagtcgcactagtcacgaccggtgctcgatttagatcgtagcagaacacacgaaaggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttcccgccctcctcactagtgcgactgagcggctggcaaggcgcatagnnnnnnnnnnnnnn

SEQ ID NO: 189504 - DNA, 302 bp, Homo sapiens
  misc_feature: GYAE6OF02IG65E.39.54.E10.1.454.CMB.1.raw
  modified_base (300)..(302): a, c, t, g, unknown or other
  misc_feature (300)..(302): n is a, c, g, or t
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctgcccctcggtcactctgttcccgccctcctcactagtgcgactgagcgggctggcaaggcgcatagnnn

SEQ ID NO: 189505 - DNA, 304 bp, Homo sapiens
  misc_feature: GYAE6OF02IORRL.39.54.E10.1.454.CMB.1.raw
  modified_base (299)..(304): a, c, t, g, unknown or other
  misc_feature (299)..(304): n is a, c, g, or t
tcagtcgcactagtcacgaccggtgctcgatttagatcgtagcagaacacacaaaggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttccccgccctcctcactagtgcgactgagcgggctggcaaggcgcatagnnnnnn

SEQ ID NO: 189506 - DNA, 299 bp, Homo sapiens
  misc_feature: GYAE6OF02JCA7J.39.54.E10.1.454.CMB.1.raw
  modified_base (297)..(299): a, c, t, g, unknown or other
  misc_feature (297)..(299): n is a, c, g, or t
tcagtcgcactagtcacgaccggtgctcgatttagatcgtagcagacacacaaaggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttcccaccctcctcactagtgcgactgagcgggctggcaaggcgcatagnnn

SEQ ID NO: 189507 - DNA, 299 bp, Homo sapiens
  misc_feature: GYAE6OF02F6PQK.39.54.E10.1.454.CMB.1.raw
  modified_base (297)..(299): a, c, t, g, unknown or other
  misc_feature (297)..(299): n is a, c, g, or t
tcagtcgcactagtcacgaccggtgctcgatttagatcgtagcagaacacacaaaggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttcccgcctcctcactagtgcgactgagcggctggcaaggcgcatagnnn

SEQ ID NO: 189508 - DNA, 302 bp, Homo sapiens
  misc_feature: GYAE6OF02F57E7.39.54.E10.1.454.CMB.1.raw
  modified_base (299)..(302): a, c, t, g, unknown or other
  misc_feature (299)..(302): n is a, c, g, or t
tcagtcgcactagtcacgaccggtgctcgatttagatcgtagcagacacacaaaggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgactgtcctgggtcagcccaaggctgccccctcggtcactctgttcccgccctcctcactagtgcgactgagcgggctggcaaggcgcatagnnnn

SEQ ID NO: 189509 - DNA, 307 bp, Homo sapiens
  misc_feature: GYAE6OF02I3AH2.39.54.E10.1.454.CMB.1.raw
  modified_base (297)..(307): a, c, t, g, unknown or other
  misc_feature (297)..(307): n is a, c, g, or t
tcagtcgcactagtcacgaccggtgctcgatttagatcgtagcaggaacacacaaaggggacgggatccctgagcgcttctcaggctccagctctggggctgagcgccacctcaccatctccagcctccagtctgaggatgaggctgactattactgtcagacctgggcactggcattcatgtggtattcggcggagggaccaagctgaccgtcctgggtcagcccaaggctgccccctggtcactctgttcccgcctcctcactagtgcgactgagcgggctggcaaggcgcatgnnnnnnnnnnn

SEQ ID NO: 189510 - DNA, 300 bp, Homo sapiens
  misc_feature: GYAE6OF02G9CAD.39.54.E10.1.454.CMB.1.raw
  modified_base (298)..(300): a, c, t, g, unknown or other
  misc_feature (298)..(300): n is a, c, g, or t
tcagtcgcactagtcacgaccggtgctcgatttagatcgtagcagacacacaaagggggacgggatccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcacgccaaggctcgccccctggtcactctcgttcccgccctcctcactagtgcgactgagcggctggcaaggcgcatgnnn

SEQ ID NO: 189511 - DNA, 307 bp, Homo sapiens
  misc_feature: GYAE6OF02G750X.39.54.E10.1.454.CMB.1.raw
  modified_base (304)..(307): a, c, t, g, unknown or other
  misc_feature (304)..(307): n is a, c, g, or t
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggcctcgccccctcggtcactctcgttccccgccctcctcaagtgcgactgacgcgggctggcaaggcgcatagnnnn

SEQ ID NO: 189512 - DNA, 306 bp, Homo sapiens
  misc_feature: GYAE6OF02GENQZ.39.54.E10.1.454.CMB.1.raw
  modified_base (300)..(306): a, c, t, g, unknown or other
  misc_feature (300)..(306): n is a, c, g, or t
tcagtcgcactagtcacgaccggtgctcgatttagatcgtagcagaacacacaaagggggacgggatccctgagcgcttctcaggctccagctctggggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttccccgcctcctcactagtgcgactgagcgggctggcaaggcgcatagnnnnnnn

SEQ ID NO: 189513 - DNA, 561 bp, Homo sapiens
  misc_feature: GYAE6OF02F54YF.39.54.E10.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagtcgcactagtcacgaccggtgctcgatttagatcgtagcagaacacgtacaaaggggacggatcccttgagcgcttctcaggctccagctcgtgggctgaggcgccacctcaccatcgtccagcctccagtctgaggatgagctgactattactgtcagaccgtggggcacgtggcgattccagtgtggtagttcgggcggagggaccaaggcgtcgaaccgtccgtggtcgagccgaaggaccgtacgtccccctcggtccgaccttcgtcgtccccgcccgtccctctacctacgtcgccgacgtaggacggccggccgtacggaaccgaaggcgtccgaagttacggacagngcgctgagncgngagcgcngtgtattgtgngngngngtatgactacgtacgtgngtgtgtgtnagtgtgtntntgacgcgtgacgacgcgtcgtcgtctctacgtctacgcgcgtacgacgacgccgtcgtccgtccgtcccgtccgtccgtaccgccgtccgtaccgacggtaccgtaccgaccgtacgaccgacgcgacg

SEQ ID NO: 189514 - DNA, 173 bp, Homo sapiens
  misc_feature: GYAE6OF01CQWV4.15.55.E11.1.454.CMB.1.raw
  modified_base (173)..(173): a, c, t, g, unknown or other
  misc_feature (173)..(173): n is a, c, g, or t
tcagtctacgtagccacgaccggtgctcgatttagcactcgcacgttgggtttgggggaagaggaagactgacggtcccccaggagttcaggtgctgggcacagcggccctgggctgcctggtcaaggactacttccgctacgtagactgagcgggctggcaaggcgcatagn

SEQ ID NO: 189515 - DNA, 596 bp, Homo sapiens
  misc_feature: GYAE6OF01CQRMI.15.55.E11.1.454.CMB.1.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaagggccncttcaccatctccagagacaattccaaacaacacactttatcttacaaatgaacagcctgcgagccgaggacacggccgtatactactgtgcgagagatcgaacaggcccgtgggacgcccgttgactacgtggggccaggggaccctggtccaccgtctcctcacctccaccaacggcccacgtccggtccttccccgtcggccaccctccctcccaacgacgccaccctccgtcggggccaccgacggcccggccccgtcgggccttcgcccgtcggtacgaacggtacctaccgttcccgccgttaccgtaggaccgtcggacggccgggcgtcgggacgaagggcgcgagtacg

SEQ ID NO: 189516 - DNA, 174 bp, Homo sapiens
  misc_feature: GYAE6OF01AJKLV.15.55.E11.1.454.CMB.1.raw
  modified_base (173)..(174): a, c, t, g, unknown or other
  misc_feature (173)..(174): n is a, c, g, or t
tcagtctacgtagccacgaccggtgctcgatttagcactcgcacgttgggtttgggggaagaggaagactgacggtcccccaggagttcaggtgctgggcacagcggccctgggctgcctggtcaaggactacttccgctacgtagactgagcgggctggcaaggcgcatagnn

SEQ ID NO: 189517 - DNA, 557 bp, Homo sapiens
  misc_feature: GYAE6OF01A5PKG.15.55.E11.1.454.CMB.1.raw
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (551)..(552): a, c, t, g, unknown or other
  misc_feature (551)..(552): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaagggctggagtggatctcagctattagtggaggtggtagtggtgaaaaacncatattacgcaggctcgtgaggccnctcaccatctccagagacaattccaaacaacacactttatcttacaaatgaacagcctgcgagccggaggaccacggccgtatactactgtgcgagagatcgaacaggcccgtgggacgcccgttgactacgtcgggccaacgggaccctggtacaccgtctccctacaacctcccaccgaacgggcccacgtccggtccttccccctggccaccctccctaccaacgacgccacctcgtcggggacacgacgccggccgtgggcctgccgtgacaggctactccgctacgtagctgacgcggctcggacaggcgnngtacg

SEQ ID NO: 189518 - DNA, 600 bp, Homo sapiens
  misc_feature: GYAE6OF01BPZ9I.15.55.E11.1.454.CMB.1.raw
  modified_base (318)..(318): a, c, t, g, unknown or other
  misc_feature (318)..(318): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaaggccgcttcaccatctccagagacaattccaacaacacactttatcttacaaatgaacagcctgcgagccgaggacacggccttanactactgtgcgagagatcgaacaggcccgtgggacgcccgttgactacgtggggccaggggaaccctgggtccaccggtctcctacaacctccaccgaacggcccacgtccggtccttcccccgtcggcccaccctccctacccaacgacgaccaccgtcgtcggggcacgacgccggcccgtcgggcctcggcccgtcggtaccgaacggtaccttaccgttcccgtaccgtaccggtacgaccgtcggacggcgggcgtcggacgaagggcgcgagtacg

SEQ ID NO: 189519 - DNA, 714 bp, Homo sapiens
  misc_feature: GYAE6OF01EF41P.15.55.E11.1.454.CMB.1.raw
  modified_base (270)..(270): a, c, t, g, unknown or other
  misc_feature (270)..(270): n is a, c, g, or t
  modified_base (321)..(321): a, c, t, g, unknown or other
  misc_feature (321)..(321): n is a, c, g, or t
tcagtctacgtagccacgaccggtgctcgatttagcactcgcacgttgggtttgggggaggcttggtacagcctgggggtccctgagactctcctgtgcagcctcaggattcgcctttcgcatctatgccatgacctggggtccgccaggctccagggaaggggctggagtgggcggccaccatacaaaaagatcggaatgacacaacctatgtgaactctggtgagtgccactcaccgtctcgagacgacgacgacaacgactacactnacatactacgacaactagaaacgaaccgtacgaaggacgaccggaggtacngttacttagtcgtagttacgtgtggtggtagctagttacgttcggtacgtcgggtcgggtaccggtacggtaacccggtaccggtcctttacccgtaccgtacccgtaccgtaccgtacccgtccccgtaacccggtaacccgggtaccccgtaccgttacccggttccccgttacccccggttacccggtcccggtccccgaaccggtccctacccggtaccgggaccgaccccgtacccgtccgaacggtacggaccgaccgacgggccgggcccgtctttccgtcgccgtcggtaccgtaacgggtaccgttaaccgttacccggtaccgttaccggtaacggtaaccggtcggacggccgggcgtacgggacgaagggccggcgagtag

SEQ ID NO: 189520 - DNA, 616 bp, Homo sapiens
  misc_feature: GYAE6OF01A9NP0.15.55.E11.1.454.CMB.1.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccaggggaaggggctggagtggatctcagctattagtggaggtggtagtggtgaaaacncatattacgcaggctccgtgaagggccncttcaccatctccagagacaattccaacaacacactttatcttcaaatgaacagcctgcgagccgaggacacggccgtatactactgtgcgagagatcgaacaggcccgtgggacgccccgttgacctacgtggggccaaggggaacccctgggtccaccggtctccctacaacctccaccgaacgggccccacgtcccggtcctttcccccgtcggcccacccctccctccaacgacgccaccgtccgtcgggggccacgacggccggcccgtcgggcctcgcccgtcggtaccgaacggtaccttaccgttcccggaccgttaccggtagaccgtggacggcggggaccgtcgggaccgaagggcgcgagtacgg

SEQ ID NO: 189521 - DNA, 603 bp, Homo sapiens
  misc_feature: GYAE6OF01CIYM4.15.55.E11.1.454.CMB.1.raw
  modified_base (210)..(210): a, c, t, g, unknown or other
  misc_feature (210)..(210): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaagggccgcttcaccatctccagagacaattccaacaacacactttatcttcaaatgaacagcctgcgagccgaggacacggccgtatactactgtgcgagagatcgaacacggcccgtgggacgcccgttgactacgtggggccacggggaaccctggtcacccgtctcctcaacctccaccgacgggcccacgtcggtccttccccgtcggccaccctccctccaacgacgaccaccctcgcggggcacgacgccggccccgtgggcctcggcccgttggtccgaacgggtaccttaccgttcccgccgttaaccggtacggtaccgtggacggtccgggacgtcgggaccgaaggggccgcgtagtacgg

SEQ ID NO: 189522 - DNA, 564 bp, Homo sapiens
  misc_feature: GYAE6OF01BRF1L.15.55.E11.1.454.CMB.1.raw
  modified_base (559)..(559): a, c, t, g, unknown or other
  misc_feature (559)..(559): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaaacaacacactttatcttacaaatgaacagcctgcgagccgagacacggccgtatactatgtgacgagagatcgaacaggcccgtgggacgcccgttgactacgtggggccagggaccctggtcaccgtctcctacacctccaccgacggccatccgtcctccctcgccaccctcctaccaacgacgccacctcgcggggcacgacgccggcccgtcgggcctcgccgtcggtacgaacggtactaccgttccgacgtacgtagacgtggacgcgggcgtcggacgaaggcgcgngtacg

SEQ ID NO: 189523 - DNA, 590 bp, Homo sapiens
  misc_feature: GYAE6OF01AK2VF.15.55.E11.1.454.CMB.1.raw
  modified_base (211)..(211): a, c, t, g, unknown or other
  misc_feature (211)..(211): n is a, c, g, or t
  modified_base (585)..(585): a, c, t, g, unknown or other
  misc_feature (585)..(585): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtagaaaacncatattacgcaggctccgtgaagggccgcttcaccatctccagagacaattccaacaacacactttatcttacaaatgaacagcctgcgagccgagacacggccgtatactactgtgcgagagatcgaacgcggcccgtgggacgtcccgttagacctacgtcggggaccacggggacccctggtccaccgtctccctaccaaccctccaccgaacgggccctacgtcccggtccttcccccgtcggcccacccctccctaccaacgacgccaccgtcggtcggggcaccgacgcccggcccgtgggtcctcggccgtcggtaccaacggccttaccgtccgcgtacgtagcgtgcggcggcgtcggacaggcncagtg

SEQ ID NO: 189524 - DNA, 597 bp, Homo sapiens
  misc_feature: GYAE6OF01BFJB8.15.55.E11.1.454.CMB.1.raw
  modified_base (238)..(238): a, c, t, g, unknown or other
  misc_feature (238)..(238): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccncttcaccatctccagagacaattccaacaacacactttatcttcaaatgaacagcctgcgagccgaggacacggccgtatactactgtgcgagagatcgaacaggcccgtgggacgcccgttgactacgtggggccaggggaaccctggtccaccgtctcctacaacctcccaccgaacgggccccacgtccggtccttcccccgtcggcccacccctcctcccaacgacgccaccctcgtcggggccacgacgccggcccgtcgggcctcgcccgtcggtaccgaacggtaccttaccgttcccgacgtaccggtacgacgtggacggcgggcgtcgggacgaagggccgcgagtacg

SEQ ID NO: 189525 - DNA, 508 bp, Homo sapiens
  misc_feature: GYAE6OF01D020L.15.55.E11.1.454.CMB.1.raw
  modified_base (495)..(508): a, c, t, g, unknown or other
  misc_feature (495)..(508): n is a, c, g, or t
tcagtctacgtagccacgaccggtgctcgatttagcactcgcacgttgggtttgggctcaactctcttgtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggacgcccgtgactacgtggggccagggaacccgtggtccaccgtctcctcaacctccaccacggcccatccggtcctcccctggccaccctcctccaagacgccacctcgtcggggcacgacggccggcccgtgggcctcgcccgtggtaccgaaggaccttaccgttcccgctacgtagaccgttggacgccgggctgggaccaaggcacagtagnnnnnnnnnnnnnn

SEQ ID NO: 189526 - DNA, 663 bp, Homo sapiens
  misc_feature: GYAE6OF01EOKU5.15.55.E11.1.454.CMB.1.raw
  modified_base (240)..(240): a, c, t, g, unknown or other
  misc_feature (240)..(240): n is a, c, g, or t
  modified_base (658)..(658): a, c, t, g, unknown or other
  misc_feature (658)..(658): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaaggggctggagtggatctcagctattagtggaggtggtagtggtagaaaacacatattacgcaggctccgtgaagggccncttcaccatctccagagacaattccaacaacactactttatcttacaaatgaacagcctgcgagccgaggacacggcctatactactgtcgcgagagatacgaacgacggcccggtgggacgtccccgttagacctacggtcggggaccaacggggtaacccctgggtacccacccggttcttacccctacgtaaccctcccgaacccgaaccggggtcccctaacgttccccggttacccttcccccgtcggtacccctaccccgttccctacccgaacgacgcccacccgttccggcgggaccaccgaccggcccggtcccgtcgggtcctcgtcccggtcggtacgaacggtaccttaccgttccgtaccgtacgtacgacgtcggacggcgggcgtacggacgaaggccgacgngtacg

SEQ ID NO: 189527 - DNA, 523 bp, Homo sapiens
  misc_feature: GYAE6OF01AMAAJ.15.55.E11.1.454.CMB.1.raw
  modified_base (210)..(210): a, c, t, g, unknown or other
  misc_feature (210)..(210): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (476)..(476): a, c, t, g, unknown or other
  misc_feature (476)..(476): n is a, c, g, or t
  modified_base (519)..(520): a, c, t, g, unknown or other
  misc_feature (519)..(520): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaagggccgcttcaccatctccagagacaattccaacaacacactttatcttcaaatgaacagcctgcgagccgaggacacggccgtatactactgtgcgagagatcgaacaggcccgtggggacgcccgttgacctactggggccaggggaaccctggtccaccgtctcctcacctccaccacggcccatcgtcttcccctgccaccctcctccacgcncacctcncgggcacagcggccctggcngctggcagctactccgcgtcgtagctgagcggctggcaggcgnngtg

SEQ ID NO: 189528 - DNA, 657 bp, Homo sapiens
  misc_feature: GYAE6OF01AUL26.15.55.E11.1.454.CMB.1.raw
  modified_base (145)..(145): a, c, t, g, unknown or other
  misc_feature (145)..(145): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccnccaggctccagggaaggggctggagtggatctcagctattagtggaggtggtagtggtgaaaaacncatattacgcaggctccgtgaagggccncttcaccatcctccagagacaattccaaacaacactactttatcttacaaatgaacagcctgcgagccgaggaccacggccgtatactactgtgcgagagatcgaaacacgggcccgtgggacgccccgttagacgtacgtcggggaccaacggggtaacccctgggtaccacccggtctccctaccaaccctcccaacccgaacgggcccctacgttcccggttacccttccccccgtcgggccctacccctccctacccgaacgacgcctaccctccggtcggggccaccgacggcccggcccgtcggggccttcggcccgtcggtaccgtaacggaccgtacccgttcccgaccgttaccggtacgaccggtcggacggcggggcgtcgggaccgaagggccgaccgaagtacgg

SEQ ID NO: 189529 - DNA, 593 bp, Homo sapiens
  misc_feature: GYAE6OF01CGF5B.15.55.E11.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (505)..(505): a, c, t, g, unknown or other
  misc_feature (505)..(505): n is a, c, g, or t
tcagtctacgtagccacgaccggtgctcgatttagcactcgcacgtttggggtttgggggaggcttggtacagcctgggggtccctgagactctcctgtgcagcctcaggattcgcctttcgcatctatgccatgacctgggtccgcaggctccagggagggctggagtggatctcagcttattagtggaggtggtagtggtagaaaaacncattattacgcaggctcgtgaagggccgcttcacatcncagnacaattccaacaacactactttatctttacaaaatgaaccagtcctgcgacgccggaagacaccgggcctatacctatgtcgacgaagagatacgaaacgacggtcccgtagggacgtcccgttagacgtacgtcggggaccacggggtacctggccgaccgttctcccacgacctaccgacgacggccctacgtccggttccctcccgtgccctacccttcccacacgtacgccaccgtgtcgggcaacgngtccgccgtggcctcgccgtgacacggtacttaccgtccgacttcggagacgtggaccggtcgggtcgaggtccgaggtcgcgaagtg

SEQ ID NO: 189530 - DNA, 620 bp, Homo sapiens
  misc_feature: GYAE6OF01BEHCW.15.55.E11.1.454.CMB.1.raw
  modified_base (194)..(194): a, c, t, g, unknown or other
  misc_feature (194)..(194): n is a, c, g, or t
  modified_base (614)..(615): a, c, t, g, unknown or other
  misc_feature (614)..(615): n is a, c, g, or t
  modified_base (617)..(617): a, c, t, g, unknown or other
  misc_feature (617)..(617): n is a, c, g, or t
  modified_base (620)..(620): a, c, t, g, unknown or other
  misc_feature (620)..(620): n is a, c, g, or t
tcagtctacgtagccacgaccggtgctcgatttagcactcgcacgttgggtttgggggaggcttggtacagcctggggggtccctgagactctcctgtgcagcctcaggattcaccttgagcacttattggatgacttgggtccgccaggctccgagggaaggggctggagtgggtggccaccatacaaaaagntggaagtgacacaacctatgtgaactctgtgagtggggccattccaccgtctccagagacgacgccaagactcactacatctgacaaatcgaaacacctgagacgccgaggacacggctgtgtattactgtgtgagagtattgttctggcggttcgggggacccaggggtaaccctggtccaccgtctcctcgacgtccctccgaccgaacgggcccctagttcccggttcccttcccccgtcggcccgtccccgtcgtccctccgacggacgcccacccgtccgacgacgccgaccgacggcccggcccgtgggcctcggtccgtcggtaccgtaacggtaccttaccgttcccgcgttaccggtacgtacgtcggacgggccgggtcgtacgggcgaacgggcccgacgtacgtacgnntncgn

SEQ ID NO: 189531 - DNA, 717 bp, Homo sapiens
  misc_feature: GYAE6OF01CSCP5.15.55.E11.1.454.CMB.1.raw
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (707)..(707): a, c, t, g, unknown or other
  misc_feature (707)..(707): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggcctccgaggggaaggggctggagtggatctcagctattaggtgggaggtggtagtggtagaaaacacatattacgcaggctccgtgaacgggccncttcaccatctcagagacaattccaacaacacacttttancttacaaatgaacacgcctgcgacgccgaggacacggccgtatactactgtgcgagagngtacgaacncggccgtgggacgtcccggttgactacggtcggggaccaacggggtacccttgggtcccacccgttcctacctaccgaacctcccaacccggaacgggccccaacggttcccggttaccccgtttcccccgtccgggtacccctaccccctcccgtacccgaaacggccgtacccgtaacccgttcgggaccggggggtaccaacccggaacgggccccgggtacccccgtggggtacccttcggtaccccggttcgggtaacccgaaccgggttaccgttacccgttccggaaccgttaccggtacgtacggtccgggacgggtacccgggtcgtacgggaccgagggcccgngtaacgtacg

SEQ ID NO: 189532 - DNA, 713 bp, Homo sapiens
  misc_feature: GYAE6OF01ANUNT.15.55.E11.1.454.CMB.1.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaagggctggagtggatctcagctattagtggaggtggtagtggtagaaaaacacatattacgcaggctccgtgaagggccnctcaccatcctccagagactaattccaaacaacactactttatcttacaaatgaacagcctgcgagccgagacncggcgtatactactgtgcgagagataccgaacgacgggcccggtaggggacgtccccggttagaaccgttaccgggtacgggggccctaaacgggggtaaacccccttgggtaccccgaacccggttcccttaccccgtaaccctaaaccccgtccccgaaccccgaacggggcccccgtaacgttccccggttcccctttcccccccgtacgggtccccctacccccgttcccctacccgaaacggacctacccgacccgttaccggccgggggaccaccgacggcccggtcccgtcgggcctacggccgtcggtaccgaacggtaccttaccgttcccgacgttaccgtagaccgttggacggtcgggaccgtggaccgaacggcgacgtacgtacgg

SEQ ID NO: 189533 - DNA, 642 bp, Homo sapiens
  misc_feature: GYAE6OF01CXS9X.15.55.E11.1.454.CMB.1.raw
  modified_base (145)..(145): a, c, t, g, unknown or other
  misc_feature (145)..(145): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccnccaggctccgaggggaagggctggagtggatctcagctattaggtggaggtggtagtggtagaaaacncatattacgcaggctcgtggaacgggccncttcaccatcctaccagagactaacttccaaacaacactactttatcttacaaatcgaaacngcctgcgagccgaggaccacggcctaataccgtactggtgcgaagagactccggaacgacggcccggtgggacctcccggttagactacggtcggggacctaaggggtaccctggaccaccgttcctacccgacaaccctccaaccgtaaccgggccctacgtcccgttccttccccgtcggtacccacccctcctaccgaacgacgccgtaccgtcggtacggggccaccgaccgccggacccggtcggccgtcgtccgtcggtaccgaagtaccgtaccgtaccgtaccgtacgtagacgtcggacggcggaccgtcggacgagggcgcgagtacg

SEQ ID NO: 189534 - DNA, 684 bp, Homo sapiens
  misc_feature: GYAE6OF01CDRFZ.15.55.E11.1.454.CMB.1.raw
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagtctacgtagccacgaccggtgctcgatttagcactcgcacgttgggtttgggggaggcttggtacagcctgggggggtccctgagactctcctgtgcagcctcaggattcgcctttcgcatctatgccatgacctgggtccgccaggctccgaggggaagggctggagtggatctcagctattagtggaggtggtagtggtagaaaacacatatacgcaggctccgtgaagggccncttcacatctccagagacaattccaacaacactacttatcttanaaatnaacngctgcgagccgagacgacggctanactangtgcgagagatcgaacgcggcccgtaggggacgtcccgttagaccgtacggtcggggaccgacgggtaaccctgggtaccctaccgtcctcctaccaccctacccgaaccgaacggccctacgtcccgttcccttccccgacgtaccctacccctccacccgaacgaccgacctacccgtcgggtaccggggacctaccggaccgggtcccgggtacccggtcggggtcccttcgggcccgttagggtaaccgtaaccggtaacccgttacccgttacccggtaccgttaaccgggtaaccggtaccggtggaccggggtaccggggccggtaacgggaccggaagggccgcgtaacgtacg

SEQ ID NO: 189535 - DNA, 860 bp, Homo sapiens
  misc_feature: GYAE6OF01BLWLB.15.55.E11.1.454.CMB.1.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgagggaagggctggagtggatctcagctattagtggaggtggtagtggtagaaaacncatattacgcaggctcgtgaagggccncttcaccatctcaganacaattccaaacaacactactttatcttacaaatgaacngcctgcgagccgaggacacggcgtatactacgtgagcgagagactacgaacgacgggcccgtggggaacctcccggttagaccgttaacggtcgggggaccctaacgggggaaaccccttgggtacccctaacccggttcctaccccgtaacccgtaaccccgttaccccgaaaccccggtaaaccggggtaccccctaaccggtttccccgggttacccccgttttacccccccggtacccgggtacccccttaaccccccgttaccccgttaaccccgaaaccggtaacccggtaccccgtaaccccgggttacccgggttaccgggggggaccctaacccgggtaaccgggtaccccggggtcccccggttaccgggggtccccgttaccgggtccccgggttaccgggtaacccggtaaaccgggttaacccgtttaacccggtttaccccggtaacccgttaaccgggttaaccgggtaaccggttacgggaaaccgggttcccggggtaccggttacggggtaacccggaaacggggtcccggtaacgtaacggtaacggg

SEQ ID NO: 189536 - DNA, 1007 bp, Homo sapiens
  misc_feature: GYAE6OF01C598I.15.55.E11.1.454.CMB.1.raw
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtcccgccaggcctccgaggggaagggggctgggagtggatcctcagctagttagtggaggtggttagtggtagaaaaacactataattacgcgaggccttccgtaggaacggggcctcttaccaccatcgtccaagacgaactaatttacccaaacaaacacctaacctttttatacctttaacaaaattcgaaaaccgacgcccttaggcggacggacccggaagggaccgaaccgggtaccccttaataacccgttactttcggacggaccggtaaaggacaacgttacccggaaacggtaaccggggtccccggttacggggggaacgtccccgggttaagttaaccggttaacccgggtcggggggaacccggtaaccggggtaaccccgtttcgggtccccgtaaaccccgggtttccctaccccggtaccctaaacccccggttaccccgaaacccggaacccgggggcccccttaaccgttcccccgggttttaccccctttcccccccggtacggggttcccccctaacccccgttttacccaaccccgggtaaacgacccgggtaccccgttaaaccccggtttcccggggttaccgggggggaccccaaaccgtaaccccggggtccccggggttccccgggttaccgggggccctttcccgggggttaccgtttacgggggtaaccccgttaaaaacggggtccccctttaaaccccggttttccccggggaacccgttttaaccgggtttaaaccggtaacccggtttcgggggaaaccgggttaccccgggggtcgggttaacccccggggtaaaccgggaaaccggggtcccggtaaaccggtaggtaacgg

SEQ ID NO: 189537 - DNA, 546 bp, Homo sapiens
  misc_feature: GYAE6OF01CARLT.15.55.E11.1.454.CMB.1.raw
  modified_base (138)..(138): a, c, t, g, unknown or other
  misc_feature (138)..(138): n is a, c, g, or t
  modified_base (325)..(325): a, c, t, g, unknown or other
  misc_feature (325)..(325): n is a, c, g, or t
  modified_base (518)..(518): a, c, t, g, unknown or other
  misc_feature (518)..(518): n is a, c, g, or t
  modified_base (524)..(546): a, c, t, g, unknown or other
  misc_feature (524)..(546): n is a, c, g, or t
tcagtctacgtagccacgaccggtgctcgatttagcactcgcacgttgggtttgggctcaactctcttgtccgccaggctccagggaaggggctggagtggatctcagctattagtggaggtggtagtggtgaaaacncatattacgcaggctccgtgaagggccgcttcaccatctccagagacaattcccaaacaacactacttttatcttcaaaatgaaacagcctgcgagccgaggacacggcctatactactgtgcgagagatcgaacaggcccgtgggagcccgttgactactggggccagggaacctggtcacccgtntccctcaaccctccaccgaacggcccaatcggtccttcccccgtggcccaccctcctacccaagacgccaccctcgtgggggccacgacgccggacccgtggggcctgacccgtggtaccgaacggactaccgttcccggactacgtagacgtgaggaccgggtctgggccaaagggtccgactaacgtaggntgcagnnnnnnnnnnnnnnnnnnnnnnn

SEQ ID NO: 189538 - DNA, 651 bp, Homo sapiens
  misc_feature: GYAE6OF01D0MU9.15.55.E11.1.454.CMB.1.raw
  modified_base (622)..(623): a, c, t, g, unknown or other
  misc_feature (622)..(623): n is a, c, g, or t
  modified_base (625)..(625): a, c, t, g, unknown or other
  misc_feature (625)..(625): n is a, c, g, or t
  modified_base (627)..(651): a, c, t, g, unknown or other
  misc_feature (627)..(651): n is a, c, g, or t
tcagtctacgtagccacgaccggtgctcgattttagcactcgcacgttggggtttgggctcaactctcttgtccgccaggctccagggaaggggctggagtggatctcagctattagtggaggtggtagtggtgaaaacacatattacgcaggctccgtgaagggccgcttcaccatctccagagacaattccaacaacacacttttatcttacaaatgaacagcctgcgagccgaggacacggccgtatactatggtgcgagagatacgaacgacggcccggtgggacgcccgttagaccgtacgtcggggaccgacggggaaccctggtcctaccgttcctaccctaccaacccgttacccaacccgtaacggggacccctaacgttcccggttcccctttccccccgtcgggtccctaacccctcccgtacccaaacggtacgaccctaccgttccggtacgggggaccaaccgacggcccggtacccgtcggggtcctaccgggtcccgttacggtaccggaacggtaaccttacccgttaccccggtccgttaaccggtaggtaaccgttgggaaccggtccggggcgttaggacccgaacgggtcacgtatacggnngngnnnnnnnnnnnnnnnnnnnnnnnnn

SEQ ID NO: 189539 - DNA, 655 bp, Homo sapiens
  misc_feature: GYAE6OF01B8EPA.15.55.E11.1.454.CMB.1.raw
  modified_base (145)..(145): a, c, t, g, unknown or other
  misc_feature (145)..(145): n is a, c, g, or t
  modified_base (211)..(211): a, c, t, g, unknown or other
  misc_feature (211)..(211): n is a, c, g, or t
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccnccaggctccagggaaggggctggagtggatctcagctattagtggaggtggtagtggtagaaaacncatattacgcaggctccgtagaacgggccgtcttcaccatcctccaaganactaattccaaacaacactactttancttacaaatgaacngcctgcgagccgagcacggcctatactactgtgcgagagtactacgaacgacggcccgtagggacgtcccgttagacctacgtcggggaccaaggggtacccctggtacccaccgtcctacccgtaccaaccctacccgaacccgaacgggtcccctaacgtcccggttcccgttacccccgtcgtacccctaccccgttccctaacccgaacgtaccgccgtaacccgtccggtacggggcaccgacggcccggtacccgtcgggcctcgtccgtcggaccgtaacggtaccctaccgtccgtacgtaccgtacgtacgtggacgcgggacgtcggacgtaggcctagagtcg

SEQ ID NO: 189540 - DNA, 711 bp, Homo sapiens
  misc_feature: GYAE6OF01BT0RI.15.55.E11.1.454.CMB.1.raw
  modified_base (303)..(303): a, c, t, g, unknown or other
  misc_feature (303)..(303): n is a, c, g, or t
tcagtctacgtagccacgaccggtgctcgatttagcactcgcacgttgggtttgggggaggcttggtacagcctgggggggtccctgagactctcctgtgcagcctcaggattcgcctttcgcatctatgccatgacctgggtccgcagctccagggagggctggagtggatctcagctattagtggaggtggtagtggtagaaaacacatattacgcaggcctccggtaggaacgggccgtcttacaccatcctccaggacactaacttccaacaacactactttatcttacaaatcgaacncgcctgcgaggccggaggaccaccggccgtatactacgtgtcgcgaagagagtaccgaacgacgggtcccgtaggggaccgtcccggttacgacgtaccggtcggggacctaacgggggtaaccccttgggtaccctacccgttccgtccctacccgtaacccttacccgaaccggtaacgggccccctaacggttcccggttccccttcccccggtcgtacccctacccccgttccctaaccgacgaccgtcccgtacccgttcggggacggggtaccaccggacggtcccgggaccgttcggaccgtcgtaccgtcggaccgtaacggtacccttaccgttacccgcgttaacgggtacgtacggtcggacgggtccggacggtacggacgaacggcgacaggtcg

SEQ ID NO: 189541 - DNA, 792 bp, Homo sapiens
  misc_feature: GYAE6OF01AN226.15.55.E11.1.454.CMB.1.raw
  modified_base (155)..(155): a, c, t, g, unknown or other
  misc_feature (155)..(155): n is a, c, g, or t
  modified_base (240)..(240): a, c, t, g, unknown or other
  misc_feature (240)..(240): n is a, c, g, or t
tcagtctacgtagccacgaccggtgctcgatttagcactcgcacgttggggtttgggggagggcgttgggtacagccgtgggggggtcccgtggagactctcctgtgcagcctcaggattcgcctttcgcatctatcgcatggacctggggtccnccaggtcctccgaggggaaggggcgtgggaggtgggattctcagcttagttaggtgggagggtcggttagtgggtacgaaaaacncgtagtatttacggcaggtcctacggtcggaacgggtccgcttaccgacctatcctcgagacgactaacttaccaacaactactaactttagtaccttaacaatagtaacacgtcgagtcgacgaccgggacgacggaccggacgtacttaccgtacgtcgtaggacgagtaacgtatacgtaagaccggggtccggtaggggaccgtccggttagaccggtacggtcggaccggtaccggggtaaaccgtcgtaccggtaaccccggttctaccctaccgtaaccctcccgaaccgtaaccggggtccctaaccgggttcccggttaccccgtccccggtacccgacccgtacccccttccgaccgtacgaccgtacccgtacccgtacggtacggggtacccacggtaaccgggcccggtaacccgggtccggtccgtcggtacccgtcggtaccgtaacggtcccctagtccccgggtaccgttacgaccgggtacgtcgggtaccggaccgggttccgacgggtaccgtaagggcccggtagcgtacg

SEQ ID NO: 189542 - DNA, 792 bp, Homo sapiens
  misc_feature: GYAE6OF01DBN10.15.55.E11.1.454.CMB.1.raw
  modified_base (188)..(188): a, c, t, g, unknown or other
  misc_feature (188)..(188): n is a, c, g, or t
  modified_base (789)..(789): a, c, t, g, unknown or other
  misc_feature (789)..(789): n is a, c, g, or t
tcagtctacgtagccacgaccggtgctcgatttagcactcgcacgttgggtttgggggaggcttggtacagccgtgggggggtccctgagactctcctgtgcagcctcgaggattcgcctttcgcatctatgccatgaccgtgggtcccgccaggcctaccgaaggggaaggggcgtggagtggatcncgagtctagttaggtggagggttggtaggtggtaagaaaaacactagtacgttaccgacgacggtccgtccggtaggaacgggcccgtccttaccaccgtactccgtaccgaaggaacgtaactaaacttacccaaaaccgtaaacctaaccttaacttttaacgtaccttaacaaaagtacgaaacgtacgtccgtacggccggacggacccggaacggaacccgtaccgggtaccgttaaacttaaccgttacgtggtacggaacggaagacgtaacgaccggaacggaccggtcccggtagggaccgttccggtacgacgttacgggcggaccggaaccgggtacgtcggtacccgtaccgttcctaccctaccgacccgtacccgaacccggaaccggtccgtaccgttccccgttccccgtccccgtacgtaccccgtaccccgtcctaacccggaacgaccgtcccgtaccgtccgggacgggaccaccggccggcccggtccgtcggtccgtcgtaccgtcggtaacgaccgttaccgtaccgtccgtagtaccgtagtccggtggaccggcggaccgtcggacgaggcgtagngcg

SEQ ID NO: 189543 - DNA, 844 bp, Homo sapiens
  misc_feature: GYAE6OF01BCVJT.15.55.E11.1.454.CMB.1.raw
  modified_base (834)..(834): a, c, t, g, unknown or other
  misc_feature (834)..(834): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggcctccgaggggaaggggctggagtggatctcagctattaggtgggaggtggtaggtggtagaaaacacaatacttacgcacggtctaccggtaggaacggggtccctcttaccaccctacttccctaccgaagacgaacctaacttacccaaaacctaaccaaccttaaccttttaacttaccgttaacctaaaagtacgaaacgaccgtacctcggaccggacggacccggaacgggaaccgtaccgggtacccgtacgttaaccgtacgttaggttacgggacgtaacggacggtaacgttaacccggaaaccgtaccggggtaccccgggtagggggtaacccgtcccgggtttaacgacgtttacgggtaccggggaccggtaaccggggtaaccccgtggtacccgtaccgtccctacccgtaaccaacccctacccgaaccggaaccgggacccctaccggttccccgttaccccgttccccgtaccgggtacccctaccccgtaccctaccgaaacgaccgacccgtaccgtcgggtaccggggaccaccgaccggtcccggacccgtcgggtccttcggaccggttacggacgttacgtacccgttaccgtcccgtacgttaaccggtacgtacggtaccggaccgggtcgggtaccggtacgtaccgggaccgcnccgagtacgg

SEQ ID NO: 189544 - DNA, 888 bp, Homo sapiens
  misc_feature: GYAE6OF01DME4N.15.55.E11.1.454.CMB.1.raw
  modified_base (252)..(252): a, c, t, g, unknown or other
  misc_feature (252)..(252): n is a, c, g, or t
tcagtctacgtagccacgaccggtgctcgatttagcactcgcacggttgggtttgggggaggcttggtacagcctggggggtccctgagactctcctgtgcagcctcaggattcgcctttcgcatctatgccatcgaccgtcggggtcccgccgaggcctccgaagggggaagggggctgggagtggatctcagtctagttaggtggaggtggtagtggtacaaaacagattatccgcgaggccttaccggnggaacggggtccctacttaccacctacgttccctaccgaaggaactaacctaaaaccttacccaaaacaaacctaccttaactttttactactttaacaaaagttacgaaacacggtccctggaccggaacggtccggaaggacccgaccggtacttaacttactacgtggacgcggagacgagaccgaacggcggggccggtagggaccgttccgtagaccgttacggggcgggtacccgacggggtacccgtcggtacccgttaccgttcccgtaaccttacccgtaaacccgttaccccgaacccggtaaccggggaccccgttaccgggtttacccccggttcccccgttacccccggtaccgaacccccgttcccccgttacccgaacccgtaaccgggacccttacccgtaccccgggtcggggttaccgggggacccaaccgggttaccgggccccgggtccccggtacggggtacccggtttcccggacccggttacgggtaacccgtaaccggttacccccgttaaccggtaccccggtaacccgtttacgggacccgggttaccggtcggggccggggttaccgggcggttacggggaacccggtacggaaccgtacggtagtacg

SEQ ID NO: 189545 - DNA, 718 bp, Homo sapiens
  misc_feature: GYAE6OF01ET6E3.15.55.E11.1.454.CMB.1.raw
  modified_base (327)..(327): a, c, t, g, unknown or other
  misc_feature (327)..(327): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccaggggaaggggctggagtggatctcagctattagtggaggtggtagtggtagaaaacacatattacgcaggctccgtgaagggccgcttcaccatctccagagacaattccaaacacactactttatcttacaaatgaacagcctgcgagccgaggacacggcctatactacngtgcgagagatacgaacgacggcccgtgggacgcccggttgaaccttacggtcggggacccgaacggggtaacccctcgggtaccacccggttcccttacccgttacccaaccccgttaccccgaacccgaaccggggaccccctaacgttccccgggttaccctttcccccccgtggacccctacccccgttacccctaccgtaaacggaccgtaccacccgttccggtcgggggaccaaccggtacggcccgggtcccgtacggggccgtcggcccgttaggtaccgaaacgggtaacccttacccgtttacccggaccgttaaccgggtaacggacgttcggaacgggccggggtacctacggggaccgaagggccggtcagtaacgg

SEQ ID NO: 189546 - DNA, 992 bp, Homo sapiens
  misc_feature: GYAE6OF01EAQ6T.15.55.E11.1.454.CMB.1.raw
  modified_base (148)..(148): a, c, t, g, unknown or other
  misc_feature (148)..(148): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
tcagtctacgtagccacgaccggtgctcgatttagcactcgcacgttgggtttgggggaggcttggtacagcctggggggtccctgagactctcctgtgcagcctcaggattccgcctttcgcatctatcgccatgaccgtgggtccnccgaggcctccgaggggaaggggctggagtggatctcagtcttaagttaggtggaggttggtagtggtanaaaacnctatagttaccgcaggtcctccggtaggacgggtccgcttaccaccattcctaccgagaacgaacctaacttaacccaaaacaacctaccttaacttttacttaccgtttaacaaaagttacgaaacctacggtccttggaaccggacggacccggaagggaacccgtaccgggtacccgtttaacttaccttaaccgtgggtacgacggaagtacgtacgtaaccggaaccgtcggggaccccggtaggggacccgtccccgttaggaacccgtccggtaccgggggacccgtaaccggggaaccccttcgggtaccctacccggttaccgtaccccttaacccgtaaccccgtaaccccgaaaccccgggtaaaccgggaccccccgttacgggtttaccccccggtttaccccccgtttacccccccggttccgggaaccccccttacccccccgtttaccccggtaaaccccgtaaacccgggtacccgttaccccccggtaacccggttttacccggggaccccgggggacccaacccggtaaccccgggggtcccccggtaccccccggggttcgggtaccccgttaccgggttcccggttaaccgggtaacccgttaaaccggtaccccggtttaccccggttaccccgttaaccggtttaacccgggttaacccggtaaccgttccgggggtaaccggggtcccggggtacggtaaccgggggtacccgtaaacgggtcccgaaacgtaccgggtaacgg

SEQ ID NO: 189547 - DNA, 935 bp, Homo sapiens
  misc_feature: GYAE6OF01EU32B.15.55.E11.1.454.CMB.1.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtcccgcaggctccgaggggaagggctggagtggactctcagcttattagtggaggtggtagtggtagaaaacncagtattacgcaggtctccggtggaacgggccncttcacctatcctaccagagactaacttacccaaacaaacctactaacttttacgttacctttaaccaaaagttccgaaaacgtacgtcccgttacggaccgggaacggcccgggaaagggtacccgtaacccgggggtccttaaactaaccgtttaccgtacggttacgggacgaagggtaacgtaacggttaccggaaaacgtccggggaccccggttgggggaacccgttcccggttaaggaaccgttacgggtaccgggggaacccgtaaccgggggtaacccctttaggggtaccccgtaaccggtttccccttaccccggtaacccttaaacccccgccccgttaaaacccggaaccgggggttaccccctaaccggtttccccgggtttaccccgtttacccccccgttacgggacccccttacccccgttacccccgttaaccgaaccggttacccgaccccgtaacccggttacgggtccgggggtaacccaaaccggtccgggaccccgggtacccggttaccggggtcccgttaccggtcccggtttaccgggaaaccgtaaccgggttaaccctttacccggttcccggaccgttaaacggtacgttacccggttaggggacccgggtaccgggtacccggtacgggaacgaaccgggtaccggtagtaacgacgg

SEQ ID NO: 189548 - DNA, 826 bp, Homo sapiens
  misc_feature: GYAE6OF01B7L69.15.55.E11.1.454.CMB.1.raw
  modified_base (145)..(145): a, c, t, g, unknown or other
  misc_feature (145)..(145): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccnccaggctccgagggagggctggagtggatctcagctattaggtggaggtggtagtggtaagaaaacactattatacgcaggtctccggtaggaacgggtcctcttaccgacctattcctaccgaagtacgaacctaactttacccaaacgtaaacaaccttacttttaacttccgtttaacaaaattcgaaaccgacgtaccctggaccggaaccggcccggaacgggtacccgaaccgggtccgtaacttaccttaccggttggtacggacgaaaggtaggtaaccgttaccggaaaccgaccgggggtcccggtacggggaaccgttccccgggttagaacccggttacgggtcccgggggaacccgtaacgggggtaaacccccgttggttaaccccgttaccccggtaccttaccccgtaccgtaaccccgtaccccgaaacccggtaaccgggacccctaacgttccccggttaccccgtttcccccgcggtcccctaccccgttcccgtaaccgaaccgtacgcccgttaccgtccgggccgggaccaaccggccggtacccgggcccgtcgggtacccgtcggcccgtacggtaccggtaacgtaccttaccgtcccgacgttacgacgtaccggtggaccggcggtcgtacgggaccggtaggcgagcgtacg

SEQ ID NO: 189549 - DNA, 558 bp, Homo sapiens
  misc_feature: GYAE6OF02G7OUR.15.55.E11.1.454.CMB.1.raw
  modified_base (210)..(210): a, c, t, g, unknown or other
  misc_feature (210)..(210): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaagggtcgcttcaccatctccagagacaattccaacaacacactttatcttcaaatgaacagcctgcgagccgaggacacggccgtatactactgtgcgagagatcgaacaggcccgtgggacgcccgttgactacgtggggccaggggaaccctggtcaccgtctcctcaacctccaccaacgggcccagtcggtccttccccctcggccaccctcctccaacgacgccaccctcgtcggggccacgacgccggccctgggcctcgcctggtcacggacctacgttccgcgtacgtacgactgacgcgggctggcaaggcgcatacg

SEQ ID NO: 189550 - DNA, 228 bp, Homo sapiens
  misc_feature: GYAE6OF02GJY1V.15.55.E11.1.454.CMB.1.raw
  modified_base (174)..(175): a, c, t, g, unknown or other
  misc_feature (174)..(175): n is a, c, g, or t
  modified_base (177)..(178): a, c, t, g, unknown or other
  misc_feature (177)..(178): n is a, c, g, or t
  modified_base (180)..(228): a, c, t, g, unknown or other
  misc_feature (180)..(228): n is a, c, g, or t
tcagtctacgtagccacgaccggtgctcgatttagcactcgcacgttgggtttgggggaagaggaagactgacggtcccccaggagttcaggtgctgggcacagcggccctgggctgcctggtcaaggactacttccggctacgtagactgagcgggctggcaaggcgcatagnngnngnnnnnnnnnnnnnnnnnnnnnnnnnnnnnnnnnnnnnnnnnnnnnnnnn

SEQ ID NO: 189551 - DNA, 579 bp, Homo sapiens
  misc_feature: GYAE6OF02HII5L.15.55.E11.1.454.CMB.1.raw
  modified_base (238)..(238): a, c, t, g, unknown or other
  misc_feature (238)..(238): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccncttcaccatctccagagacaattccaacaacacactttatcttacaaatgaacagcctgcgagccgaggacacgggccgtaatactactgtgcgagagatcgaacaggcccgtgggagcccgttgactacgtggggccaggggaccctggtcaccgtctcctcacctccaccgaacgggcccacgtccggtccttcccccgtggccctacccctcccttacccgaacgcgaccacccgtcgtcggggccaccgacggccggcccgtgggcctcgcctggtccaacggtacctacgttccgtcgtacgtagacgtgacgcgggctgggacagggcgcatacg

SEQ ID NO: 189552 - DNA, 612 bp, Homo sapiens
  misc_feature: GYAE6OF02G2L8F.15.55.E11.1.454.CMB.1.raw
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttacaaatgaacagcctgcgagccgaggacacggcctatactactgtgcgagagatacgaacaggcccgtgggacgccgtgactacgtggggccagggaaccctggtccaccgtctcctcaaccctccaccgaacgggcccacgtccggtccttccccgtcggccacccctcctaccgaacgacgccaccgtcgtcggggaccacgacggccgggcccgtgggcctcgcccgttacggtaccgaacgggtaccttaccgttcccgtaccgttaaccggtacgtaccgtcggacgccggggtccgtcgggaccgaacgggccgtacgagtacgg

SEQ ID NO: 189553 - DNA, 594 bp, Homo sapiens
  misc_feature: GYAE6OF02FUNFC.15.55.E11.1.454.CMB.1.raw
  modified_base (238)..(238): a, c, t, g, unknown or other
  misc_feature (238)..(238): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccncttcaccatcctccagagacaattccaacaacacactttatcttacaaatgaacagcctgcgagccgaggacacggccgtatactactgtgcgagagatcgaacaggcccgtagggacgcccggttgacgtacgtcggggccagggaaccctggtcaccgtcctcctcacctccaccgaacgggcccagtccgtccttccccgtcggcccaccctcctacccaagacgccacccgtcgtcggggacaccgacgccggcccgtgggcctcgccgtcggtacaacgggtaccttaccgttccgaccgtacggtacgtaccgtaggacggcgggcgtcgggccgaagggccgacagtcg

SEQ ID NO: 189554 - DNA, 879 bp, Homo sapiens
  misc_feature: GYAE6OF02G1N3V.15.55.E11.1.454.CMB.1.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
tcagtctacgtagccacgaccggtgctcgatttagcactcgcacgttgggtttggggggagggcttggtacagccctggggggtccctggagtactcgtccttgtgcagcctcaggattcgcctttcgcatctatgccatgaccgtgggtccgccaggctcctagggaaggggctggagttaggatctcagctagttaggnggaggtggtagtggtagaaaacncgagtattacgcgaggcgtccggtgaaggccgcttcaccatcnccagagacaattccaactacactactttancttacaaatcgaacaggccctggacgacggcccggaagggaccgacgggtccgtaataccgttactggtacgacggtaaggagtacgttaccggaaacgacggggtacccgtagggggaaccttccccggttaagaacgttacggtcgggggacccaagggggtaaacccccttgggtacccaccggttccttacccgtaccgaaacccgtacccgaaacccggtaaaccggggtaccccctaacggttaccccgggttaccccgtttacccccggtaccggggttacccctaaacccccgtttaccccgtaaccccgtaaacgggttaacccggtaacccgtaaacccggttacccgggtaccgggggggaccctaaccgggaacccgggtaccccggggtaccccggtaccgggggtacccgttacccgggtacccgttacgggtaacccgtaaaccgggttaccgttacccgtttacccggtaacccgtttaacggttaaccggtaccgttacgggtaccgggtaccgggtaccggttacgggtaccggtaacgggtaccggtacggtacgttaacggg

SEQ ID NO: 189555 - DNA, 805 bp, Homo sapiens
  misc_feature: GYAE6OF02JS7AU.15.55.E11.1.454.CMB.1.raw
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtagaaaacacatattacgcaggctccgtgaacgggccgcttcaccatcctccagacgacaattccaacaacactactttatacttacaaatgaacagcctgcgagccgaggacacggccgtatactactgtgcgagagatcgaacgaggcccgtaggggacgtcccggttagaaccttacggcggggacccgaacggggtaaccccgttcgggttacccgacccggtttcctaccccgtacccgtaaaccccgttaccccgaacccggaaaccggggtacccccgtaacggttccccgggttacccccgtttaccccccgtacgggtaccccctacccccgttaccccgttaccccgaaacggaccgacccgtaaccccgttcccggtaccggggggacccaaccggtaccgggccccgggtccccggttaccgggggcccgttcgggtccccggttacgggtacccgtaacggggtacccttacccggtttcccggtacccggttaaacccggttacggtaaccggttaccgggtaccgggtccccggggtaccggttaccggggacccggtaaacggggcccggtaacccgtaggtaacgg

SEQ ID NO: 189556 - DNA, 681 bp, Homo sapiens
  misc_feature: GYAE6OF02IQQ6U.15.55.E11.1.454.CMB.1.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagtctacgtagccacgaccggtgctcgatttagcactcgcacgttgggtttgggggagggcttggtacagcctggggggtcccgtgagactctcctgtgcagcctcaggattcgcctttcgcatctatgccatgacctgggtccgccaggctccagggaaggggctggagtggatctcagctattagtggaggtggtagtggtgaaaaacncatattacgcaggctccgtgaagggccncttcaccatctccaganacaattccaacaacacactttancttacaaaagtgaacagcctgcagccgaggacacggtccgtataactactgtcgacgaagagttaatacggaaccaggccccggtggggaacgccccggttgaacgtttacgcggggggaccaacgggggtaacccctgggggttccaacccggttctacccttacgtaaaccctcccgtaaacccgaacgggaccccagttccgggttcccttaccccccgttcgggacccaaccccttcccgttaacccaaggtaccggaccacccgttcgccggggggccaaccgtacggcccgggccctcggggccttagcccgttggtccgaacgtctaccgttcccgcgttaacgtcgacttcggacggccgggtctacgggacgtaagggccgacgagtacgg

SEQ ID NO: 189557 - DNA, 610 bp, Homo sapiens
  misc_feature: GYAE6OF02JWJ0B.15.55.E11.1.454.CMB.1.raw
  modified_base (238)..(238): a, c, t, g, unknown or other
  misc_feature (238)..(238): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaagggctggagtggatctcagctattagtggaggtggtagtggtagaaaacacatattacgcaggctccgtgaagggccncttcaccatcctcagagacaattccaacaacactactttatcttacaatgaacagcctgcgagccgagacacggccgtatactactgtgcgagagatcgaacgaggcccgtagggacgcccgttagaccgtacgtcggggaccacggggaaccctggtaccaccgttcgtcctaccacctccaccgacggcccacgtaccggtccttccccgtcggccctaccctccgaccaacgcgccaccgtcggtacgggaccacgacggccgcccgtcgggcgtcgccgtacgggtaccaacgggtaccttccgtacccgacgttaccggacgtacgtcggacggtccgggactcgggaccgaacgggcgcgacgtcg

SEQ ID NO: 189558 - DNA, 569 bp, Homo sapiens
  misc_feature: GYAE6OF02I11KR.15.55.E11.1.454.CMB.1.raw
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (564)..(564): a, c, t, g, unknown or other
  misc_feature (564)..(564): n is a, c, g, or t
  modified_base (568)..(569): a, c, t, g, unknown or other
  misc_feature (568)..(569): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaaacaacctgagagccgaggacacggctgtgtattactgtgtgagagatgttctgcggttgggcagggaaccctggcaccgtctcctcagccctccaaccgaacgggcccagtccggtcccttcccccgnggccgccctgcctccgaggcnccacccgtccgagacgccacgagccggcccgtgggcctcgccgtggtacgaacggtacctaccgttcccgacgttaccgtacgacgtcgggaacggccgggcgtcgggaccgaacgggccgacgtaagtagntagnn

SEQ ID NO: 189559 - DNA, 619 bp, Homo sapiens
  misc_feature: GYAE6OF02GLQBO.15.55.E11.1.454.CMB.1.raw
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccaggggaagggggctggagtggatctcagctattagtggaggtggtagtggtgaaaacacatattacgcaggctccgtgaagggccgcttcaccatctccagagacaattccaacaacacactttatcttacaaatgaacagcctgcgagccgaggacacggccgtatactactgtgcgagagatacgaacaggcccggtgggacgtcccgttgacctacgtcggggccagggaaccctgggtccaccgtcctccctacaaccctccaaccgaacgggcccacgtccggtcccttcccccgtcggcccacccctccctacccaacgacgccacccgtccggtacgggggccacgacggcccggcccgtcgggcctcgaccgtggtacgaacggaccttaccgttcccgccgtaccggtaacgtacgcggacggcgggacgtcggacgaacgggcgtacgagtacgg

SEQ ID NO: 189560 - DNA, 637 bp, Homo sapiens
  misc_feature: GYAE6OF02GMXHD.15.55.E11.1.454.CMB.1.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaagggccncttcacatctccagagacaattccaacaacacactttatcttacaaatgaacagcctgcgagccgaggacacggccgtatactactgtgcgagagatacgaacacggcccggtgggacgtcccgttgaccgtacgtcgggggacccgacggggtaacccctgggtacctacccggtcctcctaccaaccctcccgaacccgaacgggccccacgtccggttccttacccccgtcggcccacccctcctaccaacgacgccacctcggtcggggccacgacggccggcccgtcgggcctcgccgtcggaccgaacgtaccgttaccgttcccgaccgttaaccggtacgtaccgtaggacggtccgggtcgtcggacggtaacgggcggacgtagtacgg

SEQ ID NO: 189561 - DNA, 591 bp, Homo sapiens
  misc_feature: GYAE6OF02GM7MO.15.55.E11.1.454.CMB.1.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (341)..(341): a, c, t, g, unknown or other
  misc_feature (341)..(341): n is a, c, g, or t
  modified_base (441)..(441): a, c, t, g, unknown or other
  misc_feature (441)..(441): n is a, c, g, or t
tcagtctacgtagccacgaccggtgctcgatttagcactcgcacgttgggtttgggggaggcttggtacagcctggggggtccatgagactctcctgtgcagcctcaggattcgcctttcgcatctatgccatgacctgggtccgccaggctccagggaaggggctggagtggatctcagctattagtggaggtggtagtggtgaaaacncatattacgcaggctccgtgaaggccncttcaccatctccagagacaattccaacaacacactttatcttacaaatgaacagcctgcgagccgaggacacggccgtatactactgtgcgagagatcgaacnggcccgtgggagcccgttgactacgtggggccagggaccctggtcaccgtctcctcaacctccaccgacggccactcgtcctcccctcggccaccctccnccaacgcgcacctcgtcggggccacgcgccggcccgtcgggcctcggccgtcggtaccgaacggtaccgttaccgttcccggcgttaaccggtacggtaaccgttcggacggtccgggtccgtcgggtaccgaacgggtccgacgtaacg

SEQ ID NO: 189562 - DNA, 632 bp, Homo sapiens
  misc_feature: GYAE6OF02H3JHT.15.55.E11.1.454.CMB.1.raw
  modified_base (145)..(145): a, c, t, g, unknown or other
  misc_feature (145)..(145): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccncaggctccagggagggctggagtggatctcagctattagtggaggtggtagtggtgaaaacacatattacgcaggctcgtgagggccnttcaccatcncaganacaattccaacacacactttatcttacaaatgaacngcctgcgagccgaggacacggccgtaatactactgtgcgagagatcgaacgaggcccgtggggacgtcccgttagaccttacggtcgggggacccaacgggggaaccctgggtacccaccgttctacccctacaaccctacccgaccgaaccgggaccctacgtccgtccctttccccgtcgaccctaccctccctaccgaacgacgcctaccgtcgtacggggcacgacgccggcccgtcgggccgtcgccgtacggtaccgtaacggaccttaccgttccgtaccgtaacggttacggtacgtcggtacggaccgggtcgtcgggaccgaacgggccgacagtacg

SEQ ID NO: 189563 - DNA, 592 bp, Homo sapiens
  misc_feature: GYAE6OF02HGGOD.15.55.E11.1.454.CMB.1.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccaggggaaggggctggagtggatctcagctattagtggaggtggtagtggtagaaaacncatattacgcaggctccgtgaagggccncttcaccatctccagagacaattccaacaacacactttatcttacaatgaacagcctgcagccgaggacacggccgtatactactgtcgcgagagagtcgaacaggcccggtgggacgcccgttgactacgtcggggccagggaccctggcacccgtctcctacacctccacgacggcccagtccgtccttccccncggccaccctccnccagacgccnctcgcggggcacgacggccggtccgtcgggtccgtcgcccgtcggtacgaacgggacctaccgttccgaccgttaaccggtacggacgtacggacggcgggtccgtcgggaccgacgggccggacgtagtacg

SEQ ID NO: 189564 - DNA, 759 bp, Homo sapiens
  misc_feature: GYAE6OF02J3B8X.15.55.E11.1.454.CMB.1.raw
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
tcagtctacgtagccacgaccggtgctcgatttagcactcgcacgttgggtttgggggaggcttggtacagcctggggggtccctgagactctcctgtgcagcctcgggattcgcctttcgcatctatgccatgacctgggtccgccaggctccgagggaaggggctggagtggatctcagctattaggtggaggtggtagtggtagaaaacnatatacgcaggctccgtgacgggcctcttcaccntctacagacgactaacttccaaacaacactactttancttacaatgaacngtccngcgacggccgaaggacacggtctataccgtcgtggtacgacgaagacgtactacggaacgcgggtcccggtagggaccgtcccgttgaaccgtcgggtcggggacccaacggggtacccttgggtaccctaccgttcctaccctaccgtaaccccgtaccgtaacccggaaccggtccccgtaccggttcccgggtttacccttcccccggtaccggtacccctaccccgttacccgtacccgaaccggtaccgacccgtacccggtccgggtaccgggggacctaaccggaccgggtacccggtcccggtccggggccgttaccggtcccggtacggtaacccggtaacggttacccgttacccgttacccgtaccgttaaccggtaacggtaccgtacgggacccgggtccgggtaccggtacgggaccggaccgggtaccgacgtacggtagcg

SEQ ID NO: 189565 - DNA, 545 bp, Homo sapiens
  misc_feature: GYAE6OF02HNVXD.15.55.E11.1.454.CMB.1.raw
  modified_base (145)..(145): a, c, t, g, unknown or other
  misc_feature (145)..(145): n is a, c, g, or t
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (346)..(346): a, c, t, g, unknown or other
  misc_feature (346)..(346): n is a, c, g, or t
  modified_base (438)..(438): a, c, t, g, unknown or other
  misc_feature (438)..(438): n is a, c, g, or t
  modified_base (539)..(539): a, c, t, g, unknown or other
  misc_feature (539)..(539): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccnccaggctccagggaaggggctggagtggatctcagctattagtggaggtggtagtggtgaaaacncatattacgcaggctccgtgaagggccncttcaccatctccagngacaattccaacaacacaacttttatcttacaaatgaacagcctgcgagccgaggaccacggcgtatactactgtgacgagagactcgaacnggcccgtgggacgcccgttgactacgtgggccagggaaccctggtccaccgtctcctcacctccacgacggccagtccgtcctcccgtgccnccctcctaccagcgccacctcgtcgggcacgcgccggccgtggctcgccgtgacacgtctacctccgcgtacgtcacgtgacgcggtcgcggaccgaggcncgatag

SEQ ID NO: 189566 - DNA, 788 bp, Homo sapiens
  misc_feature: GYAE6OF02GX89R.15.55.E11.1.454.CMB.1.raw
  modified_base (213)..(213): a, c, t, g, unknown or other
  misc_feature (213)..(213): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgaggggaaggggctggagtggatctcagctattagtggaggtggtagtggtagaaaacncatatacgcaggctccgtgaacgggccgcttccacctatcctaccagacgacaacttccaaacaaccactacttttactacttaccaaatcgaaacacgtcctgcggaacgccggagaccgacggccgtaatactctgtcgcgagagataccgaacgcggcccggtagggacgtacccggttgaaccgtacggtcgggggacccaacggggtaaccccttgggtacccacccggttcccttaccccgtaaccctaaccctaccccgtaaacccggaaccggggtaccccctacggttccccgggtttaccccgttcccccggtaccggtacccctacccccgttaccccgtaaccccgtaaaccggacccgtacccgacccgttcccgggtaccggggggtaccctaaccggaccgggtacccgggtccccggttacggggtcccttccggtcccggttaccggtaaccgtaacgggtacccttaccgttcccggtaaccgtaaccgtaacgtaccggtacgggtaccggtaccgggtcgtacgggtacggaaccgggccggtacgtacgtacgg

SEQ ID NO: 189567 - DNA, 528 bp, Homo sapiens
  misc_feature: GYAE6OF02FN8JU.15.55.E11.1.454.CMB.1.raw
  modified_base (510)..(510): a, c, t, g, unknown or other
  misc_feature (510)..(510): n is a, c, g, or t
  modified_base (512)..(528): a, c, t, g, unknown or other
  misc_feature (512)..(528): n is a, c, g, or t
tcagtctacgtagccacgaccggtgctcgatttagcactcgcacgttgggtttgggctcaactctcttgtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgagacacggccgtatactactgtgcgagagatcgaacgacggcccggtgggacgcccgttgacctacgtcggggccagggaaccctggtcaccgtctcctcaacctccaccgacggcccagtccggttcctcccccgtggcctacccctccctccgaacgacgccacccgtcgtacgggggcacgacggcccggcccgtcgggctcgccgtggacaacggacctaccttcccgacgttacgtagaccgtggacggccgggctcggcgacggcgcagtagngnnnnnnnnnnnnnnnnn

SEQ ID NO: 189568 - DNA, 669 bp, Homo sapiens
  misc_feature: GYAE6OF02FGVDS.15.55.E11.1.454.CMB.1.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgaccctgggtccgccaggctccgaggggaagggctggagtggatctacagctagttagtggaggtggtaggtggtagaaaacacatacttacgcaggcctccgtaggaagggccgcttccaccatcctaccaggacacctaactttaccaacaaccactacttttatcttacaaatcgaacagccctgcgagccggagacncggctanctagtgngcgagagctacgacgacggccgtgggaccgtccgttgaccgtgtcgggccgtacgggaacccgtggtaccaccggttctcccgtacctaccgtccaaccgacggccccagtccggttaccctccccgtacggccctacccctccgtaaccgaacggtacctacccgaaccgttcggtaccggggccaaccgggacgccccgggtacccgtgggcccttcggcccgttcgggtacgacccgtaccgttacgttcccgacggtttccggaacgttcgtacggtcggacgggtctacggggactaacggcctccgtagtaccgg

SEQ ID NO: 189569 - DNA, 742 bp, Homo sapiens
  misc_feature: GYAE6OF02HOO9F.15.55.E11.1.454.CMB.1.raw
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccgaggggaaggggctgggagtggatctcagctattaggtggaggtggtagtggtagaaaacacatattacgcaggctcgtagaggtcncttcaccntctcagagactaacttccaacaacactactttatctacaatgaacncgctgcgagccgaggaccacggacctatactacgtgcgacgagagacgtacgaacgcggcccggtaggggaccgtcccggttagaccgttacgggtcgggggacccgtaacggggtaaccccttgggtacccctacccggtttaccttacccctaccgtaacccctaccccgaaacccggaaccgggaccccgtacggttccccggtttccccgttacccccggtccggacccctaccccgtaccccgtaccgaaaccgccggtaccctacccgtccgggtaccggggaccaccggaccggcccgggtaccccgtcgggaccgttccgggtccgtacggtacgtaaccggtaccgttacccgttaccggtaccgttaacggtaccgtacggtacggaccgggtccgggtaccggtacgggacccggtacgggaccgtacgaggtacg

SEQ ID NO: 189570 - DNA, 1112 bp, Homo sapiens
  misc_feature: GYAE6OF02ILSNJ.15.55.E11.1.454.CMB.1.raw
  modified_base (145)..(145): a, c, t, g, unknown or other
  misc_feature (145)..(145): n is a, c, g, or t
tcagtctacgtagccacgaccggtgctcgatttagcactcgcacgttgggtttgggggaggcttggtacagcctggggggtccctgagactctcctgtgcagcctcaggattcgcctttcgcatctatgccatgacctgggtccnccaggctccgagggaagggctggagtggatcgtacagctattaggtgggaggtggtaggtaggtacgaaaaactactataacgttaccgcgacggtacctcccggtaggaaacggggtccgtaccgtttaccaccctaagtcccttaccgaagaacgaacctaaagtttacccaaaccgtaaaccaaccttaaccttttaactacctttaaacaaaacgttcgaaaacgtaacggtacccgtacggtaccgggaacggtaccccgggaacgggtaaccgtaaccggggtacccggttaaataaccgttaaccgttacgggttacgggacccggtaagtaacgggtaacctaaccggaaaccggtacggtacccgggtttacggggaaccgttccccgggttaacggtaacccgtacgggttaccggggggaacccgtaaccgggggtaaaaccccttcggggttaaccccgtaccccggtttcccgtaccccgttaaccgtaaccccgttaccccggaaacccggtaaaccggggtacccccgtaacgggtttacccgggttaccccccgttttacccccgggtaacgggttacccccgtacccccgtttaacccggttaaccccgtaaaacggttaacccgggtaccccgttaaccccggtttaaccgggggtaacccggggggtaccgtaaacccgggtaccggggtacccccgggttaaccccggggttaccggggtaccccgtttaaccggttcccccggggttaaacccgggttttaaacccgggaaaaccccgggggttttttaaccccgtttaacccggggtttacccccggtaacccgggttttaaaaccggggtaacccggttaacccgggtttaacggggaacccggggttacccgggtaccggttacgggggtaaccccggttaaacgggggcccttaccgggtaaacgtaccggg

SEQ ID NO: 189571 - DNA, 872 bp, Homo sapiens
  misc_feature: GYAE6OF02JHMZI.15.55.E11.1.454.CMB.1.raw
  modified_base (144)..(144): a, c, t, g, unknown or other
  misc_feature (144)..(144): n is a, c, g, or t
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
tcagtctacgtagccacgaccggtgctcgatttagcactcgcacgttgggtttgggggaggcttggtacagcctggggggtccctgagactctctgtgcagcctcaggattcgcctttcgcatctatgccatgacctgggtccnccaggctccgaggggagggctgggagtggatcngagtcttatggnggaggtgggtagtggtagaaaacacattaacgttacgacgtaggctccggtagggaacgggccctcttaccaacctgttccctccgaaggtaataacccttaaattacccgaaaaccaaactaaccgttactttttaacaccgtttaaactaaaacgtacgaaacctacgccccgttagggaaccgacgggaccggttaacggaacccggtaccccggggttactaaacgtttaacctaccggtagttacccgggagaaccgtacgtaggtaacccgaaacgggtccggcccgggttaggggaacccgttcccggtttaagacccggttacgggtaccggggggacccgtaaacggggggaaccccctttggggtacccctaaacccggtttccccgttacccggtaaacccgtaaccccgttaaccccgaaccccgggtaaaccggtccccgtaaccggttccccgggttcccgttacccccggtcgtaccccgtaccccttcccttaaccggaaccgtacgtcccgtaccgttaccggtaccgggtccgaaccgaccggtcccggccggtcggtaccgtccgtccggtacggtaccgtaacgtaccgttaccgttaccgacggttacgaacggtacgtcggacggtccgggtcgtacggacggtacggtcggacgtcgacg

SEQ ID NO: 189572 - DNA, 786 bp, Homo sapiens
  misc_feature: GYAE6OF02G21G6.15.55.E11.1.454.CMB.1.raw
tcagtctacgtagccacgaccggtgctcgattttagcactcgcacgtttgggtttggggggaggcttggtacagcctggggggtccctgagactctcctgtgcagcctcaggattcgcctttcgcatctatgccatgacctgggtccgccaggctccgaggggaaggggctgggagtggatctcagctattagtggaggttggtagtggtagaaaacacaattattacgcgaggtcgtccggtggaacggggccgtcttccacctactcctccaggacaactaacttaccaaacaacactactttatcttacaaatacgaacacgcctgaccgacggacggacggacgaccggtcgtaatactacgttgtgacgagacgactacgaacggacggtacccggtagggaccgtcccggttaggaccgttacgggtccggggaccgaacgggggtaacccttagggtccctaacccggttccctacccgtacccgaacccgtacccgaaaccccggtaaaccgggcccccgtaacggttccccggtttaccccgtttccccccggtaccggtaccccgtacccccttacccgttaacccgaacggacggtacccgtaacccgttccgggaccggggaccctaaccgaccgggtcccgggacccggtggggttccctcgggtacccgtcggtaaccggtaacgtaccgttaccgttccgtacgttccggtaacggttacgtacggtacgggtccgggtacgtcgggaaccgtaggtcccgagtacgtagg

SEQ ID NO: 189573 - DNA, 845 bp, Homo sapiens
  misc_feature: GYAE6OF02F5OC2.15.55.E11.1.454.CMB.1.raw
  modified_base (114)..(114): a, c, t, g, unknown or other
  misc_feature (114)..(114): n is a, c, g, or t
  modified_base (197)..(197): a, c, t, g, unknown or other
  misc_feature (197)..(197): n is a, c, g, or t
  modified_base (840)..(840): a, c, t, g, unknown or other
  misc_feature (840)..(840): n is a, c, g, or t
tcagtctacgtagccacgaccggtgctcgatttagcactcgcacgttgggtttgggggaggcttggtacagcctggggggtccctgagactctcctgtgcagcctctggattcnccttgagcactttattggatgacttgggtccgccaggctccgagggaagggctgggagtgggtcggcccacataacaaaagtntaggaagtgacacaacctatgtacgtaactcgtgtagagtcgggtacgtacttaccgtaccgttctaccgaaggacgtaccggaccgaccgaaacgtaacctctaaccgtactaactccgtataacctaaaagttcgaaaacctaaccggtggaacggtacggtacccggtaacgggaaccgtaccgggacgtttaggtacgttaagtttaccgttggtacggttaaggtaggaacgttaagttcgttacggtggtaccggggtttacggggacccggtaacgggtaaccctcgggttacctaccggtttccctaaccgttacgaccgtcccgttaaacccgaacccggtaaaccggggtcccttaacgggttccccggttacccgttaccccggtcgggtacccgttacccgtcggtacccgaccggacgggtaccctaccgtaccgtaccggaggtaccgtacgaacgtaccgggtacccggtacccggttgggtaccgtaccggtaccgttaccgggtaacgtaacccgttaccgttaccgttacccgtaccgttaaccggtacggtacgtcgggtcgggtaccgggacggttaccggtaaccggaccggtccggtacgtaaccgttcgaacgtgtacgngtacg

SEQ ID NO: 189574 - DNA, 184 bp, Homo sapiens
  misc_feature: GYAE6OF01DFIHQ.24.6.A06.1.454.CMB.1.raw
  modified_base (178)..(184): a, c, t, g, unknown or other
  misc_feature (178)..(184): n is a, c, g, or t
tcagactactatgtcacgaccggtgctcgatttagatctactgacaacacacgaagggcccatcggtcttcccctggcaccctcctccaagagcacctctggggcacagcggccctgggctgcctggtcaaggactacttccctcgtctctactgagcgggctggcaaggcgcatagnnnnnnn

SEQ ID NO: 189575 - DNA, 210 bp, Homo sapiens
  misc_feature: GYAE6OF01BRLG4.24.6.A06.1.454.CMB.1.raw
  modified_base (188)..(210): a, c, t, g, unknown or other
  misc_feature (188)..(210): n is a, c, g, or t
tcagactactatgtcacgaccggtgctcgatttagatctactgactaacgtacgtacgaagggcccatcggtccttcccctggcaccctcctcaagagcacctctggggcacagtcggccctggctgcctggtcaaggactacttccgacagtagtagtctgagcgggctggcaacggcgcaactagnnnnnnnnnnnnnnnnnnnnnnn

SEQ ID NO: 189576 - DNA, 185 bp, Homo sapiens
  misc_feature: GYAE6OF01CCSZB.24.6.A06.1.454.CMB.1.raw
  modified_base (178)..(185): a, c, t, g, unknown or other
  misc_feature (178)..(185): n is a, c, g, or t
tcagactactatgtcacgaccggtgctcgatttagatctactgacaacgacacaagggcccatcggtcttcccctggcaccctcctccaagagcacctctggggcacagcggccctgggctgcctggtcaaggactacttccacatagtagtctgagcgggctggcaaggcgcatagnnnnnnnn

SEQ ID NO: 189577 - DNA, 218 bp, Homo sapiens
  misc_feature: GYAE6OF01B9MSG.24.6.A06.1.454.CMB.1.raw
  modified_base (178)..(218): a, c, t, g, unknown or other
  misc_feature (178)..(218): n is a, c, g, or t
tcagactactatgtcacgaccggtgctcgatttagatctactgacaacgacacaagggcccattcggtcttcccctggcaccctcctccaagagcacctctggggcacagcggccctggctgcctggtcaaggactacttccctgtctctactgagcgggctggcaaggcgacatagnnnnnnnnnnnnnnnnnnnnnnnnnnnnnnnnnnnnnnnnn

SEQ ID NO: 189578 - DNA, 200 bp, Homo sapiens
  misc_feature: GYAE6OF01A5XY9.24.6.A06.1.454.CMB.1.raw
  modified_base (178)..(200): a, c, t, g, unknown or other
  misc_feature (178)..(200): n is a, c, g, or t
tcagactactatgtcacgaccggtgctcgatttagatctactgacaacgacacaagggcccatcggtcttcccctggcaccctcctccaagagcacctctggggcacagcggccctgggctgcctggtcaaggactacttccacatagtagtctgagcgggctggcaaggcgcatagnnnnnnnnnnnnnnnnnnnnnnn

SEQ ID NO: 189579 - DNA, 188 bp, Homo sapiens
  misc_feature: GYAE6OF01BX5SE.24.6.A06.1.454.CMB.1.raw
  modified_base (179)..(188): a, c, t, g, unknown or other
  misc_feature (179)..(188): n is a, c, g, or t
tcagactactatgtcacgaccggtgctcgatttagatctactgacaacacgacaagggcccatcggtcttccccctggcaccctcctccaagagcacctctggggcacagcggccctggggctgcctggtcaaggactactccacatagtagtctgagcgggctggcaaggcgcatagnnnnnnnnnn

SEQ ID NO: 189580 - DNA, 195 bp, Homo sapiens
  misc_feature: GYAE6OF02H0GRH.24.6.A06.1.454.CMB.1.raw
  modified_base (178)..(195): a, c, t, g, unknown or other
  misc_feature (178)..(195): n is a, c, g, or t
tcagactactatgtcacgaccggtgctcgatttagatctactgacaacacgacaagggcccatcggtcttcccctggcaccctcctccaagagcacctctggggcacagcggccctgggctgcctggtcaaggactacttccacatagtagtctgagcgggctggcaaggcgcatagnnnnnnnnnnnnnnnnnn

SEQ ID NO: 189581 - DNA, 183 bp, Homo sapiens
  misc_feature: GYAE6OF01E0WX9.1.32.C10.1.454.CMB.1.raw
  modified_base (183)..(183): a, c, t, g, unknown or other
  misc_feature (183)..(183): n is a, c, g, or t
tcagacgagtgcgtcacgaccggtgctcgatttagtatagacatcaacacacaaagggcagaactttgttacttaaacaccatcctgtttgcttctttcctcaggaactgtggctgcaccatctgtcttcatcttcccgccatctgaacgcactcgtctgagcgggctggcaaggcgcatagn

SEQ ID NO: 189582 - DNA, 521 bp, Homo sapiens
  misc_feature: GYAE6OF01CKCSI.1.32.C10.1.454.CMB.1.raw
  modified_base (278)..(278): a, c, t, g, unknown or other
  misc_feature (278)..(278): n is a, c, g, or t
tcagacgagtgcgtcacgaccggtgctcgatttagtatagacatcaacacacaaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacncccctaacctcctgatctatgctgcagccatttgcaaagtggatcccagtcgaggttcagtggctaggtgggtctgggacagtattttctctctcacctattagctagtctgactaactgaagtacttttgactaactttactactgtacaactagtaattactaatttcgaccctatcctacgttcggaccgtaagggaccaacgactggaagtaacgttaaacgactagcgtcgtgtaccg

SEQ ID NO: 189583 - DNA, 832 bp, Homo sapiens
  misc_feature: GYAE6OF01A26JH.1.32.C10.1.454.CMB.1.raw
  modified_base (358)..(358): a, c, t, g, unknown or other
  misc_feature (358)..(358): n is a, c, g, or t
  modified_base (806)..(806): a, c, t, g, unknown or other
  misc_feature (806)..(806): n is a, c, g, or t
tcagacgagtgcgtcacgaccggtgctcgatttagtatagacatcaacacacaaaggggagtctcagtcaggacacagcatggacatgaggtccccgctcagctcctgggctcctgctactctggctccgaggtgccagatgtgacatccagatgacccagtctccatcccgtccctgtctcgcatccataggagacagagtaccacatcctacttcggtccggacaacgacctaggacgtacctaacttaacctaaaccttaagttttacggtaaactttaggtacttaacgtaaacggttttaaaaccgaaacgggtaaaccgtaccccctaaaacgttccctagtacttaccgtntacgtctacgcctaacgttcctaacgtttagaccgtaaagggttccgggtctaccgtaacgtaaccgttaaaccttcgtacggttacggtcccggtagtccgttacggtaacggtaccgtaacgttactttacgtacccttacgtaacctaccgtaacgttccgtaacggtacgttacgtttaccggaaacccgttaacccgtaaggtttaaccccgttttaacgtttaacttaccccggttttaaaaccttacccgtttaaacggttccgttaaaccctaaggtttaaccgggtacccggtttttaacggttccccgtccctttaacgggtccgttaacccgggtaccggtaaccgggtaaaccgacggtaaggtaaacccgggttaaaacaaccggtaaccgttaagggtccgttacccggtaacgtacccgtaccgtaaaccgtnttttacccgtagttaacccttcccgg

SEQ ID NO: 189584 - DNA, 545 bp, Homo sapiens
  misc_feature: GYAE6OF01BQBR9.40.53.E09.1.454.CMB.1.raw
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctccaggaaccggcccccaaactcctcatctatgataatagtccacccggccctcgacggggtacctgaccgattctctggcctccaagtctggccacctcacgccctccctggccatcagtcgggctccgagtctgaggatgaggctgattatcacgtgtgcagtccgtgggatcgacacgcctgtaagttgggttgggtcgggttccggggcgggggaccaggccgtcggacccgttaccgtaagtaccacgtcccgaggtcccg

SEQ ID NO: 189585 - DNA, 670 bp, Homo sapiens
  misc_feature: GYAE6OF01AY0LO.40.53.E09.1.454.CMB.1.raw
  modified_base (208)..(208): a, c, t, g, unknown or other
  misc_feature (208)..(208): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggtnagagggtcaccatctcttgttctggaagcagactccaaacatacggaaagtaatactagtaaactggtaccagcagcctacccgaaggaacccgacccccaaactcctacactctatgaataatacgtccacccggtccctacgacggggtacctggaacccgtattcctcgtcggcctacccgtaaagttccgtacggacctacccttcgacgtccctcccgtggcctacgtcgacgggtcgggtcctccgtagttcgtaggacggtagtacggacggtcctagtaactttactacgtacgttgtcgactacgttccggtagggtactacggaacgtacgtaccgtaggtaacggttggggtttcggggttcggggttccgggggaccggggggtaaccacgggtccgtacggtacccggttaccgtaacggtaccgaacggtccccgtaacgggtccccg

SEQ ID NO: 189586 - DNA, 899 bp, Homo sapiens
  misc_feature: GYAE6OF01AS0B9.40.53.E09.1.454.CMB.1.raw
  modified_base (209)..(209): a, c, t, g, unknown or other
  misc_feature (209)..(209): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggtnagaggtcacctatctcttgttctggaagcagactaccaactagtacggaaagttaatactacgtaaaacgtcggtaccagaccacgcctacccgaacgggaacccgacccccctaaaacttccctacacttaccgttaatacgtaattaaacttacgtacccgaccccgggtacccctacggtaaccgggggttaccctacggaacccgttactttacccgtcgtaccgggtccctttaaccgaacgttcccgtacgggtacctaacccgttccgaacccgtccccgttcccccgttagggaccccctagttacccggtaacggggttccgggtacccgttacccgtaaccgggttcgttaacgggtaagggtaacggttacgggtaacggtaccgtttaaggttaacttttaaccgtacgttaaccggtcggtacgtacccgtaacggtttcccggtaagggtaacgttacggtaaccttacgggttacccggttaaggttaaccgggtttaggggggttttaccggggggttacccgggggtttacccggggggggtacccgggggggaaaccccggtaacgggttcccgggttaaccgggttaaccccccggggtttaaaccgtttaaacccggggtacccggttaaacccggggaaccccccggttaaaccggggttccccccggg

SEQ ID NO: 189587 - DNA, 801 bp, Homo sapiens
  misc_feature: GYAE6OF01D4BUT.40.53.E09.1.454.CMB.1.raw
  modified_base (250)..(250): a, c, t, g, unknown or other
  misc_feature (250)..(250): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcacccctcctcactcactgtgcagggtcctgggcccagtctgtgctgactcagccaccctcagcgtctcggggacccccgtcagaggtcaccatctcttgttcgtaggaagcagactaccaanagtacggaaagtaatacgtagtaaaactggtaaccagacacgtcctaccccgaacggaacccggaccccctaaactcctacacttctatagtaactaagtacgtcccgacccggtccctacggacgggttacctacggtaccgtagttcctcgtcggtaccttaccgaagttccgtacggacctaccctacgaccgtccccttccccgtggaccctacgtcggacggtcgggtacccttccgtacggttcctagggtaacggtagtagggtaacggtcttaggttaactttcgtaccgtacgtttaggtcgtaccgttaacgttcccgggttaaggggtactaccggtaaccggtacggttacccggttagggttaaacgggtttgggggggtttaccgggggtttaccggggggtttacccgggggggaacccggggggggtaaacccgtaaacgggttcccgggttaaccccgggttacccccgggtttaaccggttaaaccggttacccgggaaccccggttaccccgggtaccggggttacccccgg

SEQ ID NO: 189588 - DNA, 688 bp, Homo sapiens
  misc_feature: GYAE6OF01CDXOE.40.53.E09.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccacctnacgcgtcgtcgggacccccggtnaggaggtcaccatctcttgtctggaancagatccaacagtacggaaagtaatacgtagtaaaacgtcggtaccagtcacgcctacccgacggaaccggaccccctaaactcctacacttacctatacgaataacgtacgtaccgacccggtccctacggacggggtaccctacggaccgtacttctcgtggaccttaccaacgttctacggctacccgtcgtaccgcccttccgtcgacctagtccgacgggtacgggtcctccggacgttacgtacggaggtactaggtacggtcgtacgtaagtttacacgtactcggtcacttacgtcgtagggacgttcgaccgtagtcccgttaggtaacggtttcggggttaggggttaccggggttccggggaccggggggtaacctagggttccccggtaggtaaccccggttcgtaacggtaccctaaccggcccggtaacggtccccgg

SEQ ID NO: 189589 - DNA, 704 bp, Homo sapiens
  misc_feature: GYAE6OF01CGDT9.40.53.E09.1.454.CMB.1.raw
  modified_base (211)..(211): a, c, t, g, unknown or other
  misc_feature (211)..(211): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctcgggcccagtctgtgctgactcagcccaccctcagcgtcgtcgggacccccggtnaggacggtccaccattctctttgttcgtggaagcagactccaaacagtacggaaagtaaactaacgttacgttaaaacgttcgggtaacccaaggaccacgtcccgtacccccgaacgggtaaaccccggaacccccctaaaaccgttccctacacgttacctaactagaaattaacgtacgtacccaccccgggccctacggtacgggtaccctagaccgtattcctcgtcggtcctacgaagttcncggcctacctcnccgtccctccgtcgctactcgacggtcggcctaccgtgtcgtgaggtgtacgtaggtctagtatttaacgctacgttcgtcgtacgtacgtaccggtgggtattaccgacgtacgtaccgtagggttacggttgggggttcgggttcggggtaccggggacgggggtaacccgtaggtaccgttaccgggaccgttacgtaaccggacgaacccggtcccggaacggtccccg

SEQ ID NO: 189590 - DNA, 751 bp, Homo sapiens
  misc_feature: GYAE6OF01BUP40.40.53.E09.1.454.CMB.1.raw
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcacgccaccctcagcgtctcgggacccccggtcaggacgggtcaccatctcttgttctggaagcagactccaacatcggaagtaatactagtaaactggtaccagcagcctcccgaggaacccgcccccaaactcctacatcctatgataatacgtccacccggcctcgacgggtaccctcgaccgtattctcgtcggcctaccaagtccgtcggacctaccctcgaccgtcccttcccgtcgggccctaagtccgacgggttcgggcccttaccccgaggttcccgtagggaacgggtagttacgggaacgggtccttaggtaacttttacgtacctaacgttcggtacgtacctacggttcccgggttaggggtaaccttacgggtaacccaacggttacccggttaagggttaaacgggtttcggggggttttacgggggttaccggggtttcccgggggggaacccgggggggtaaacctaaccgggttcccggttaacccgggtaaccccggttaacccggttaacgggttacccggaaccggtacccccggtaacgggttccccccggg

SEQ ID NO: 189591 - DNA, 589 bp, Homo sapiens
  misc_feature: GYAE6OF01BHGYE.40.53.E09.1.454.CMB.1.raw
  modified_base (208)..(208): a, c, t, g, unknown or other
  misc_feature (208)..(208): n is a, c, g, or t
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggtnaggaggtcaccatctcttgtctggaagcagactccaaacagtcggaaagtaactactagtaaactggtaccagcagcctcccgaggacccgaccccaaactcctnatctatgataatacgtccaccggccctacgacgggtacctgacctattcncgtcggcctacaagtcgtcgccacctcacgtccctccgtcgacctagtcgacggtcggccttccgacgtctaggacggataggacggtctagtacttacgtcacgttcgtacgctacgtccgtaggtatcgacgtacgcgtaggtacgttgggttcgggtcggttcggggaccggggaactcggtcgtcgtacccgtacgtacgacgaccgaccggtacggtcccg

SEQ ID NO: 189592 - DNA, 821 bp, Homo sapiens
  misc_feature: GYAE6OF01BDFP1.40.53.E09.1.454.CMB.1.raw
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggtcaggagggtcaccatctcttgttctggaagcagactccaacatcggaagtaatactgtaaactggtaccagcagcctaccgaaggaaccggaccccccaaacgtccctacactctatgtaataatacgtccaccggccctacgacgggggttaccctcggaacccgtatttctacgtcggtaccttaccgaagttccgttacgggaccgaacccttcgaaccggtccccttccccgtacgggtccctaactccgaacggttccggggtccttaccgtaacgttccgtaggtaacgggagtacgggtagggtccgttaggttaactttaacgtccgttaaccgtggttaccgtacttaacccgttcccgggttaacggggttacttaccgggaaccgtacccggttaaccgtttacgggttaaaacgggttttcgggggtttaccggggggtttacggggggtttacccccgggggggttaaccggggggggaaaccccgttaaaacgggggtccccggttaacccgggggttaaaccccggttttaaccccgggtaaaccgggtttacccggtaaacccggtaccccccggggttaaaacggggttcccccggg

SEQ ID NO: 189593 - DNA, 862 bp, Homo sapiens
  misc_feature: GYAE6OF01CHYXC.40.53.E09.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcacccctcctcactcactgtgcgagggtcctgggcccagtctgtgctgactcagcccaccctnacgcgtcgtccggggaccccccgtnaggtacgggtcaacctattccttcgtttcgttccgtaggaacgtcaaggtaactcccaaactagtaccggtaaattaaacgttacgtagttaaaaccgtcggtaaccaagccacgccgtacccgaacggaacccgtacccccaaacctccttacagttctatagaacttaatacggtccgaacccggtcctacggtacgggtacctacgaccgtactttccgtcgtcggtacctaccgtaacgtccgtcgggtaccctacccgtccgtacccgtccccgttcccgtacggacccgtacgtaccggtacgggtcgggtaccctacccgttacggttccgggtaacgggtaacggtacggtacgggtacccgggtaccgtttaaggtaaccttttaccgtacgttaacccgtttcgggttaccggaaccgtttacccgggtccgggttaacgggtaacttaccggaaccgttaccggttacggttagggtaaacggggttttcgggggtttacgggggttccggggggtttaccgggggaaacccgggggtaacccggttaaacggtccccggttaacgggttacccggttaaacccgttaaccgggttacccggaacccggtaccccgggtttaacggtccccccggg

SEQ ID NO: 189594 - DNA, 705 bp, Homo sapiens
  misc_feature: GYAE6OF01B1L12.40.53.E09.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (685)..(685): a, c, t, g, unknown or other
  misc_feature (685)..(685): n is a, c, g, or t
tcagtctagcgactcacgaccggtgctcgatttagagagagtgtgttgggtttggggagcttcagctgtgggtagagaagacaggactcaggacaatctccagcatggccagccttccctctcctcctcaccctcctcactcactgtgcgagggtcctcgggcccagtctgtgctgactcacgcccacctcacgcgtcgcggaccccgnaggaggtcacgatctcttgttcaggaanacagactacaaacagtaacggtaaagtaactacgtaacgtaaaacgtggtaaccacgacacgtccgtacccgaacgggtaaaccccgaccccaaactccctaacgtaacttactaagtactaaagttaactaccgtcccgtaacccggacccgtaacggtaaccgggtacctaccgaccgttattccgtacggtcgactaccgtaaagttcgtacgacctaaccctctacgtcccctaccgtcggtaccaagttccgagggttccgggacctacgtagttacgtagaacggtactgggaacgtctagttaatacgttacgaacgttggaactctacgttccggaagtaggtacacgtcggtaactcgggttaaggtttcgggggtacggggttacggtcccggggggaaaggaccaagtccgggttaccgaacgtaccttaacggacncccggtaaccggagtccccg

SEQ ID NO: 189595 - DNA, 862 bp, Homo sapiens
  misc_feature: GYAE6OF01DR1KR.40.53.E09.1.454.CMB.1.raw
  modified_base (691)..(691): a, c, t, g, unknown or other
  misc_feature (691)..(691): n is a, c, g, or t
tcagtctagcgactcacgaccggtgctcgatttagagagagtgtgttgggtttggggagcttcagctgtgggtagagaagacaggactcaggacaatctccagcatggccagccttccctctcctcctcaccctcctcactcactgtgcgagggtccgtcgggccctagtctgtgctgacctcgacgccctaccgtcgagtcgtccgtccggggacccccgtgacggacggtaccaaccgtattccttcgtttcggttacgagggaacgaccgtaagtaaccgtaccaaaccgtaaggtaaacccgggtaaattaaaccgttaccgttaaacggttaaaaacccggttcgggtaaacccacggtaccgaaccggtaccccgtaacccccggaaaccgggggtaaaccccccgtaaccccccctaaaaccgttcccgttaacctaccttaaccgtaagtaacggtaaacttaaacgtaccggtaaccccgtaccccgggtacccgttaacgggtaacggggttaaccctacggtaacccgttatttcccggtcgttaccgggtaccttaaaccccggtaggtacccggtacgggaccccttaccgtacccgtaccggtcccccgttccgtaacgggtacccttacgacggttaccggacgggtacctacccggtagttcgtaggaccggttntaggtacgtacgttagacttttacgactcggtagtccgtaacgtacgtacgggtagacgtcgaacgtacgtcgtacgggttaggttcgggttacgggttccggggtacccggggagggtactacggtacccgtacgtacccgttacgacgacgacccgtcggacgttcccg

SEQ ID NO: 189596 - DNA, 863 bp, Homo sapiens
  misc_feature: GYAE6OF01BMKTD.40.53.E09.1.454.CMB.1.raw
  modified_base (148)..(148): a, c, t, g, unknown or other
  misc_feature (148)..(148): n is a, c, g, or t
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
tcagtctagcgactcacgaccggtgctcgatttagagagagtgtgttgggtttgggagcttcagctgtgggtagagaagacaggactcaggacaatctccagcatggccagcttccctctcctcctccaccctcctcactcactgtcncgacggtcctcgggcccagttctgtgctcgactcacgcccacctcacgcgtccgtccgggaccccgtgaggacggtccaaccgtnttccttcgttgttcgaggaancagtacctaccaaagtacgtacggtaaagttaaacgttacttaacggtaaaaccgttcggaaccacggacgaccgtacccggaaccccggaacggaaaccccccgtaaacccccaaactttccctaactacgtacttaaggtaactaacttaacggttccgtacccgaccccggtaccgtaaccgggtaacgggtacctccggtaaccgttctttacccggcgttaccggacccttacccggtaaagttcccggttaccggaacccttaccgtaccccggtacccggttcccccgtttcccggaccggtaacccttacggtccggtacgggtccgtaccgttacccggtacggtcggtaacgggtacggttacgtacgggacgttaccgttaacgtagttttaaccgcgttaaccgtcggttaaactcccggttacggtacccgggtagggttaccacggtaaccggtcgttaaccgggttagttaaccggggttggggtttacccgggggtacggggtaccgggggtaccgggttaacacgggttccctaaacccggtacccgtacggtaaccgaccccggtaccgtacccgggtacgtccccccggg

SEQ ID NO: 189597 - DNA, 804 bp, Homo sapiens
  misc_feature: GYAE6OF01ATRLJ.40.53.E09.1.454.CMB.1.raw
tcagtctagcgactcacgaccggtgctcgatttagagagagtgtggttgggtttgggggagcttcacgctgtgggtagagaagacaggtactcaggacaatctccagcatggccagcttccctctcctcctcgacccttctcactctacgttcgtgtcagggttccttgggccctatctgtgctgtactcacgccctacccgtcggacgtcgtccgtcgggacccccggtgaggacggtccacctatcctcttgtctaggacgctagactccaacgtactacggtaaattaactacgttacgtaaacgttcggtaacctagaccaacggtccgtaccccgaacggaaaccccggtaccccctaaaactcccgtacacgttacctagttacgaataacgtacgtccaacccggtccctacggtacgggttacctcggtaaccgtacttccgtacgtacgtacctaccgtaacgtcgtacgggacctaccgttacgaaccggtcccctttacccggtaccgtccctaagttaccgtacgggtaccggtaccttacccgtaacggttccgttaaggaaccgggttacgttaccgggtaacgtaccgtaggttaactttccggtactaccggtagttccgaacgtaccgttccgggtaacggacttacggcgttaacgtaccggtttaggtacggtttggggttacggggttccggggttaacgggggacccggggttaaactcggttaccggttaccggtaaccggttaacggtacggttaccgacccgggtaccgtcggtaccccg

SEQ ID NO: 189598 - DNA, 660 bp, Homo sapiens
  misc_feature: GYAE6OF02JLQP5.40.53.E09.1.454.CMB.1.raw
  modified_base (449)..(449): a, c, t, g, unknown or other
  misc_feature (449)..(449): n is a, c, g, or t
  modified_base (491)..(491): a, c, t, g, unknown or other
  misc_feature (491)..(491): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgtcagagggtcaccatctcttgttctggaagcagactccaaacagtcggaagtaatactagtaaaactggtaaccagcagcctaccgaaggaacccgacccccaaactccctacactctatacgaataatacgtccaccggcctacgacgggtacctaggacctattccgtctcggacctaccgaagtcgtcggacctaccctcacgccctccgtcgggccatcgaggtcggcctccgagttcgngaggatggacggtctaggtactttactcgtaacgttggtacnctaacgttccgtaggggtactcggaacctcggtaccttagggtaacgtttgggggttcgggttccgggttaccggggggaccgggggtaacctaaggggtcccgttaaccgggttacccgggttacccgttaagggtacccgtaaccggtacccggtaacgggtccccg

SEQ ID NO: 189599 - DNA, 581 bp, Homo sapiens
  misc_feature: GYAE6OF02INCCV.40.53.E09.1.454.CMB.1.raw
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaaacatcggaaagtaatactgtaaaactggtaccagcagctccaggaaccgcccccaaatcctcatctatgataatgtcaccggccctnaggggtacctgaccgattcnctggctccaagtctggccacctcacgccctcccgtggccatcagtcgggctccagtctgaggatgaggtctgattatcacttggtcgactactccgtgggacttagaccagcccgtagtaagttggggtttaggggttcgggttccgggggaccgggggggtaacccaacgggtccgtacgggtacccggttaccgtaacggtaccgacggtaccccgaagggtccccgg

SEQ ID NO: 189600 - DNA, 575 bp, Homo sapiens
  misc_feature: GYAE6OF02HU235.40.53.E09.1.454.CMB.1.raw
  modified_base (412)..(412): a, c, t, g, unknown or other
  misc_feature (412)..(412): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactagtaaactggtaccagcagctccaggaaccgcccccaaactcctcatctatgataatgtcaccggcctacgacggggtacctgaccgattctctcggctcaagtctggcacctcacgcctcccgtggccactcagtcgggcctccgtagtcnggacggatcggaggtctagtattatctacgttgtgcctacgtccgtagggactacgacgagccgtagtaacgttgggttggggtcggttccgggggaccgggggaaccgaacggtcgtcggtacccggttaccgtaaacggtccgaacggcccgaaggtcccg

SEQ ID NO: 189601 - DNA, 540 bp, Homo sapiens
  misc_feature: GYAE6OF02FLZHQ.40.53.E09.1.454.CMB.1.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcacccctcctcactcactgtgcagggtcctgggcccagtctgtgctgactcagccaccctcagcgtctcgggacccccggtnagagggtcaccatctcttgttctggaagcagatccaacatcggaagtaatactgtaaaactggtaccagcagctcccaggaaccggcccccaaactccncatctatgataatacgtcaccgccctacgaggggtacctcgacgtattctctggctccaagtcnggccacctcacgcctccnggccatcagtcgggctccgtagtcctgacggatggagctagattactcacgtgtgctactcgtggtatgacacgcgtagagtgggttggtggttcgggcggggacaaggtaccgtcggtaccgtcgtaacgtcgacgcccgaaggtcccg

SEQ ID NO: 189602 - DNA, 773 bp, Homo sapiens
  misc_feature: GYAE6OF02FUW2W.40.53.E09.1.454.CMB.1.raw
  modified_base (210)..(210): a, c, t, g, unknown or other
  misc_feature (210)..(210): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggacccccggtnaggacgggtccacctacttccttctttcgttcgtagggaacgcaagtactaccaaacgtacgtacggaaagttaaacttacttaacggtaaaccgtcggtaaccagaccacgtcccgtaccccgaacgggaaccccggtacccccaaaccgttccctactactctaactacggtaaacttaacgtaccgtacccgacccggtcccgttacgggacgggttacctacggtaaccgtacttccgtacgtacgtacctaccgtaagttccgacggtccctaccgtaccgaccgtccccttacccgtcggaccctaggtccgtacgggtcgggtaccctaccggtagttccgtaagggacggtacgttgggacgtcttaggtaacttacgtacgtacggtgtacgaccttacggttacgagggtatacggactcggtaccgtaggttacgggttggggttcggggtaccgggttacggggggaacccgggtaactccgggtaccggttacccgggtaccctttacgggtaaccggtaccggacccggtaccccggttaggtccccgg

SEQ ID NO: 189603 - DNA, 666 bp, Homo sapiens
  misc_feature: GYAE6OF02IFSIS.40.53.E09.1.454.CMB.1.raw
  modified_base (243)..(243): a, c, t, g, unknown or other
  misc_feature (243)..(243): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcacgccaccctcagccgtcgtcgggacccccggtcaggacgggtcaccattctcttgttctaggaancagactaccaacagtacggaagttaatactagtaaaccgtggtaccagcacgtacctcccgaagggaaccccggacccccaaacttccctcactcttaatagtataaacgtcgtaccgacccggtccctaccggtaacgggtaccgtacgacctacgttctccgtacgtcctacgtaacgtcgtacgccacctcaccgtccctccgtcgacctacgtcgacggtcggacctcgtagtaccgtaggacggtagtacgcggtacttacgtattactacgtccgttgacgtctacgtaccgtagaacggtctaagaccggttctacgggtagttcgggggttagggttcggggttaacgggggaccgggtacacggtccgtaacggtcccggttacgtaacgtcggaaccgccggtacgtccccgg

SEQ ID NO: 189604 - DNA, 763 bp, Homo sapiens
  misc_feature: GYAE6OF02IILBG.40.53.E09.1.454.CMB.1.raw
  modified_base (554)..(554): a, c, t, g, unknown or other
  misc_feature (554)..(554): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctcgggccagtctgtgctgtactcacgccaccctcacgtcgtcgtcgggaccccggtcagacgggtacaccatctcttcgtcgtggaacgcagactaccgaacacgtacggaaagtaactacgtagtaaacgtcggtaccaggtcacgcctaccgaacgggacccgaccccaaacctccgtacatctatacgtaataactacgtacccgaccgtacccgtacggtacggggtaaccttacggacccgttaattccgtcggttaccgccgttaacgtaaccggttcttcgggaccctaacccgtccgtacccggtccctttaccccgtcggtacccgtaacgttaaccggccgggttaacgggtcctttccggtaacgtttcggtaaacggcgggttaacncgggttacgtacgttaacgttaacgtttacctaccgtaacgtttggtaccgcttaaccgggtcgtagggtacctaccgggttacaacggtcggttaggttaacgtcggggttcggggtttaccggggtccgggggaaccgggtacgtaacggttaccgtaccgggtacccgttaacggtcgtaccggtaccgtcccgtaacgtccccgg

SEQ ID NO: 189605 - DNA, 827 bp, Homo sapiens
  misc_feature: GYAE6OF02GOY9E.40.53.E09.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctctcactcactgtgcagggtcctgggccctagtctgtgctgactcacgccacctcagcgtcgtcgggacccccgtnagacgggtcacctatcttcttgtctggacncagtactccaacagtacggaagtaactactagtaaacgtcgtaaccagtcgacgcctccgaacggaacccgaccccaaactcccgatactcgtactaggtaacttaaacgtcggtacccaccccgggtaccccgttacgggtaaccgggggttaccctaccgggaacccgtttacgtttaccgttccggtccgggtaacctttacccgaaacggttccggtacggtacccgtacccttaccgacccgtcccgttcccgtacgggaccctaacgtaccgtacggggttccgggtaccttcccggtaaggttcccggaagggtaacggacgtagggtacgtagttacgtttaacgttaacctccggttagttcggtccgttaaccggttcttacccggggttaggtaacgtttaaccgacggttaccgttacggtaacggttacgggttacggggggttttccggggttcggggggtaaccccggggggtaacggggtaccccaaagggggtttcccgtaacccgggttaacccggttaccgttaaaacggttccccggaaacccggggttaccgaccgggttacccccgg

SEQ ID NO: 189606 - DNA, 729 bp, Homo sapiens
  misc_feature: GYAE6OF02F3RV8.40.53.E09.1.454.CMB.1.raw
  modified_base (213)..(213): a, c, t, g, unknown or other
  misc_feature (213)..(213): n is a, c, g, or t
  modified_base (354)..(354): a, c, t, g, unknown or other
  misc_feature (354)..(354): n is a, c, g, or t
  modified_base (447)..(447): a, c, t, g, unknown or other
  misc_feature (447)..(447): n is a, c, g, or t
tcagtctagcgactcacgaccggtgctcgatttagagagagtgtgttgggtttggggagcttcagctgtgggtagagaagacaggactcaggacaatctccagcatggccagccttccctctcctcctcaccctcctcactcactgtgcagggtcctgggcccagtctgtgctgactcacgccaccctcgagcgtcgtcggggacccccggtnaggacgggtccaccattcttcgtttgttcgtagggaacgcagactaccaaacatacggaaataatacgtaagtaaacgtcggtaaccagacacgcctacccgaacgggaacccggacccccaaactcctactactacgtanagtaataactacgtcccgaacccggtccctacggtaaccggggttacctacggtaccgtattccgtcgtacggccctacgaagtcgtcgaccncctacaccgtccctccgtcgacctaagtcgtacgggtcggtccctaccgtaggttccgtaggaggtagtacgggacgtcttagttaaccttgtacctaggttcggtactactacggttccgggtaggtactacgaaccgtacggtcgtaagggttaggttcgggggtttacggggtcgggttaaccccgggggggtaacgggtaaccgtaccgggtacgttacccggggtacccgtttacggtaaaccgtcccggaaccggtaccccggacggttaccccgg

SEQ ID NO: 189607 - DNA, 731 bp, Homo sapiens
  misc_feature: GYAE6OF02HTMV9.40.53.E09.1.454.CMB.1.raw
  modified_base (207)..(207): a, c, t, g, unknown or other
  misc_feature (207)..(207): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctctcactcactgtgcagggtcctgggcccagtctgtgctgactcagccaccctcagcgtcgtcgggacccccgtnagacggtcaccatccttcttgttctggaagcacgatccaaactagtacggtaaagtaataacgtagtaaaacttcggtaaccagacagccttaccccgaaggaccccggacccccaaacgtccctactattacctaatacgtaattaaacgtaccgtccgaacccgggtcccttacgggtaacggggtaccctacggaacccgtacgttttaccgtccgtacgggtaccttaacccgtaacgggttccgtaccgggtaccctaaaccccgttctaacccggtccccccgttccccgtacgggtaccctaacgttccggtaacgggttccggggacccctttacggaacgtttccgtagggacggtagtccgggtaggtacctgttaaccgttcgtacgtacgttacgtcgtacgtacgtcggtagggacttacgacgtacgtacgtaggtagttcgggttggggtcggtccgggggacgggtacacggtccgtagtaccgtcgtaacgacgacgaccgagtccg

SEQ ID NO: 189608 - DNA, 781 bp, Homo sapiens
  misc_feature: GYAE6OF02GMD5A.40.53.E09.1.454.CMB.1.raw
  modified_base (211)..(211): a, c, t, g, unknown or other
  misc_feature (211)..(211): n is a, c, g, or t
tcagtctagcgactcacgaccggtgctcgatttagagagagtgtgttggggtttggggagcttcagctgtgggtagagaagacagggactcaggacaatctccagcatggccagcttccctctcctcctcaccctcctcactcactgtgcagggtcctggacccagtctgtgctgactcagccaccctcagcgtcgtcgggacccccggtnaggagggtcaccatctcttgtctggaagcagactccaacagtacggaagtaatactaggtaaaacctggtaaccagcacgtcctacccgaagggaacccggacccccaaactccctacacttccgtatacggtaattaacgtaccgtaccgaaccccggtccctacggaacgggggttacccctacggaacccgttagtttccgtaccgttcggacccttacccgaaaggtttcccgtgggacccctaacccgtccgaaccgtccccgttcccgtacggccctacgtccgtacgggtccgggtacccgttaccgtacggttcgtacggaacgggtacgtacgggtacggtacggttacgttacgttactaccgtaccgttcggtccgtacctacggttccggtacgggtactacggtaccgacggtaccgtaggttaacgggtttgggggttacgggtttacgggggttcccgggggtaccggggggtaaccggtacgggttaccggttaccggtaaccccgggttaccgttaaccggtaccggtaccggtacccggaccggttccccgg

SEQ ID NO: 189609 - DNA, 957 bp, Homo sapiens
  misc_feature: GYAE6OF02IB36C.40.53.E09.1.454.CMB.1.raw
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctcgggcccagtctgtgctgactcacgcccaccctcacgtcgtccgtccggggaccccccggtgaggacgggtaccaacctatccttcttcgttactagggaaacgtcagactacccgaaacacgtacgggtaaaagttaacttaacgttaaggtaaaaccgttcggtaacccaaggaacccgaacggtccccgttaaccccggaaacggggaaaccccggtaacccccccctaaaaaccgttcccctaaccgtaacttacctaagttaccgtaaaagtttaaacgttaaccggtaccccgtaaccccgggtaccccccgttaaccggggtaaccggggggttaaccccttacggggtaaaccccgttacgtttttacccgttaccgggttccgggtaccctttaaacccgtaaccgggtttacccggttccggggtaacccctttaaccccgttacccgggtaaccccgtttccccccgggttaaccccccggtttcggaaccccgttaacggttcccggtaaccggggtttccgggtacccgtaccgtttaaccggggtcgtaaccggggtagggtaacgtacggggtaacggttaccgttaaggttaacctttaaccgtcgtacggtttcgtaaccgggtacctacggttaccggtagggtaacgttaccggtacgtacggtaccgttaaggtacgggtttcgggtttacgggggttcgggtaacccgggggacggggtaccacgggttaccgtccggtaccgtaccgtacggtacccgacgtacccggtacggtccccg

SEQ ID NO: 189610 - DNA, 685 bp, Homo sapiens
  misc_feature: GYAE6OF02FO423.40.53.E09.1.454.CMB.1.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (542)..(542): a, c, t, g, unknown or other
  misc_feature (542)..(542): n is a, c, g, or t
tcagtctagcgactcacgaccggtgctcgatttagagagagtgtgttggggtttggggagcttcagctgtgggtagagaagacaggactcagggacaatctccagcatggccagcttccctctcctcctcaccctcctcactcactgtgcagggtcctgggcccagtctgtgctgactcacgcccaccctcagcgtcgtcgggacccccggtnaggacgggtccaccatcttcttgttctaggaancagactaccaacagtacggaaagtaatacgtacgttaaacgtcggaacagcgacgtcctacccgaacggaacccggaccccaaactcctacactctaagtacgtaataatacgtccaccccggtcctaccggacgggttacctcgaaccgtattctcgtcgtacctacaacgttacgtcgacctacctacgaccgttccctcccgtacggcctaacgtcgtacggtacgggtccttaccgacggttcgacgggtaggtacgtggacggtctagttacttactacgtacttcgtacnccgtacgtcggtaggtcgttacgaacacgtactaggtaaggttcgggttacggggttcgggttccggggggacgggtaaccggtacggtccgtaacggtaccgtaccggttaacgtaccggtaaccgcccggtaacggtcccg

SEQ ID NO: 189611 - DNA, 835 bp, Homo sapiens
  misc_feature: GYAE6OF02GD9QR.40.53.E09.1.454.CMB.1.raw
  modified_base (555)..(555): a, c, t, g, unknown or other
  misc_feature (555)..(555): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcgagggtcctcgggcccagtctgtgctgactcacgcccaccctcgacgtccgtcggtccgggacccccggtgacggacgggtccacctacttccttcgtttcggttcgtaggaacgacagtaactaccaaacgtacgtaacggtaaagtaactacgtaacgtaaacgtcggtaaccgagcacgtcctacccgaacgggaacccgacccctaaactcctactactctaagtgtaataacgtacgtaccgaccggtccgtacggtacgggttacctacgtaaccgtacttccgtcgtcgccttaccgtacggttccgtcggacctacccgtcgtaccgtcccgttcccgtcggacctaacgtcggtacgggttccggtaccctaccgttacggtcgtacgggtaacggtntaccggggtaaacggttccttaagggttaacgtttacccgtaaccggtttaagggttcggttaacccggtacctttaacgggtttccgggtaacgggtataaccggtcccgtaaacggtccggtttaagggtaccggggttttgggggtttaaccgggggttcgggggtaaccccgggggggtaaaccgggtacctaaccgggtacccggttaaccgggtaacccggttaacggtaacgggttacccggaacccgggtaccccggagggtttaccccccg

SEQ ID NO: 189612 - DNA, 735 bp, Homo sapiens
  misc_feature: GYAE6OF02J14AD.40.53.E09.1.454.CMB.1.raw
  modified_base (155)..(155): a, c, t, g, unknown or other
  misc_feature (155)..(155): n is a, c, g, or t
  modified_base (321)..(321): a, c, t, g, unknown or other
  misc_feature (321)..(321): n is a, c, g, or t
  modified_base (441)..(441): a, c, t, g, unknown or other
  misc_feature (441)..(441): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcaggtccnggcccagtctgtgctgactcacgcccaccctcacgccgtcgtccgggaccccccggtcgacggtacgggtccaccactcgttctttacgttccgtaggaagccaggactaccaaacgtagtaccggaaagttaatacgttaacggtaaactacggtaaccagaccnggtaccctacccggaacggaaccccggacccccaaaccgtcctaccattactacgtataacttaagtaccgtaccacccggccctacggtacgggtaaccctacggacccgttattcccncgttcgacctaacgtacgtttcgacggtccctaccctacgaccgtcccgtcccgttacggaccctacgtaaccgtcgggttccgggtacccttacccgtagttccgttaacggtaccggtagtcgacggtaccgtgttagttaacctctaccggtattcgactagttccgagggtactaccggatcggaccgttaggtaggtttcggtagggtttcgggaccggggtaccgggtaaccgaggttaccggtccgtaccggttacctacggtaccgtaccggaccgtacggtcccg

SEQ ID NO: 189613 - DNA, 764 bp, Homo sapiens
  misc_feature: GYAE6OF02FRYHX.40.53.E09.1.454.CMB.1.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (416)..(416): a, c, t, g, unknown or other
  misc_feature (416)..(416): n is a, c, g, or t
tcagtctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcgagcccacctcagcgtcctcggggaccccccggtnaggtagggtccaccatcttctttgtctgggaancagactaccaacagtcggtaaagtaatacgttagtaaaaccgtcggtaaccaggacagtcctaccccgaagggaaccccggacccccctaaaaccgtccctacacgttacctaatacggtaattaaactacggtacccgaaccccggtcccctaggaacggggttaacccncggtaaccgttattccgtcgtcgggtcctacccgtaacggttccgtaggtaaccctaccctccgaccgttcccccgtcccgtggtaccctagtaccgtggtccgggccttaccgagttaccgtagggtacggtacgtaggtaggtccgttagtacttacgtcgtacgttgtacgactacgtccgtgggtaatacgaacggtacgtcgtaacggtaagggtttggggtacgggttcggggttccgggggtaaccggggggtacccgtacgggttaacccggttacgggtacccgtttaccggttaaaccgggtcccgtacccgggtacccggtaacggttacccccggg

SEQ ID NO: 189614 - DNA, 482 bp, Homo sapiens
  misc_feature: GYAE6OF01BKZQ2.30.76.G10.1.454.CMB.1.raw
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (464)..(464): a, c, t, g, unknown or other
  misc_feature (464)..(464): n is a, c, g, or t
  modified_base (472)..(482): a, c, t, g, unknown or other
  misc_feature (472)..(482): n is a, c, g, or t
tcagcacgctacgtcacgaccggtgctcgatttagtcactcatacagggtgctgctgaggctgtaggtgctgtccttgctgtcctgctctgtgacactctcctgggagtcaccatcacttgccgggctagtcaggacatccgaaatgagttgagctggtatcagcagaaaccaggtaaacgcccctaactcctgatttacgctgcgtctgctttacaaagtggagtcccatcaaggttcagcggcagtggatctggcacagatttcgctctcaccatcagcagcctgcagcctgaagtattttgctaacttattactgttctaacaagattaaccacttaccctgggaccgtttcgaccgaaagggaccaagggtgaaatcaaacgaactgngctgcacatcngtcttcatccttcccgctatctagaacgtagcgtgcctgacgcgggactggcaaggccganagtacggnnnnnnnnnnn

SEQ ID NO: 189615 - DNA, 784 bp, Homo sapiens
  misc_feature: GYAE6OF01AOJBM.30.76.G10.1.454.CMB.1.raw
  modified_base (762)..(762): a, c, t, g, unknown or other
  misc_feature (762)..(762): n is a, c, g, or t
  modified_base (769)..(769): a, c, t, g, unknown or other
  misc_feature (769)..(769): n is a, c, g, or t
  modified_base (776)..(777): a, c, t, g, unknown or other
  misc_feature (776)..(777): n is a, c, g, or t
  modified_base (779)..(779): a, c, t, g, unknown or other
  misc_feature (779)..(779): n is a, c, g, or t
  modified_base (781)..(781): a, c, t, g, unknown or other
  misc_feature (781)..(781): n is a, c, g, or t
  modified_base (783)..(783): a, c, t, g, unknown or other
  misc_feature (783)..(783): n is a, c, g, or t
tcagcacgctacgtcacgaccggtgctcgatttagtcactcatacaggggtgctgctgaggctgtaggtgctgtccttgctgtcctgctctgtgacactcgtcctgggatcacctagtctacgttcgccgggcttaggtcaggactataccgtaaagtggagttgagtcgtggtatcgagacaacgtaaaccgtaaggtaaaccgtccccgttaaaccgtccgttagtacgttttaccgcgttcggcgtttacgtacgttaaccgtttaaacgaaaggttcgggaccgtacccctagttaccggtaaacggggtttaccaacggggaccgggtaccgtaaaggttccgggttaacgtacccggttagggaaccttaaccgtaagttaacgtttccgtaccttcctaaccgtacctacgttaccgacgtaccggaaccgttccggacggaaccggtacgtacccggttaggtttaaacggttagttttaccggaactttaaacttttacgttacgtacggtaaccttaagtaaacttacgttaactaccgttacgtcgggacctacggtaacggaacggtaacgtaaagggacgtaaacgtacgtaaacgtaacgtggtcgtacgtacgaaccgtactaacgtacgttacgttactttactacccgttaccgttaccccgtatacgtacgtacggtaactacggtacggtcgtacgtacggacggtacgggccgtacggacgtacggtaccgaggtaactagngagcganagagcanngngngng

SEQ ID NO: 189616 - DNA, 562 bp, Homo sapiens
  misc_feature: GYAE6OF01CEYP4.30.76.G10.1.454.CMB.1.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (336)..(336): a, c, t, g, unknown or other
  misc_feature (336)..(336): n is a, c, g, or t
  modified_base (487)..(487): a, c, t, g, unknown or other
  misc_feature (487)..(487): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
  modified_base (561)..(562): a, c, t, g, unknown or other
  misc_feature (561)..(562): n is a, c, g, or t
tcagcacgctacgtcacgaccggtgctcgatttagtcactcatacagggtgctgctgaggctgtaggtgctgtccttgctgtcctgctctgtgacactctcctggggatccaccatcacttggccgggctagtcaggacataccgaaatggagttcgagctggtatcagacaagaaaccaggtaaaccgccccctaactctagtattacgctgcgtctagtacttaacgaaggtggactccatcgaaggtcagcgnagtgatcgtagcanagtattcgctctcacatacagcacgctgcagcctagtaagtatttagactaattactgtatacaanagtacttaacgtaccgttaccgaggtaccgtacggaaccgaaggaacgaaaggtaacgtaactaacgaacgtaacgtggtacgacgtactacgtaactatacgttacttcttacaccgttcctaccgctaacttacgaacgtaacgtacgnggtacgtgtacgacgggtcggtacgagggtaaccgaacggactaccgtaaggcgangtancganagnananngnn

SEQ ID NO: 189617 - DNA, 460 bp, Homo sapiens
  misc_feature: GYAE6OF02HVE0O.30.76.G10.1.454.CMB.1.raw
  modified_base (435)..(435): a, c, t, g, unknown or other
  misc_feature (435)..(435): n is a, c, g, or t
  modified_base (451)..(460): a, c, t, g, unknown or other
  misc_feature (451)..(460): n is a, c, g, or t
tcagcacgctacgtcacgaccggtgctcgatttagtcactcatacagggtgctgctgaggctgtaggtgctgtccttgctgtcctgctctgtgacactctcctgggagtcaccatcacttgccgggctagtcaggacatccgaaatgagttgagctggtatcagcagaaaccaggtaaagcccctaacctcctgatttacgctgcgtctgctttacaaagtggatcccatcaaggttcagcggcagtggatctggcacagatttcgctctcaccatcagcagcctgcagcctgaagattttgcaacttattactgtctacaagattacacttacctgggacgttcggccaagggaccaaggtggaaatcaaacgaactgtgctgcacatctgtcttcatcttcccgctatctgaacgtagcgtgctgagcgggcnggcaaggcgcagtagnnnnnnnnnn

SEQ ID NO: 189618 - DNA, 476 bp, Homo sapiens
  misc_feature: GYAE6OF02HKOJK.30.76.G10.1.454.CMB.1.raw
  modified_base (466)..(476): a, c, t, g, unknown or other
  misc_feature (466)..(476): n is a, c, g, or t
tcagcacgctacgtcacgaccggtgctcgatttagtcactcatacagggtgctgctgaggctgtaggtgctgtccttgctgtcctgctctgtgacactctcctgggagtcaccatcacttgccgggctagtcaggacatccgaaatgagttgagctggtatcagcagaaaccaggtaaagcccctaacctcctgatttacgctgcgtctgctttacaaagtggagtcccatcaaggttcagcggcagtggatctggcacagatttcgctctcaccatcagcagcctgcagcctgaagattttgactaacttattactgtctacaagtattacacttaccgtggacgttcggaccaagggaccaagggtggaaatacgaaacgaactgtggctagcacctatctgtcttcattccttcccgcctatctagaaccgtagcgtgctgagcggctggcaggcgacagtgnnnnnnnnnnn

SEQ ID NO: 189619 - DNA, 476 bp, Homo sapiens
  misc_feature: GYAE6OF02G6OJ1.30.76.G10.1.454.CMB.1.raw
  modified_base (297)..(297): a, c, t, g, unknown or other
  misc_feature (297)..(297): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (464)..(476): a, c, t, g, unknown or other
  misc_feature (464)..(476): n is a, c, g, or t
tcagcacgctacgtcacgaccggtgctcgatttagtcactcatacagggtgctgctgaggctgtaggtgctgtccttgctgtcctgctctgtgacactctcctgggagtcaccatcacttgccgggctagtcaggacatccgaaatgagttgagctggtatcagcagaaaccaggtaaagcccctaactcctgatttacgctgcgtctgctttacaaagtggatcccatcaaggttcagcggcagtggatctggcacagatttcgctctcaccatcagcagcctgcagcctgaagtnttttgctaacttattactgtcctaacaagtacttacaacttacccgtgggtaccgttcggaccaagggaccaagggtagaaatacgaaacgactgtagctgcacatctntcttcatcctcccnctatctgaacgtgcgtgctgacgcgggctggacaggcacagtgnnnnnnnnnnnnn

SEQ ID NO: 189620 - DNA, 794 bp, Homo sapiens
  misc_feature: GYAE6OF02GFOCM.30.76.G10.1.454.CMB.1.raw
  modified_base (729)..(729): a, c, t, g, unknown or other
  misc_feature (729)..(729): n is a, c, g, or t
  modified_base (782)..(782): a, c, t, g, unknown or other
  misc_feature (782)..(782): n is a, c, g, or t
  modified_base (787)..(787): a, c, t, g, unknown or other
  misc_feature (787)..(787): n is a, c, g, or t
  modified_base (789)..(793): a, c, t, g, unknown or other
  misc_feature (789)..(793): n is a, c, g, or t
tcagcacgctacgtcacgaccggtgctcgatttagtcactcatacagggtgctgctgaggctgtaggtgctgtccttgctgtcctgctctgtgacactctcctggggatcaccatcacttgccgggctagtcaggacatccgaaatgagttgagctggtatcagacaagaaaaccgaggtaaaccgccccctaacctcctagtattttaccgctcggtccgttacttcgttaccttttaaacgaaaagggttcggaccgtacccctaattacgtaaacgggtttcgacggccggagtaggtaggtactcggtcggactacgaggttactttccgtccttcctaccgtaaccacttacggacgccacggtcccttacggcacggtaccgtacggtaaagtttccgttttacgaacctttaaaactttttacgttaccgttaaggttacctaaacgtaaaagttacctttaaacccgtaaccccgtttacccggttcgggggttaacccggtttaaccgggaaacccggaaacgggggtaacccgtaaaaggggtttaaccggtaaaacgttaaccggaaaaaccggtaaccgttaggggttcggttaccgtaccggtaacctaacccttactttccggttacgtttaccttaccttaccgtttccccgttacccctaccgtacgtttaccgtaacgggtaacggttacgtccggtacgtcggtaacgggngtaaccgggtcgacggtaccgggacggtcgaacgtacgtaggacgtcgtgacngaganannnnnc

SEQ ID NO: 189621 - DNA, 642 bp, Homo sapiens
  misc_feature: GYAE6OF02F1MJ6.30.76.G10.1.454.CMB.1.raw
  modified_base (260)..(260): a, c, t, g, unknown or other
  misc_feature (260)..(260): n is a, c, g, or t
  modified_base (632)..(633): a, c, t, g, unknown or other
  misc_feature (632)..(633): n is a, c, g, or t
  modified_base (635)..(635): a, c, t, g, unknown or other
  misc_feature (635)..(635): n is a, c, g, or t
  modified_base (637)..(642): a, c, t, g, unknown or other
  misc_feature (637)..(642): n is a, c, g, or t
tcagcacgctacgtcacgaccggtgctcgatttagtcactcatacagggtgctgctgaggctgtaggtgctgtccttgctgtcctgctctgtgacactctcctgggatcaccatcacttgccgggctagtcaggacatccgaaatgagttgagctggtatcagcaagaaaccaggtaaacgcccctaactcctgatttacgctgcgtctgtctttaacaagtggactcccatcgaaggtcagcggcagtgatcgtggcanagtattcgctctcaccatacagcacgcctgcacgtcctagaagttattttgacttaaactttattaccgtgttactaacaacgttaactttaacctaacccgtttacccggtaggggtaccgtttacccgggaccgaaaacggggacccgtaaagggtaacggtaaaactaacgaaaaccgtaacgtcggtacgggtctacggaccctaaccgtactttccgttccgttaccgttactacccgtttcccttaccccgtacgtacttaaccgttacggtaaaccggttacggtccggttacgtcggtacgggtacgggtccggggtaccggtcgggtaaccggaacgggtccgaacgtaacgtggacagtcgnncncnnnnnn

SEQ ID NO: 189622 - DNA, 220 bp, Homo sapiens
  misc_feature: GYAE6OF01DMXEB.45.65.F10.1.454.CMB.1.raw
  modified_base (211)..(220): a, c, t, g, unknown or other
  misc_feature (211)..(220): n is a, c, g, or t
tcagacgcgatcgacacgaccggtgctcgatttagctacgctctaagggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnnnnnnnnn

SEQ ID NO: 189623 - DNA, 212 bp, Homo sapiens
  misc_feature: GYAE6OF01BHBZV.45.65.F10.1.454.CMB.1.raw
  modified_base (210)..(212): a, c, t, g, unknown or other
  misc_feature (210)..(212): n is a, c, g, or t
tcagacgcgatcgacacgaccggtgctcgatttagctacgctctaagggggaagaggaagactgacggtcctcccaggagttcaggtgctgggcaccttgggcacggggaggtgtgtcacaagatttgggctctgggcacagcggccctgggctgcctggtcaaggctacttcctcgatcgcgtctgagcgggctggcaaggcgcatagnnn

SEQ ID NO: 189624 - DNA, 228 bp, Homo sapiens
  misc_feature: GYAE6OF01EFYFI.45.65.F10.1.454.CMB.1.raw
  modified_base (213)..(228): a, c, t, g, unknown or other
  misc_feature (213)..(228): n is a, c, g, or t
tcagacgcgatcgacacgaccggtgctcgatttagctacgctctaaggggggaagaggaagactggacggtcctcccaggagttcaggtgctgggcaccttgggcacggggaggtgtgtcacaagatttgggctctgggcacagcggccctgggctgcctggtcaaggtactacttcctcgatcgcgtctgagcggctggcaaggcacatagnnnnnnnnnnnnnnnn

SEQ ID NO: 189625 - DNA, 276 bp, Homo sapiens
  misc_feature: GYAE6OF02F09LK.45.65.F10.1.454.CMB.1.raw
  modified_base (244)..(246): a, c, t, g, unknown or other
  misc_feature (244)..(246): n is a, c, g, or t
  modified_base (248)..(249): a, c, t, g, unknown or other
  misc_feature (248)..(249): n is a, c, g, or t
  modified_base (251)..(260): a, c, t, g, unknown or other
  misc_feature (251)..(260): n is a, c, g, or t
  modified_base (262)..(276): a, c, t, g, unknown or other
  misc_feature (262)..(276): n is a, c, g, or t
tcagacgcgatcgacacgaccggtgctcgatttagctacgctctaaggggggaagaggaagactgacggtcctcccaggagttcaggtgctgggcaccttgggcacggcgggaggtgtgtcacaagatttgggctctgggcaccgtgggcatgggggagtgtgtcacaaggatttgggccctgggctgcctggtcaaggcttacttcctcgatcgcgtctgagcgggctggccaggcgcatagnnncnncnnnnnnnnnnannnnnnnnnnnnnnn

SEQ ID NO: 189626 - DNA, 516 bp, Homo sapiens
  misc_feature: GYAE6OF01E1I4J.35.36.D03.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcagaacctggtcaggctcccaggctcctcatctatggtncatcccaccaggccactggtactcccagcccaggttcagtggcaggtgggtctgggacagagttcactctcaccatcagcagcctgcagtctgatgtattttgctagttttattactgtcagtctattatgaattaacgtcggtcccttcggtggtaccgttcggaccgtaaggggaccaagggtcgggaacgtccgaaacgg

SEQ ID NO: 189627 - DNA, 500 bp, Homo sapiens
  misc_feature: GYAE6OF01DAU6C.35.36.D03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (439)..(439): a, c, t, g, unknown or other
  misc_feature (439)..(439): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccaggggganagagcccaccctntcctgcagggccagtcagactattagtaccaacttagcctggtatcagcagaacctggtcaggctccaggctcctcatctatggtgcatccaccagggccactggtactcccagccaggttcagtggcagtgggtctgggacagagttcactctcaccatcagcagcctgcagtctgattgattttgctagtttatactgtcagctattangtataacgtggtcctcggtggaccgttcggacctaagggaccaaggtcgaagtccgaaacg

SEQ ID NO: 189628 - DNA, 608 bp, Homo sapiens
  misc_feature: GYAE6OF01EHNSZ.35.36.D03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgacgaaccactggagaaacngtgatgacgcagtctccagccatcctgtctgtgtctccgagggganagacgcccaccctctcctgcgagggccagtcagactattacgtaccaacttagccttggtatcagcaagaaacctggtcaggctcccgaggcctcctcattctatggtgcactccaccgaggccacgtcggtactcccgagcccgtaggttccagggttcgggacgtacgggttcggggtaccgtggggaaccgtacggtacgtttcgaaccttcgtaccaaccctagtcgaacgcaacgcccgtagccaggttctgattcgtaattttcgacttagttttacttacgttgtactagtctattatagtaacttaacggtcgtcccgttcggtcggggtacgttccgggaaccgtaacgggtacgtaagggtcggtaaacgtaccgtaaaccgg

SEQ ID NO: 189629 - DNA, 518 bp, Homo sapiens
  misc_feature: GYAE6OF01AGHX9.35.36.D03.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagagcccaccctctcctgcagggccagtcagactattacgtaccaacttagcctggtatcagcagaacctggtcaggctccaggcctctcatctatggtncatcccacgaggccacgtgtactcccagccaggttcaggtgctaggtcgggtctgggacagagttcactctcaccatcagcagcctgcagtctgatgtatttgactagtttatatgtactagtctattatagtatacgtcggtccttcggtcgtaccgtacggaccgtaacgggtacgaagggtcggtaacgtaccgtaacgg

SEQ ID NO: 189630 - DNA, 583 bp, Homo sapiens
  misc_feature: GYAE6OF01DMFA9.35.36.D03.1.454.CMB.1.raw
  modified_base (171)..(171): a, c, t, g, unknown or other
  misc_feature (171)..(171): n is a, c, g, or t
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
tcagtacagatcgtcacgaccggtgctcgatttagctgcgtcacgatctctcttggggcagagtctctggggaggaactgctcagttaggacccagacggaaccatggaagccccagcgcagcttctcttcctcctggctactctggctccgaggaaccactggagaaacngtgatgacgcagtctccagccatcctgtctgtcgtctccgagggganagacgcccaccctctcctgcgagggccaggtcagacctattacgtaccaacttagcctggtancagcagaacctggtcaggcctccaggcctcctnactctatggtncactccacgacggccacgtggtactcccagccaggttcaggtcggactaggttcgggtcgtagggacgtacggtacgttaccgtacgtctacacctactcgacgtcgtacgtccgtacgacgtacgtctgtattgtatttcgtacgttagtttacttacgttacgtactagtactaaacgtataatcgtacgtccggtacctacggtacgtacgtccgttacgtttccggaccgtacgggtaaccaggtcgtaacggg

SEQ ID NO: 189631 - DNA, 568 bp, Homo sapiens
  misc_feature: GYAE6OF01DS02M.35.36.D03.1.454.CMB.1.raw
  modified_base (308)..(308): a, c, t, g, unknown or other
  misc_feature (308)..(308): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcaaggaaagttggccaggctcccaggctcctnattcgtttggtgtcgtccacgttaggggcccgtctgggtcgtcccgagttccaggtttcaggtggcaggttggcttcgtgggacagagttcactctcaccatcacgcacgcctgcagtctagaagtattttgacttagtttattactgttacagtacctaaattaataaagttagtacgttcgggtacccttccggtacggtttacgtaccgttacggttttcgggacccggtacggggaaccctaaggtcgtaacgggg

SEQ ID NO: 189632 - DNA, 500 bp, Homo sapiens
  misc_feature: GYAE6OF01B7GSE.35.36.D03.1.454.CMB.1.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (494)..(494): a, c, t, g, unknown or other
  misc_feature (494)..(494): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccaggggganagagccacctntcctgcagggccagtcagactattagtaccaacttagcctggtatcagcagaaacctggtcaggctcccaggctcctcatctatggtncatccacaggccactggtancccagccaggttcagtgcagtggtctgggacagtatttcactctcacttactcagcagtctgaccaaccgtgaagatgttgactaacgttactactgttacaacagtacttacgacggtcccattcactttcgcctcgggaccacacgtacgaatccagngaactg

SEQ ID NO: 189633 - DNA, 653 bp, Homo sapiens
  misc_feature: GYAE6OF01AVGS1.35.36.D03.1.454.CMB.1.raw
  modified_base (215)..(215): a, c, t, g, unknown or other
  misc_feature (215)..(215): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagacgcccaccctctcctgcagggccagtcagagtgttagcagctaacttagcctaggtaccagcaaggaaagttggccaggcctccgaggtcctcctcattcgtttggtcgtcgtccacgtacggggcccgtcgtggtcgtccccgagttccgagggtttccaagggttcggaccgtaggtcggtccttcgggtacggggtacgtaggtacgtttccgaccgttccgtaccaacctatccgacgccgtaacgtcccgtcgtaccgtacgttcgtaagtaacgttacgttttcgtacgtttagttttacgttacgtcgttactaacgtactaaattaagtaaacgtacgtaccgtacggtcccgttaccggtaggtttcgtaccgttacggttttacgggacccggtaacggggaaccgtacggtcgtagggtaaacg

SEQ ID NO: 189634 - DNA, 510 bp, Homo sapiens
  misc_feature: GYAE6OF01BZTOW.35.36.D03.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcagaacctggtcaggctcccaggctcctcatctatggtncatcccaccagggccactggtactcccagccaggttcagtggcaggtgggtctgggacagagttcactctcaccatcagcagcctgcagtctgaagtattttgcttgtttattactgtcagctagttattatgccgttcggccgttactaccgttttcgggaccgtaggggacccgtaacgtggagatcgagtaacg

SEQ ID NO: 189635 - DNA, 610 bp, Homo sapiens
  misc_feature: GYAE6OF01BBHWN.35.36.D03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgagggganagacgcccaccctctcctgcagggccagtcagagtgttagcagctaacttagcctggtaccagcagaagttggccaggctccaggctcctnattctttggtcgtcgtccacgtacgggccgtcgttggtcgtcccagtcgtaggttcaggtggctaggtcggccttcgtaggggactaggtacgtttcacgtcctaccaaccctataccgagccaggtcccgttgcctaaggttcctagtaacttcgtaccttttaggaccctaaaccttatttaccgtacgaaccctaactaacttaccacgtacctaaccgttttacttttccgttacgttttaccgggacgggtaacgggacccgtaagggtcggaactagttaccgaaggtaacgtaacgg

SEQ ID NO: 189636 - DNA, 549 bp, Homo sapiens
  misc_feature: GYAE6OF01D0G1K.35.36.D03.1.454.CMB.1.raw
  modified_base (169)..(169): a, c, t, g, unknown or other
  misc_feature (169)..(169): n is a, c, g, or t
  modified_base (216)..(216): a, c, t, g, unknown or other
  misc_feature (216)..(216): n is a, c, g, or t
  modified_base (318)..(318): a, c, t, g, unknown or other
  misc_feature (318)..(318): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagagcccaccctctcctgcagggccagtcagactattagtaccaacttagcctggtatcagcagaacctggtcaggcctccgaggcctcctcatctatggtncatcccacgacggccacgtggtactcccagtccgtaggttccaggtcggcgtagggtcgggtacgtagggacgtaggtacgttccactctaccacctatcgacgcacgtccgtgcgtagtcgtgtattgtattttgacgttagtttacttacttgtactagtctattatagtatacgtcgtcgtcggtggtacgtcggaccgtaacggacgaaggtacggacgtcgtaacg

SEQ ID NO: 189637 - DNA, 709 bp, Homo sapiens
  misc_feature: GYAE6OF01C60X8.35.36.D03.1.454.CMB.1.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
  modified_base (332)..(332): a, c, t, g, unknown or other
  misc_feature (332)..(332): n is a, c, g, or t
tcagtacagatcgtcacgaccggtgctcgatttagctgcgtcacgatctctcttggggcagagctcgtggggaggaactgctcagttaggacccagacggaaccatggaagccccagcgcagcttctcttcctcctgctactctggctccgaggaaccactggagaaacngtgatgacgcagtctccagccatcctgtctgtcgtctcgagggganagacgcccacctctccgtgcgacgggccagtcagactatacgtaccaagttacgcctgtatcagcaagaaacctggtcacggcctacccgagtcctcctactacgtctagtggtcnctactccaccgaggaccctagtcggtaacctcccgaacggccgtaaggtttccgaggttcgggaccgtaggttcggggttcgtacggggaacctaggtaaccgtttccgacttacctacccgtaacctagtcccgtaaggaccctaacggtccccgtaggacccgttaaggtttaccctaagggtaaacgtaacttttaacggtcgtaacccgttttaaggttttaaccctacggttaacccgttagttacccgtaacgggttaactttaacggtttaaacgtaccggttcccggtaccgggtaccccgttccgtccgttaccgttcgggtttacccgggacgggtaacggtaacggtacgggtaggaagtaaaccg

SEQ ID NO: 189638 - DNA, 589 bp, Homo sapiens
  misc_feature: GYAE6OF01BJABU.35.36.D03.1.454.CMB.1.raw
  modified_base (166)..(166): a, c, t, g, unknown or other
  misc_feature (166)..(166): n is a, c, g, or t
  modified_base (305)..(305): a, c, t, g, unknown or other
  misc_feature (305)..(305): n is a, c, g, or t
tcagtacagatcgtcacgaccggtgctcgatttagctgcgtcacgatcgtctcttggggcagagcctctggggaggaactgctcagttaggacccagacggaaccatggaagccccagcgcagcttctcttcctcctgctactctggctcgagaccatggagaacngtgatgacgcagtctccagccatcctgtctgtgtctccagggggagagagccaccctctcctgcagggccagtcagactattagaccaacttagcctgtactcagcagaaacctggtaccaggctcccaggcctccgtnatctatggtagcatccgaccgagggccacgtggtactcccgagccaggttcaggtcggctaggtgggtctgggtacagtacggttcacgttcgtaccaccgtatccacgtccaacggccccgttagaccgtacgtctagtaacgttcggttattttcgactagttttattaacttgtctagactattagtagtaagttaacgtgggtacccttaccgggtggtaaccgtttccgggaccgtaaacggggtaccgaaagggttcgggaaacggtccgtaaaacgg

SEQ ID NO: 189639 - DNA, 535 bp, Homo sapiens
  misc_feature: GYAE6OF01CJ88M.35.36.D03.1.454.CMB.1.raw
  modified_base (169)..(169): a, c, t, g, unknown or other
  misc_feature (169)..(169): n is a, c, g, or t
  modified_base (213)..(213): a, c, t, g, unknown or other
  misc_feature (213)..(213): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctcagccatcctgtctgtgtctccagggganagagccaccctctcctgcagggccagtcagactattagaccaattgcctggtatcagcagaacctggtcaggctccgaggctcctnatctatggtncatcccacaggccacgtggtactcccagccaggttcaggtgcagtgggtctgggacagtagttcactctcaccatcagcagtcctgcagtctgattgtattttgctagtttattacgttgtcagtctaattatagtacttaacgtcggtaccttaccggtggtaccggtttcggacccggtaaacgggtacccgaagggtacgggtaacgttacccggtaaaacgg

SEQ ID NO: 189640 - DNA, 543 bp, Homo sapiens
  misc_feature: GYAE6OF01EUI1E.35.36.D03.1.454.CMB.1.raw
  modified_base (318)..(318): a, c, t, g, unknown or other
  misc_feature (318)..(318): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggagagacgcccaccctctcctgcagggccagtcagactattagaccaacttagcctggtatcagcaagaaacctggtcaggctcccgagctcctcatctatggtcncactccaccaggccactggtatcccgagccaggttcaggtggcaggtcgggtctagggactagtacgttcacgtctacaccatcagcacgcctgctagtctagattcgtattttcgacttagtttacttacgttgtcagtctattagtcgtaattacgtcggtccttcggtggtaccgttcggaccgtaaggggacctaagggtcgggtaaacgtcgtaaaccgg

SEQ ID NO: 189641 - DNA, 561 bp, Homo sapiens
  misc_feature: GYAE6OF01DUT9B.35.36.D03.1.454.CMB.1.raw
  modified_base (288)..(288): a, c, t, g, unknown or other
  misc_feature (288)..(288): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcttgggttttccttgttgtcttttttagaaggtgtccagtgtgaggtgcagcgtgggtggagtcgtgggggagcctggtcaagcctggagacgtccctgacgactctcctgtgtagcctctggattcaccttcaatntgtatagcatcgacctgggtcccgccaggcctccgtggggaacgggctgggagtgggtctcatctagttggaagttgtgtttgtttaanactattatttagngggagacggtcggggtgggggcctattccactntctcagagacaacgaccaagacgctagtatttcngaacaagtanaacacgctgcgagacgaggacacggcttagtagttattactggtcgacgagaggtaggacgggcgtacgggttcccggttcccccgggtttagg

SEQ ID NO: 189642 - DNA, 570 bp, Homo sapiens
  misc_feature: GYAE6OF01C56YN.35.36.D03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (391)..(391): a, c, t, g, unknown or other
  misc_feature (391)..(391): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgagggganagacgcccaccctctcctgcagggccaggtcagtactattacgtaccaacttagcctggtactcaagcagaaacctgggtcaggcctccgagcctcctnatctagtgcncactccaccgaggccagtggactccagcctaggtcagtgcgagtgggctgggacagtgtacacgtcncgtacatcagcacgcctgactagtcgtagtattgtaattttgacgttaagttttattacgtcgtactagtacttaatttatagtaagttaaccgtcggtacccttcccggttagggtaaccggttccgggaccgtaaacggggaaccgtaagggtaccggtaaacgtcccgtaaaacgg

SEQ ID NO: 189643 - DNA, 655 bp, Homo sapiens
  misc_feature: GYAE6OF01B6RKA.35.36.D03.1.454.CMB.1.raw
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggganagacgccctaccctctcctggcaggggccagtcagagtattcggaacaacgtagtctggtaccagcacgaaaccgtgggccgggctcccgaggcctcctcattctatggtncatccaccgagggccaacgtcggtactcccgaagtcccaaggttcaggtggcctaggtcgggtactggggactaggacctttcgaccttcctacacccagttacacggtccaacgccttgaccacggttccgtagaaaggttatttaacgtgtaccgttaaggttttaacctcgaacccgttgtcgtaaggtacctaaggtttttaaactacgggcccgttccgggcccccgtccgttccgtttccggtttcccggtttcgggggaacccgggtaacggggaacccgtaagggggttagggaacgaaacggttaacgaaaaaaccggg

SEQ ID NO: 189644 - DNA, 747 bp, Homo sapiens
  misc_feature: GYAE6OF01C4O5S.35.36.D03.1.454.CMB.1.raw
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgctttttagaaggtgtccagtgtgaggtgcagctggtggagtctgggggagcctggtcaagcctggagagtccctgagactctcctgtgtagcctntggattcaccttcaatatgtatagcatgaccctgggtcccnccaggctccgtaggggaagggctggagtgggtctcgatctattggaagttagtgtttgttaatacgattaattagtagggagacgggtcggggtcggggggtccgtagttacctaccacttccttcccgaagaacgaacccgaaaccggacccgaaaacggaaaccgaccgtaaggtttaactttttaccgtaacggtaacctaaaaagttacggaaaaccgtaacggtacccgttacgggaccggtaaacgggaacccgggtaacggggaaacccgaaccggggtaccgtttaggggttacggtttaaacgttttaaccggtttacgggttacgggtacccgggtaaagggttaacggggttaggggaaacggggggtacccggttaaaccgggggttccccccggggtttttaacccccccccggggggtttttaaagggg

SEQ ID NO: 189645 - DNA, 524 bp, Homo sapiens
  misc_feature: GYAE6OF01CJJYM.35.36.D03.1.454.CMB.1.raw
  modified_base (303)..(303): a, c, t, g, unknown or other
  misc_feature (303)..(303): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcacttcaatatgtatagcatgacctgggtccnccaggctccgtgggaaggggctggagtgggtctcatctattggaagtgtgttgttatacatattatggagacggcgggtgggggccgtattcaccatctcagagacaacgccaagaacgcagtatttctagacaaatgaacagcctgcgagacgaggacacggctgtgtattagtgtgcgagaggtggagggagacgggtccggttcccccgggtttacgg

SEQ ID NO: 189646 - DNA, 550 bp, Homo sapiens
  misc_feature: GYAE6OF01BOZFI.35.36.D03.1.454.CMB.1.raw
  modified_base (312)..(312): a, c, t, g, unknown or other
  misc_feature (312)..(312): n is a, c, g, or t
  modified_base (448)..(448): a, c, t, g, unknown or other
  misc_feature (448)..(448): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggagcctggtcaagcctggagagtccctgagactctcctgtgtagcctctggattcaccttcaatatgtatagcatgacctggtccgcaggctccngggaagggctggagtgggtctcgatctattggaagttgtgtttgtttatactatatttatgggagtacggtcgggtggggggccgtagttcgacctatctcctagaacgaccaacgccaagaacgcagttatttcngacaaatgaacacgtcctgcgagacgaggacacggctaggtcgtattatgtcggcgaggagtggacgggagtacgggttcccggttcccccggggtttaagg

SEQ ID NO: 189647 - DNA, 710 bp, Homo sapiens
  misc_feature: GYAE6OF01C27QA.35.36.D03.1.454.CMB.1.raw
  modified_base (169)..(169): a, c, t, g, unknown or other
  misc_feature (169)..(169): n is a, c, g, or t
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagacgcccaccctctcctgcagggccagtcagactattagtaccaacttagcctggtatcagcagaactggtcaggcctccaggcctcctnatctagtggtgccatccaccacgggccactcggtactcccgagcccgtaaggttcaggttggccgtagggttcggggtacgtcggggaacgtacggtacgttttaccgaccttaccttacccgaaccctacgttaccgaacggccgtaaccggtcccgttcggacccgtaacggtttcttacgggtaagttttacgggttaacgttttttacggtaccgttttaagggttttttaccttttaaccggttcgtttaacccgtaggttaccttaaagttttaacgtacgttaaacgttaaaccggttcgggtaccccgttaccgggttacggtaccgggtttacccgggaccgtaaacggggtacccgtaaaggggttaccggtaaaggttcccgtaaaaccggg

SEQ ID NO: 189648 - DNA, 589 bp, Homo sapiens
  misc_feature: GYAE6OF01BGM60.35.36.D03.1.454.CMB.1.raw
  modified_base (215)..(215): a, c, t, g, unknown or other
  misc_feature (215)..(215): n is a, c, g, or t
  modified_base (330)..(330): a, c, t, g, unknown or other
  misc_feature (330)..(330): n is a, c, g, or t
  modified_base (450)..(450): a, c, t, g, unknown or other
  misc_feature (450)..(450): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagacgcccaccctctcctgcgagggccagtcagactattacgtaccaacttagcctaggtactcagcaagaacctggtcacggcctcccgaggcctcctctattctagtgggtcnctactcccaccgaggccctacgtcggtactcccgagtccctaggtttcagggtcggacgtagggttcggggtctacggggactacggtacgttcaccgttcctaccgacctatcgacgcncgtcctgctgtctgattgtatttgacttagtttatacttgtactagtactattagtagtaacttacgtcggtacccgttcggtcggtaccggttcggaccggtaagggaccgtaagggtcggtaacgtacgtaaaccgg

SEQ ID NO: 189649 - DNA, 535 bp, Homo sapiens
  misc_feature: GYAE6OF01D1669.35.36.D03.1.454.CMB.1.raw
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
  modified_base (528)..(528): a, c, t, g, unknown or other
  misc_feature (528)..(528): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggacagacgccaccctctcctgcagggccagtcagagtgttagcagcaacttagcctggtaccagcaagaaagttggaccaggcctcccgaggctcctctattctttggtgtcgtaccagtacggggccgtcgtgggtcgtcccgagtcgaggttcaggtggctaggtggctcgtgggacaggtacgttcnctctcacctatcagcagcctgctagtctagtaagtnttttgacttagtttacttacgtgtctagactaaatataatgtcttggcctggtgttcgcttacgtttcggaccgagggtaccaaggtcgnggtaacg

SEQ ID NO: 189650 - DNA, 571 bp, Homo sapiens
  misc_feature: GYAE6OF01BSYE6.35.36.D03.1.454.CMB.1.raw
  modified_base (214)..(214): a, c, t, g, unknown or other
  misc_feature (214)..(214): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagcccaccctctcctgcagggccagtcagactattagtaccaacttagcctggtatcagcagaacctggtcaggctcccaggctcctcatctagtcggtgcatccaccgagggcccagtggtactcccgagcctaggttcaggtggcgtaggtcgggtctacgggacaggtacgttccacttcctaccacctactacgagcacgtcctgctacgtctgattcgtagttttcgacgttacgttttatttacttacgtctacgtctatttactagtaacttaacgtcggtccctccgggtcggtacggttccggaccgtaacgggacccgtaagggtcggtaacgtcgtaaaccggg

SEQ ID NO: 189651 - DNA, 586 bp, Homo sapiens
  misc_feature: GYAE6OF01DZOIN.35.36.D03.1.454.CMB.1.raw
  modified_base (165)..(165): a, c, t, g, unknown or other
  misc_feature (165)..(165): n is a, c, g, or t
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactgganaaacngtgatgacgcagtctccagccatcctgtctgtgtcctccgagggganagacgcccaccctctcctgcgacgggccagtcagactatacgtaacctaacttagcctggtactcagacacgaaacctggtacacggcctccgaggtcctcctcatctagtggtcncactccaaccgacggccacgtcggactcccgagtaccgtaggttcaggtggctagggttgggtctacggggactagtacgttcctactctacaccatccgacgcacgcctcgactacgtctgtattggtatttcgacctaacttacttattacgtaacacgtaagtacgtactacggtaaccgccgtacgtactacgacgtccgttaccggaacgtaacgggaactaaccgtacggtacggtaagtaaaacgg

SEQ ID NO: 189652 - DNA, 728 bp, Homo sapiens
  misc_feature: GYAE6OF01DBJF0.35.36.D03.1.454.CMB.1.raw
  modified_base (170)..(170): a, c, t, g, unknown or other
  misc_feature (170)..(170): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggaagaaacngtgatgacgcagtctccagccatcctgtctgtgtctccgaggggacagacgcccacctctcctgcaggccagtcagctattacgaccaattcgcctggtactcgagctaagaaccgtggtaccacggcctcccgagtcctccgtatactctagtgtcgacctactccgaccgacggcccacggttacggtactccccgaaggtcccgtaacgggttcagggttcggacgttaggggttcgggtaccgttaggggaacgtacggtacgttaccaccgttaccgtaccaaccgtacttacgacgtaccgtaacggtccttcggactacggttcttaggtacgttagttaacgttttcgactttaaggtttttacgtaccgttgttacctacggttacttaaagttttactacgttaaacgttaaccgggtaccgggttcccccggtttaacggggttccgggttaacccgggtttacccgggtaaacccggtaaaaccggggggttaacccgtaaacgggggttaaccgggtaaaaccggttccccggttaaaaaccggg

SEQ ID NO: 189653 - DNA, 533 bp, Homo sapiens
  misc_feature: GYAE6OF01B9YQ1.35.36.D03.1.454.CMB.1.raw
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
  modified_base (483)..(483): a, c, t, g, unknown or other
  misc_feature (483)..(483): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggagcctggtcaagcctggagagtccctgagctctcctgtgtagcctctggattcacttcaatatgtatgcatgacctggtcccgccaggctccgtgggaagggctggagtgggtctcatctattgggaagttgtgttgttatacattattatggagacgcgggtgggggccagttcaccntctcagagacaacgcaagacgcagtatttcagacaaatnaacgagtccgtgacgtagacgaaggacgacggtctggtagttattanggtgacgagacgtgggacgggactagggtcccgttcccccggggtttaag

SEQ ID NO: 189654 - DNA, 570 bp, Homo sapiens
  misc_feature: GYAE6OF01A2GGY.35.36.D03.1.454.CMB.1.raw
  modified_base (215)..(215): a, c, t, g, unknown or other
  misc_feature (215)..(215): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagacgcccaccctctcctgccaggggccagtcagactattacgtaccaacttgcctggtatcagcagaacctggtcaggcctccgaggcctcctcatctatggtcgcactcccaccgaggccacgtggtactcccagccaggttcagtggcaggtgggtcagggacaggacgttcacgttcacacctatcagaccacgtcctgctagtctagattgtatttgcgttagtttacttacgtgttacagtactagttatacgtaattaccggtcggtaccccgttcgggttcgggtaacccgttacgggaccggtaacggggaaccgtaagggtacgggtaaacgtcccggtaaacgg

SEQ ID NO: 189655 - DNA, 637 bp, Homo sapiens
  misc_feature: GYAE6OF01CKGMH.35.36.D03.1.454.CMB.1.raw
  modified_base (288)..(288): a, c, t, g, unknown or other
  misc_feature (288)..(288): n is a, c, g, or t
  modified_base (583)..(583): a, c, t, g, unknown or other
  misc_feature (583)..(583): n is a, c, g, or t
tcagtacagatcgtcacgaccggtgctcgatttagctgcgtcacgatctctcttggggtctgagagaggagccttagccctggattccaaggcctatccacttggtgatcagcactgagcacgagatcacatggaactgggctccgctgggtttccttgttgtctttttagagtgtcagtgtgaggtgcagcgtggtggaggtcggtgggggaggccgtggtacaaggccgtggagacgtccctgagactctccgtgtgtacgcctcgtggtaacttccaaccctttnaaattattaggtaatacgacaagtcgaccgttcgggtacccgccgaggcctccggtagggggaacgggcgtagggaggttcgggtcttacagtcgtaagttggaaagttgtttgtttagtttaatacaattagtttagagggagacgggtcggggtcgggggcctattccgaacctattcccgtacgaagaacgaaccgaaccgaccaaagaaccgactagttactttcgagaacaaatacgaacgagccgtagcgaagacggaaggtacacggcgttagtagttacgttaacgnggtgacggtagagggtggacggtacgcggttccccgggttccccgggttaaggg

SEQ ID NO: 189656 - DNA, 668 bp, Homo sapiens
  misc_feature: GYAE6OF01CQ9W5.35.36.D03.1.454.CMB.1.raw
  modified_base (215)..(215): a, c, t, g, unknown or other
  misc_feature (215)..(215): n is a, c, g, or t
  modified_base (323)..(323): a, c, t, g, unknown or other
  misc_feature (323)..(323): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagagcccaccctctcctgcagggccagtcagactattagtaccaacttagcctggtatcagcagaaacctggtacaggcctcccgaggcctcctcattctagtggtcnctactccaccgaggccctaacgtggtactccccgagcccgtaggttccagggttcggacctagggttcggggtccgtaggggaactagggtaacgtttccgtaccttcctaccgaaccctacgttaccgaacggccaacggtcccttcggcctacggttccttggtaactttgttaactttttcggacgtttaagtttttacttacgttgttacacggttacttagtttagtacgtaacgttaaccgtcggttacccgttaccgggttacggtacccggtttaccgggacccggtaaacggggtaaccccgtaagggtacgggtaaaccggtcccgtaaaacggg

SEQ ID NO: 189657 - DNA, 603 bp, Homo sapiens
  misc_feature: GYAE6OF01EUGRR.35.36.D03.1.454.CMB.1.raw
  modified_base (299)..(299): a, c, t, g, unknown or other
  misc_feature (299)..(299): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaatagcctggtaccagcaagaagtgcaggctccagctcctnattcgttgtgtgtccacgtacgggcctcgtggtcgtcccgtagtcctaggttcaggtcggctaggttggcttcgtagggactaggtacgttcacgttctaccaaccgtataccgacgccacggtccctagccgtacgttcctaggtaacgttagtttttacgacgtttagtttttaacgttacctttagtaccgtaagtacctaaaagttaacttaaagtacgtaccgtcggtacccttacggtagttacgtaccgttacgttttcgggacccgtaacggggtaaccctaaggcgttaacgggg

SEQ ID NO: 189658 - DNA, 595 bp, Homo sapiens
  misc_feature: GYAE6OF01BCTBA.35.36.D03.1.454.CMB.1.raw
  modified_base (215)..(215): a, c, t, g, unknown or other
  misc_feature (215)..(215): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagacgcccaccctctcctgcgagggccagtcagactattacgtaccaacttagccttggtatcagcaagaaccgtggtcacggcctacccgaggcctccgtcatcctagtggtcgctactcccgacgacgggccacgtggtacctcccgacgtccgtaggttcaggtggcagggttcgggtctgggactagtacgttcactctacaccatcacgcacgcctgacctgtctgtacgttgttagttttacgctttaagtttacttacgttgtacaggtactatttagtacgtaacgttacgtccggtcccgttacgggtacgggtaccgttcggaaccggtaacgggacccgtaagggtacggtaacggtacccgtaaacgg

SEQ ID NO: 189659 - DNA, 621 bp, Homo sapiens
  misc_feature: GYAE6OF01BD3YF.35.36.D03.1.454.CMB.1.raw
  modified_base (217)..(217): a, c, t, g, unknown or other
  misc_feature (217)..(217): n is a, c, g, or t
  modified_base (336)..(336): a, c, t, g, unknown or other
  misc_feature (336)..(336): n is a, c, g, or t
  modified_base (517)..(517): a, c, t, g, unknown or other
  misc_feature (517)..(517): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactggagaaacagtgatgacgcagtctccagccatcctgtctgtcgtctccgagggganagacgcccaccctctcctgcagggccagtcagtactattacgtaccaacttacgcctggtactacgagccaagtaacctggtaccaggcctcccgaggtcctcctacactctagtggtnaccactcccaccgacggcctacgtcggtactcccgagtccgtaggttcacggtggacgagggtcggggtctaggggactaggtacgttccgactctaccacctactcgaacgcgacgtcccgtgacgtacgtctagtgtttggtacttttcgacgtttaacgttttattacgtcggttaanacgtattagtttatagtaaccgttacgtccggtacccggtcggttcggtaccggttccggaaccggtaacgggaccgtaagggtacgtaacgtaccgtaaacgg

SEQ ID NO: 189660 - DNA, 743 bp, Homo sapiens
  misc_feature: GYAE6OF01EYPGG.35.36.D03.1.454.CMB.1.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgagggganagacgcccaccctctccngcgagggccagtcagagtgttagcagcaacttacgcctaggtaccagacgaaggtaaacgttcggaccagggcctcccgaggcctccgtctagttcgtttggtcgtcgtacccgtacgtacggggcccgtcgttcgggtccgtccccgaaggttcccgaagggtttcaagggttcgggcgtaagggtcgggtccgttacggtcggggtactaacggttacggtttaccgtaccgttcccttaccgtaacctacttccgagtaccgacgtcccgttcgaccgtacggttccgttaaggtaagtttacggttttacgtaacgtttacggtttttaactttaccgttcgttaccgtaaggtaacttaaaatttaacgttaaacgttaacggacccgtttacggggttaccccgttaccgggtttacggtttcgttacccgtttaacgggtttttaccgggtacccggtaaacggggggttaacccctaaacgggttccgtacgggttaaacgg

SEQ ID NO: 189661 - DNA, 703 bp, Homo sapiens
  misc_feature: GYAE6OF01E2DI6.35.36.D03.1.454.CMB.1.raw
  modified_base (164)..(164): a, c, t, g, unknown or other
  misc_feature (164)..(164): n is a, c, g, or t
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactgganaaacngtgatgacgcagtctccagccatcctgtctgtgtctccgagggganagacgcccaccctctcctgcgagggccagtcagacttagttacgtaccaacttagcctaggtactcgagacaagaacctggtccacggcctccgaggtcctcctntacttctagtggtacncctactacccgaccggacggacctacgttcggtaccncccgacgtcccgtaggttaccaggtcgggacgtagggttcgggtacgtacggggactacgggtacgtttccgaccgttcctacccgtaaccctagtccgtaacggaccgtaccggtcccgtcgaccgtacgttcgtagtagttacgtttacgttttacggacgtttagttttaacttacgttcgttacgtacgttacttaagttacgtacgtaacgttaaccggttccggttacccgttaccgggttcgggttaccgggttaccgggtaaccggtaaaccgggggtaaccggtaaacgggtacgggttaaacccgtaaccggtaaacggg

SEQ ID NO: 189662 - DNA, 732 bp, Homo sapiens
  misc_feature: GYAE6OF01CJXTS.35.36.D03.1.454.CMB.1.raw
  modified_base (316)..(316): a, c, t, g, unknown or other
  misc_feature (316)..(316): n is a, c, g, or t
tcagtacagatcgtcacgaccggtgctcgatttagctgcgtcacgatctctcttgggtctgagagaggagccttagccctggattccaaggcctatccacttggtgatcagcactgatcaccgaggattcaccatggaactggggctccgctgggttttccttgttgtctttttagaaggtgtccagtgtgaggtgcagctggtggagtcgtgggggagcctggtcaagcctggagacgtccctgacgactctccgtgtgtacgcctctggattcacctttcaatatggtaataggcagtcgacccgtgggtcccnccgaggccttccgtagggaaggggctgggagtgggtctcgatctaagttcggtaagttgtgtttgtttaatactaagttagttagtcggagtacggtcggggtacgggggtccgtagttccgacccgtaattcccgtaccgaaggaacgtaaccgaaaccggacccgaaaggaacccgtacgtaacggttacttttacggtacgtacgtaaaacgtacggaaaccgtacgggtacccgttaggaccggtaacgggaaccggtaacgggaaccgtaacgggtacccgttaggttaccgggttaaacgtttaccggttacggttcggaccgggtaaggtaacgggtttacggggaacggggtaccccgggttaacggggttccccccggggtttaacccccccggggtttttaagggg

SEQ ID NO: 189663 - DNA, 569 bp, Homo sapiens
  misc_feature: GYAE6OF01B0UTO.35.36.D03.1.454.CMB.1.raw
  modified_base (475)..(475): a, c, t, g, unknown or other
  misc_feature (475)..(475): n is a, c, g, or t
tcagtacagatcgtcacgaccggtgctcgatttagctgcgtcacgatctctcttggggtctgagagaggagccttagccctggattccaaggcctatccacttggtgatcagcactgatcaccgaggattcaccatggaactggggctccgctgggttttccttgttgcttttttagaaggtgtccagtgtgaggtgcagctggtggagtcgtgggggaggcctggtcaagcctggagagtccctgagactctcctgtgtagcctctggacttcacctttcaatatgtatagcatgaccgtgggtcccaccgaggctccgtggggaagggcgtgggagtgggtctcatctattggaagttagtgtttgtttatactattattagtaggaggacggcggggtcggggggccgtagttccacatcctaccagagaaccaacgaccaagaaccgacagttatttctgacaaatgaacngacctgacggacgacgaggacgacggctggtgtattactggtgcggaggaggtgggacgggacgacgggttcccgggttccccccgggtttagg

SEQ ID NO: 189664 - DNA, 830 bp, Homo sapiens
  misc_feature: GYAE6OF01BM40J.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactgggctccgctgggttttccttgttgtctttttagaaggtgtccagtgtgaggtgcagcgtggtggagtcgtgggggaggccgtggtcaagccgtggagtacgtccctggacgtactcctccgtgtgtaacgcccttcgtggtacttccaccctttacaaattattgttaatacggctaagttcggtaacccggttcggggtcccgccgtagggtcccttcccgggtagggggaaacggggtccgttggggtaacgggttcgggggttccttacgtaacgtttccgttaaaggtttaggggtaaaaggtttagggtttaggtttttagggtttttaaactaacgtttaaagtttaagttttaaggttacggggaaacgggtaacccgggggtccgggggggttacgggggggtacccgtaacgttttaccccgaacccgtaacttcccgtaacccgaagggaacgaacccgtaacccgaacccgaaaacggaacccgtacgtaaacgtttaattttccgtaacggaacgtaaagttacggaaaaccgacgtaccccgtaggtaccggaacggaaccggaagggaaccgtacgggtccttaggttacgttaacgttacgtggtacggacggtaaggaggttacggacggggtaccgtacggggttcccccggttacccccgggtttaggg

SEQ ID NO: 189665 - DNA, 765 bp, Homo sapiens
  misc_feature: GYAE6OF01ESSF9.35.36.D03.1.454.CMB.1.raw
  modified_base (190)..(190): a, c, t, g, unknown or other
  misc_feature (190)..(190): n is a, c, g, or t
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
  modified_base (480)..(480): a, c, t, g, unknown or other
  misc_feature (480)..(480): n is a, c, g, or t
tcagtacagatcgtcacgaccggtgctcgatttagctgcgtcacgatctctcttgggtctgagagaggagccttagccctggattccaaggcctatcccacttggtgatcagcactgagcaccgaggatcaccataggaacgtgggcctccgcgttcgggttttccttgttgttcgtttttagtaaggtngtcgtagtgtgaggtgcagcgtggtggtaggtcgtggggtagggtcgtggtcgaaggccgtggacgagtccgtcgtacgtctctctcgtcgtgccgtcttcggtacttctaccttactaataattagtatagtancctacgtcggaccctacggtccggtccctacggnaacgggtcccgttggggaaggggtcgggtcggtacggtagggtcgtacgttaggtaacgttaagttagggttaaggtttaagttacgttagtttaagtttaactagttaagttaacgtacnggggtagggggtaccgggacgggttacggggggtaccccggtaagttacctaccctaagtacgtaccgtaaacggaaccgaaacggaaaccggacccgaaacggtaaaccgttaccgtaacggttaacgtttaaacgttacggtaaaccgtaaagtaccgtaaacgtacggaaccgtaacggacggtaaacgtaaccgggaacggtaaccgtaacggtaccgttacggttaggttaacgttaacggttaggtacggtacgggacgggtacggtacgggtaccggg

SEQ ID NO: 189666 - DNA, 544 bp, Homo sapiens
  misc_feature: GYAE6OF01BC9EP.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctgggtggagtcgtgggggaggcctggtcaagcctggagagtccctgagactctcctgtgtagccctctggattcaccttcaatatgtatagcatgacctgggtccgcaggctccgtggggaacgggctgggagtgggtctcatctattggaagttagtgttgtttatacattattatggagacggcggggtgggggccgattcaccatcctcagagacacgaccaagacgcagtattctgtacaaatagaacagcctgcgagacgaggacgacggctggtgtagttacgtgtggacgagaggtggagggacgtacgggttcccggttccccccgggtttaagg

SEQ ID NO: 189667 - DNA, 765 bp, Homo sapiens
  misc_feature: GYAE6OF01DMPLA.35.36.D03.1.454.CMB.1.raw
  modified_base (271)..(271): a, c, t, g, unknown or other
  misc_feature (271)..(271): n is a, c, g, or t
  modified_base (376)..(376): a, c, t, g, unknown or other
  misc_feature (376)..(376): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctgggtggagtcgtgggggagccctggtcaagcctggagacgtcccgtgagacctctcctgtgtagccctntggactttcaccttcaatatgtatgctatgaccgtgggccgccaggctcgtggggaagggctggagtgggtctcattctagttgggaagttgttgtttgtttaanactagttattagtgggaacggaccggtcggggggtacggggggtacccgtagtttacccgaacctacgttcccgttccgaaaggtaacggaaacccgtaacccgggaacccgaaaacgggtaaacccggaccgtaaacggttttaacgttttaccgttacggtaaccgtaaaaacgttcggaaaaaccgtaccggtacccgttacggggaacccggtaaacgggtaccgggtaaacggggaaccccgtaacggggtccctttaggggttacgtttaaaccgtttaaccgttgggttacggaaccgggtaaggtaacgggtaggggaaccgggggtacccggttaaacggggttccccccgggttttacccccccgggggttttaaaggg

SEQ ID NO: 189668 - DNA, 759 bp, Homo sapiens
  misc_feature: GYAE6OF01ALRUY.35.36.D03.1.454.CMB.1.raw
  modified_base (169)..(169): a, c, t, g, unknown or other
  misc_feature (169)..(169): n is a, c, g, or t
  modified_base (218)..(218): a, c, t, g, unknown or other
  misc_feature (218)..(218): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtcgtcctccgaggggganacgacgcccaccctctccgtgcgagggccagtcacgtactattacgtaaccaacttacgcctggtactcgagaccaacgtaaacccgtggtaccgacggccctaccccgaggtccttacccgtactaacttcctaacgtcgggtacgacctaacctaccccgaaccggtacggggtacccctaaccggtttacgggtaaccctaccccgtaacggtccccggtaagggtttccgacgggttcgggaccgtagggttcgggtacgtacggggactagggtacgttccaaccgtcctacctaacctacgtccgaacgccgtacggtccctgacctacggttcctaggtactttggttaacttttcggacgtttaagttttaacgttcttacggttacgtacggtactttaagttagttaacgtacgtttaaaccggtccgggtttacccggttaccgggttacgggttacccgggttaccgggacccgggtaaacggggttaccgtaacggggttacggtaaccgtaacccgttaaaaccggg

SEQ ID NO: 189669 - DNA, 861 bp, Homo sapiens
  misc_feature: GYAE6OF01DS5ZE.35.36.D03.1.454.CMB.1.raw
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
tcagtacagatcgtcacgaccggtgctcgatttagctgcgtcacgatctctcttggggcagagctctggggaggaactgctcagttaggacccagacggaaccatggaacgccccagcgcagcttctcttcctctgctactctggcctccgaggaaccacgtggaagaaacngtgatgaccgcacgtccnccacgcctacttcctgtctgtcgtcctacggaggggagacgccgcccctaccccgtctccgcggacgacgggcctagtcagtaccttaagttaaccgtaacctaacttacgcccgttaggtaactcacgtaccgaacgtaaaccgtggtccacggtccctcccggacggtcccttacccgtacacgttctaacgtgggtaccacctaccgtacccgaacccggacggtacccctaaggttccggtaaccgtaccccgagtacccggttacggttacgacggtccggtcggtacggggttcgggtcggtacggggtacgtaacggttacgttccgtaccgttacctaccgtaacctacgttcgaacgtcggtaacccgcgttcgtaaccggtttacgtaccgttacgttaaggtttacgttttaacgttttaccggttacgtttttaacggttttaccgtttaaccgtttaacgttacgtacgttaactttaagtttaacggtaaaccgttaaggtttaaaccccggttccgggttaacccgggtttcccgggttaccggggtttaaccccggggtttaccccgggaaaccccggggttaaacgggggttaaccccggggttaaaggggttaaccgggtaaaccccgggttaaacccggttaaaacccgggg

SEQ ID NO: 189670 - DNA, 582 bp, Homo sapiens
  misc_feature: GYAE6OF01BH43L.35.36.D03.1.454.CMB.1.raw
  modified_base (307)..(307): a, c, t, g, unknown or other
  misc_feature (307)..(307): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggaagagcccaccctctcctgccagggccagtcagactattacgtaccaacttagcctggatcagcagaacctggtcaggcctccgaggcctcctnatcgtatggtcacactccaccgaggccacgtcggtactcccgagtccgtaggttcaggtcggaccgtagggtcgggtacgtagggactaggtacgttccacgtctacaccgtatacagcacgcctgctagtctgattgtactttgacttagtttacttacgttgtactagtactattagtagtaacgttaacgtcggttacctaccgggttcggtacccggttaccggaaccgtaacggggaacgtaagggtcggtaacgtaacccggtaaacgg

SEQ ID NO: 189671 - DNA, 713 bp, Homo sapiens
  misc_feature: GYAE6OF01A1XER.35.36.D03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgagggganagacgcccaccctctccgtgcagggccagtcagactagttacgtaccaacttgcctggtatcagcagaacctggtcaggcctccgaggcctcctcattctagtggcnctactccgaccgacggccacgtcggtacncccgagcccgtaggttccaggtcgggactagggttcgggtcgtacggggtacgtacggttacgttaccaaccgttccgtaccgaaccgtaacgttaccacggccgtaacggtcccgttacggaccgtaggttctacggtagttacggtttagttttacggaccgttttaagttttaacgttaccgttcggtacgttacgtacgttaagtttacggttaacgtaaccgttaaacccggttcgggttacccccggtttaccggggttcggggtaacccgggtttaccgggaaacccgggtaaaaccggggtaccggttaaaaggggtttccgggaaaacccggtttaacccgtaaaacccgggg

SEQ ID NO: 189672 - DNA, 636 bp, Homo sapiens
  misc_feature: GYAE6OF01DNQ1S.35.36.D03.1.454.CMB.1.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
  modified_base (541)..(541): a, c, t, g, unknown or other
  misc_feature (541)..(541): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactggagaaacngtgatgacgcagtctccagccatcctgtctgtgtctccgagggganacgacgcccaccctctcctgacacgggccaggtcagtactattacgtaacctaacttagccttaggtatcgagacagaaacctggtaccaggcctacccgaggtcctcctnactcgtacgtggtcnccactacccgacgacgggcctacgtacggtactccccgagtcccgtaggtttcacggttcgggacgtaagggttcgggtaccgtagggacgtaagtacggttacctaccgtacctaccaaccgacttacgacgtacacggtccgtacgacgtacgttctacgtattggttaactttcgactttagttttactttacgtntacgagttctaattagtagtactacgtcggtacccgttcggtcggtaccgttacgaccggtaacggaacgtaagggtacggaacgtcgtaaacgg

SEQ ID NO: 189673 - DNA, 689 bp, Homo sapiens
  misc_feature: GYAE6OF01CNVPP.35.36.D03.1.454.CMB.1.raw
  modified_base (637)..(637): a, c, t, g, unknown or other
  misc_feature (637)..(637): n is a, c, g, or t
  modified_base (660)..(660): a, c, t, g, unknown or other
  misc_feature (660)..(660): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactgggctccgctgggttttcctgttgtctttttagaggtgtccagtgtgaggtgcagctggtggagtcgtgggggagcctggtcaagcctaggagagtccctgacgacttctcctgtcgtacgtccctgttggactttccgacctttacgaattatggttaatagcctagtacggtacccgtcggggtccccgccgagggtcctccggtaggggaaggggtcgtagggagggttgggtcctacgattctaagtttaggaaggttgttagttttagttaataactagttaatttaggcgggtaggtaccggtcgggggtacgggggcccgtacgttacccgtaccacttcccgtcgaacgaaccgtaaccaacccggtacccgaaacggaaaccgacgttaacgttaacttttcgtacgtaacttaaaagtacgaacgtacgtaccgtaggacggtaacgacgggaacggacgacggtaccgtgttagtactttaggnggtgacggaggtagtcgggaggnggtaccggttcccgggtccccgggtttag

SEQ ID NO: 189674 - DNA, 778 bp, Homo sapiens
  misc_feature: GYAE6OF01C7G2A.35.36.D03.1.454.CMB.1.raw
  modified_base (111)..(111): a, c, t, g, unknown or other
  misc_feature (111)..(111): n is a, c, g, or t
  modified_base (156)..(156): a, c, t, g, unknown or other
  misc_feature (156)..(156): n is a, c, g, or t
  modified_base (169)..(169): a, c, t, g, unknown or other
  misc_feature (169)..(169): n is a, c, g, or t
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (600)..(600): a, c, t, g, unknown or other
  misc_feature (600)..(600): n is a, c, g, or t
tcagtacagatcgtcacgaccggtgctcgatttagctgcgtcacgatctctcttggggcagagctcgtggggagaactgctcagttaggacccagacggaaccatggaacncccagcgcagcttctcttcctctgctactctggctccgagaaccncgtggaagaaacngtgatgacncagtcncgagccatcctgtctgtcgtccgacggaggggacacggaccgccctacccctctccgtggaccgacgggacctaggttcgaagtaacctttaagttaaccgtaaaccctaacgtttacggtaccgttaggttaacaccgaagaacccgtaaacggtaaacccgttggtaccgaaccgggtccctacccgaggtcccttaccgtactaacgttacgttaggtcgggaccacctaccgtacccgtaacgggaaccggtaccaacggttccggtaaccctaccccgaggtaacccgttaggttcgaggtcgggtaccggtagggttcggggtaccctaggggaacctagggtacctttaccgaccgttaccaccaaccgtacgtacgacgccgaacgttccgacgtacgtacgttacgngtaacgttgttttaaccgttagtaccgtttaagttttactacggttgttaaccgtagttaactttagttaacgacgttaaaccgttcggtacccggtccgttacgggtacccgggttacggtacccgggaaccgttaaaggggacccgttaagggtacgtaaaccgtacgtaaaccgg

SEQ ID NO: 189675 - DNA, 712 bp, Homo sapiens
  misc_feature: GYAE6OF01BSA4T.35.36.D03.1.454.CMB.1.raw
  modified_base (183)..(183): a, c, t, g, unknown or other
  misc_feature (183)..(183): n is a, c, g, or t
  modified_base (330)..(330): a, c, t, g, unknown or other
  misc_feature (330)..(330): n is a, c, g, or t
tcagtacagatcgtcacgaccggtgctcgatttagctgcgtcacgatctctcttgggtctgagagaggagccttagccctggattccaaggcctatccacttggtgatcagcactgagcacgaggatcacatggactgggctccgcttggtttccttgttgtctttttagagtgtcagtgtgnggtgcagcgtggtggagtcggtgggggacgccgttggtacaagccgtggagtacgtcctgacgtactctcctgtgtacgtcctcgtggtactttccaacctttcaaattgtgttaatagactacgtcggtacccgtcggggtccccnccggacggtccgttccggtagggggaacggggtcgttaggggtaggttcgggtcctagtacgttcgttaagtagggtaaagtttgttgtttaagtttaatacttaagttattaggtggacgggtcgggtcgggggtcgggggtacctacgttaccgaacgtctacctaccgaaggtaacgaaccgaaccgaccaaaggaccctagtaacgtttatttaccgagaacaaagtacggaacgtaccgtccgtaggacggtaacggaacggtacggaaccgtaccggtacgttaggttcgtttaacgttacgtggttacggacggtaagtacgggtagggaccgggtacggttacccggggttccccgggttcccccggggttaag

SEQ ID NO: 189676 - DNA, 860 bp, Homo sapiens
  misc_feature: GYAE6OF01E0V6S.35.36.D03.1.454.CMB.1.raw
  modified_base (208)..(208): a, c, t, g, unknown or other
  misc_feature (208)..(208): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccagtggacgtggggctccgtcttgggttttcttgttgtctttttagaggtgtccagtgtgaggtgcagcgtgggnggtagtcggtgggggacgtccgtggtaccaaggtccgtgggacgtacgtcccgtagacgtaccttccgttccgtggtacgtacgtcccgttcgtggtactttccgtaaccttcgtaaggttacgtcacgttgggatcggcctacggttcggggtcccgtaccgtaacggttcccggaagggggtaacggggttcgttacggggtttcggtttcggggtttaccaacgggtttaacggttaccggtagggttaggtaacgggttcggggaaccttacgggtaaaccgtacgtaaacggttccggtaacccggtaccgggtaccgtttacccgggtaacgggtaacccggggtccttaacccgtttcccccccgtaacccccggtaccaaaggggaaccccgtaaaaccggtaaacccgacccgtaaaaccgaacctaacccgtaaacttaacgtactaccgtaaagaacctaaaagtacggtaacgtaacgttaggaaccgggtaaggacccggaaccggtaacggtaccggtaccggtacttaccggtttagtaaccgttttaggtacgggttaggaaacgtaacgggggtacggttacccgaaccgttaaacggttaaacgtcgtttaacgtttttgggttaccctacggg

SEQ ID NO: 189677 - DNA, 898 bp, Homo sapiens
  misc_feature: GYAE6OF01A5QW6.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggcctccgcttgggttttccttgttgtcttttttagaaggtgtccagtgtggagtgcagctggtggagtcgtgggggagcctggtcaagccgtggagacgtccctgacgactcgtcctgtacgtacgtccttgtaggtacttcctaccctttacaaattagttacgtaagttacggacctagtccggaccggttcgggtaccccgccgacgggtccgtccggtaggggggtaaacggggtcgttaggggacgtttcggggtaccttacgtaacttccgttaagtttagggtaaaggtttaggtttgttttaggtttaactaacttaagtttaatttacggtagggtaacgggtaccggggttacggggggtaccgggggggtaccttaaccgttacccgtaacccgtacgttacccgtaaccggtaaccggaaacgaaacccggtaaacccgaacccggaaaacggtaacccggtaaccgttaacggttttaaccgttttaccgtaaccgtaacgtaaaacgtaaccggtaaaccgtaaccgtacccggttacgggaacccgggaaggtaacccgggaaacgggtacccggtaaaccgggtaccggtttacgttaagggttaaaccgttttaacggttcgggttaccggaacggggttacgggtaaggggttacccggggggtaacggggttacccgggtaaaccccgggggttttcccccgggtttaacccccccggggggtttttaaagggg

SEQ ID NO: 189678 - DNA, 627 bp, Homo sapiens
  misc_feature: GYAE6OF01AX69J.35.36.D03.1.454.CMB.1.raw
  modified_base (240)..(240): a, c, t, g, unknown or other
  misc_feature (240)..(240): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcttgggttttccttgttgtcttttttagaaggtgtccagtgtgaggtgcagctggtggagtcgtgggggagcctggtcaagcctggagngtccctgagactctcctgtgtacgcctcgtggattccaccttcaatatgtatagctagtcgtacccgtcgggtcccgccgagggtccttcccggtagggggaacgggggtcctggggaggttcgggtcctcgattcgtagttgggaagttagtttgtttagtttatactattattagtgggacgacgggtcggggtcgggggcctagttccacctatccacgagacgaaccaacgccgaaagaccgctaagttactttcagtaactaaagtacgaactagttcgtaggacgtaacggaccggaaggaccgaccggtcttacgttacgttattacgtggtacgacgtaaagggaggttacgacttaaagacttgttaggttttacggg

SEQ ID NO: 189679 - DNA, 863 bp, Homo sapiens
  misc_feature: GYAE6OF01AO9V5.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtctttttagaaggtgtccagtgtgaggtgcagctggtggagtcggtgggggagccgtggtcaagccgtggacgtacgtccctgacgtacctcgtccgtgtgtacgcctcgtggtacttcctaccttacaattagtggtaataggcctatcgaccgtcggggtcccgccgaggtccgtccggtagggggaacgggtcgtgggtaggttcggggtccttacgacgtttccgttaagtttaggggaagtttaaggtttcggttttagttttaaataaccgttaaagtttaagttttaaaggtggggtaaacgggtaaccgggggtcccggggggggtttaggggggggtaccccttaaggttttaccccgaaccccggttaactttacccccggttaacccgaaagggtaaacccgtaaacccgaaaccccgggaaccaaaacgggtaacccgtacgtaacggttttacttttacgaacgtaaactaaacgttaggaaccgtacgtacccgttagggaccgaacgggaaccggaagggtaccccgacggggtactttaggttaacggttaaccgtttaacccggttaggggttcggaaccgggttaaagggtaacggggttacggggaaaccggggttacccggtaacccgggggtttaccccccccggggttttccccccgggggggttttaaaggg

SEQ ID NO: 189680 - DNA, 825 bp, Homo sapiens
  misc_feature: GYAE6OF01AQ6AA.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagccaccggaggtattcaccagtacggaacgtcgggggcctccggtcgtttcgggtttttccttgtttcgttctttttttaaggaaggttcgtaccgtaggttggtggtaggtgacaggtcgtgggtgggtaggtcggtggggggtacgtccgttaggtacgaacggtccggttagggaacggtccgttcccgtaggacgtccttccgtacgttggtcgtacgtccttcgtaggtacttccgtaccttacaattagttagtaatacgtacgtacgttcggtacccgtcgggtcccgtccgacggtccgttccgggtaagggggaggggtcgttgggtaacggttcgggtaccttcgtaacgttcgttaaggtttagggtaacgttaggtttcgtttagtttactaactagttagtttagtagggtacggacggggtcgggggtacgggggtccttacgtccgactacgtccgtaccgaagtaccggaaccaaccggtaacgtaaaccggaaccgtacgttaagtttacttaacgagtaacaacgtaccgaaacgtccggtacctagggaaccgtaacgggaaccgaggtaccggtacgtacggtttagacggttttactagggttacgtcgggtaacggtggtacgggttcgggtaacgggtcccgggttaccccggttccccggggttttaccccgggttaacgggg

SEQ ID NO: 189681 - DNA, 765 bp, Homo sapiens
  misc_feature: GYAE6OF01BDSCI.35.36.D03.1.454.CMB.1.raw
  modified_base (322)..(322): a, c, t, g, unknown or other
  misc_feature (322)..(322): n is a, c, g, or t
  modified_base (441)..(441): a, c, t, g, unknown or other
  misc_feature (441)..(441): n is a, c, g, or t
tcagtacagatcgtcacgaccggtgctcgatttagctgcgtcacgatctctcttggggtctgagagacggagccttagccctggagttccaaggcctatccacttggtgatcagcactgagcaccgaggattcaccatggaactggggctccgctgggttttctgttgctttttagaggtgtccagtgtgagtgcagctggtggagtcgtggggagcctggtcaagcctaggagacgtccctggagtcctcgtccgtgtgtagcctcgtggtattccgacctttcaaattctaggtactagcctaagtcgaccgtggtcccnccgtaggtcctaccggttggggaacgggtcttggggaagttcgggtacctccgatcgttagttcgggaagttagtgtttagtttacgaaccttagtaactttagtacgggagtaccggnggggttcgggggaccgtaagtttcccgaacctacgttacgtacccgaaggaacgaacaaccggaacccgaaaggaaccgtacgtaagtttaaactttcccgtaggaaccgtaaaacgtcggtaaaccgacggttaccccgtaagggaccgtaacgggaacccggaacgggaacccgtaccggggtaccttacgggttaaggttaacccgttttaaacgtcggggtttacggaccggttaaacggggacgggttaggggtaacccgggggtaaccgtttccggggttaaccccccgggttttcccccccgggggttttaaagggg

SEQ ID NO: 189682 - DNA, 835 bp, Homo sapiens
  misc_feature: GYAE6OF01AZ34X.35.36.D03.1.454.CMB.1.raw
  modified_base (245)..(245): a, c, t, g, unknown or other
  misc_feature (245)..(245): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcttgggttttcttgttgtctttttagaggtgtccagtgtgagtgcagctggtggagtcgtgggggaggcctggtcaagccgtggagacgtcccngacgacctcctcctgtgtacgccttcgtggtactttccgtaaccgttttaaggaacttagtcgtaccctagttggtcggccgttcggggtccccgaccggacgggtccctaccgggaaaggggggtaacgggggtccgttagggggtacggggtttcggggttccttacggttaaacggttttaaggtttagggttaggggggtttaacgggtttggggttaacggtaaacgtttaaaccgttaagttaaccctaaccggttaaaccggtccggaaacggtaccccggtttcccgggttaacgggggtaaacccgggggttccccgtttaccgaaccccttacgttaccccgtaccgaaacggtaaacggaaccttaaaccgtttaacccgaaaacggtaaacccaacgttaaccgtagtaaaccgtttacgaaccgtaacgtaaaacttacgggaaaccgtacggtaccccgtaagggacggaaccggaccgggtaaaccggaccggtaccggtaaccgttattaacgtttcgaggtaacgaacgaaacacttaagtacgtacggtacctttaatacgttacgtacggg

SEQ ID NO: 189683 - DNA, 772 bp, Homo sapiens
  misc_feature: GYAE6OF01EY00I.35.36.D03.1.454.CMB.1.raw
tcagtacagatcgtcacgaccggtgctcgatttagctgcgtcacgatctctcttggggcagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgagggccagtcagtagtgttagcagacaacttagcctaggtaccagactaagaaaggttcggaccaggcctcccgaggcctcctctattcgtttggtcgtacgtacccgacgtacgggccgtcgtcgggttcgtcccgtaaggttcgtaacgggtttccaagggtttcgggaccgtagggttcgggtaccgtttaccgggttacgggggaaccttaaacgggtacggttttacccgtaaacccgttcccgtaccgtaaacccctaacgtttacccgaacgggaccctaaaccgggccccgttacgggtacccgttaacggtttacccgtaaggtttaaacgttacggtttttttacggaaccgttttaagggtttttaaactttaacccggtttagggtaaccctaacggtaacttaaaaattaagttaaaacgttaacggtaccgttccgggtaccctttacggtacggtttacgtaccgttaacggttttacgggacccggtaaagggggtaaccctaaagggtcgttaaacggg

SEQ ID NO: 189684 - DNA, 752 bp, Homo sapiens
  misc_feature: GYAE6OF01BR75L.35.36.D03.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
tcagtacagatcgtcacgaccggtgctcgatttagctgcgtcacgatctctcctggggcagagctctgggggaggaactgctcagttaggacccagacggaaccatggaagccccagcgcagcttctcttcctcctgctactctggctccgaggaaccacgtgganaaacngtgatgacgcagtcctccagccatcctgtctgtcgtcctacggaggggacaggacgccctacccctctccgtggaccgacggggcctaggtccacggtaacttaacttaacggtaaccctaacgttacgccgttaggttaactcgacggtaccaacggtaaaccgttgggtaccgacggtaccctaccccgacgggtcccttacctactacgttacgtaggttcgggtcaccgtaaccgtcccaaccggtacggcctaacgtcggtaacctacccgacggtaccgtaggttccgaggtcggacgtagggttcgggtaccgtaggggaactaggtaccgttacaccttctaacccacgacttcgacgtacctcggttcctaggttacgtactttggaacgttttgttaacgttttcgtaacgtttaacgtttgttttaaccgcggtttaacagttaccttagttaagtacgttaacttacgggttcccggtacccgttagggtcccggttaaacgggttcccggaaaccggtaacgggtaccggtaagggtaccgtaacggtaccccggtaaaggttacggg

SEQ ID NO: 189685 - DNA, 713 bp, Homo sapiens
  misc_feature: GYAE6OF01A7KSD.35.36.D03.1.454.CMB.1.raw
  modified_base (296)..(296): a, c, t, g, unknown or other
  misc_feature (296)..(296): n is a, c, g, or t
tcagtacagatcgtcacgaccggtgctcgatttagctgcgtcacgatctctcttggggtctgagagaggagccttagccctggattccaaggcctatccacttggtgatcagcactgagcaccggaggattcaccagtggaacgtggggctccgcgttgggttttccttgttgtcttttttagaaggtgtccagtgtgaggtgcagcgtgggtggagtcggtgggggaggccgtggtcaagccgtggagacgtcctgagtactctcctgtgtacgtctctggtacttcctaccttnaattatgtatagcagtcggaccgtcggggtccgccgacggtccgtaccggtgggggaacggggtcgttggggtaagggttcgggtctacgtagttcgttaggttacggggtaagtttaggtttacggttttagtttaactaacgtaatttagtttaaggtagggacggtcggggtacgggggtcggggggtaccctaagtttacccgaacctacggttacccctaacgaacgggaaccgaaaccgtaaccgaaccgaaaacgtaaaccaacctaacgttaattactaccgttagaaacctaaagtaccggtaaacctacgtacgtacggaagacgggaccgaagggacccgacggttctacgttaccttattacgtggtaccgagtaacgggtcggtatactaagtagtcgttaagg

SEQ ID NO: 189686 - DNA, 863 bp, Homo sapiens
  misc_feature: GYAE6OF01B8QCU.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcacatggaactgggctcgtctgggtttccttgttgtctttttagaaggtgtccagtgtgaggtgcagtcgtgggtggtaggtcggtggggggacggtccgtgggtaccgaacggtccgtacgggaacgacggttcccgtaggtaacggtaccttccgttccgttaggttggttaccgtaccgttcgttacgggtaactttaccgtaacctttactaaattacttaggtaagtaacgtactacgtaccggtaaccggttcggggtaccccgaccggtaccgggtccgtccgggttaagggggacggggtcgttaggggtacggttccgggttactaccgtaagttaccgttaagtttacggggtaaaggttttaggtttacggtttttaagtttaacgttaacgttaaagtttaacggtttaaggtaggggtaacggtacggggtcggggggtaccggggggtacctaccggtttaccaccgttactacccgtaccggaacggtaacgaaaccgtaaccggaaaccgaaaccggtaacgacgtttaacgttacgttttacgagtaacgaaagtaacggaacgtacggtaccgtacggacggtaacggaccggaacggtccgaacggttcgttaggttaggttaccttaggtacggtagggtacgaaggggtacggtaacggggaccggtaaccggttacccggggttccccgggtttacccgggtttaacgggg

SEQ ID NO: 189687 - DNA, 605 bp, Homo sapiens
  misc_feature: GYAE6OF01B42TX.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtcttttttagaaggtgtccagtgtgaggtgcagctggtggagtcgtgggggagcctggtcaagcctggagacgtccctgagactctcctgtgtagcctctggattcaccttcaattatgtatagcatcgaccgtgggtcccgccgaggcctccgtggggaaggggctgggagtgggtctcgatctagttggaagttagttgtttagtttatactattatttagtgggagacgggcggggtcggggggccgtagtttccacctatcctccgagacgaccgaaccgaccgaagaaccgctaagttactttcagacaaagtacgaacgacgtcctaggacgaacgacggacggaccgacggcgtaggttagttacttacgtggtcggcggaggtaggtgggacgggacggtacgggttccccggttcccccgggtttagg

SEQ ID NO: 189688 - DNA, 767 bp, Homo sapiens
  misc_feature: GYAE6OF01ED2C3.35.36.D03.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (430)..(430): a, c, t, g, unknown or other
  misc_feature (430)..(430): n is a, c, g, or t
  modified_base (449)..(449): a, c, t, g, unknown or other
  misc_feature (449)..(449): n is a, c, g, or t
tcagtacagatcgtcacgaccggtgctcgatttagctgcgtcacgatctctcttggggtctgagagaggagccttagccctggattccaaggcctatccacttggtgatcagcactgatcaccgaggattcaccatggaacgtggggctccgtcttgggttttccttgttgtcttttttagaaggttgtccagtgtgagggtncagtcgtgggtggacggtcggtagggggcgtccgtggtcaagccgtaggacgcgtcctggacgtctctccgtgtctagcctagtcggatttcccaccttactaatctagtanacgctaagtcggtaccggtcgggtcccgccggcggtccttccgggaggggaccgggtgtagggtaggtcggtctcagttcgttaaggttggaagttggtttacgttttagtttanaacttaagttacgttaggngggtacgacgggggtccgggggtcgggggtacctactttaccgacttaacgttcccgtaccgaagaacgaaccctaacggaacccgaaaggaccgttacgtaagttttaccttacgtacggtaaacctaaagtaccgtaaaacgccggttacccggttaggaaccgggtaaggaacccgggtaacggtaccggtaccgggttacgtggtttaacgttacggtttacgagggttaccggacgggtaaggaagggttccggggacggggttacccggttaacccggggtttcccccggggtttcccccggggtttaaggg

SEQ ID NO: 189689 - DNA, 829 bp, Homo sapiens
  misc_feature: GYAE6OF01DDIAG.35.36.D03.1.454.CMB.1.raw
  modified_base (176)..(176): a, c, t, g, unknown or other
  misc_feature (176)..(176): n is a, c, g, or t
tcagtacagatcgtcacgaccggtgctcgatttagctgcgtcacgatctctcttggggcagagctcgtggggagactgctcagttaggacccagacggaaccatggaacgccccagcgcagcttctcttcctcctgctactcgtggcctccgaggaacccacgtggaagaaaaccnggtagaacgtcgacgcgtacgtcctaccgacgccagtccgtgtctgttactccgtaccggaggggacacgaccgtcccctaccgtccgtccgtaggccgacgggcctagtctaacgtacttacgttaccgaccttaacgtccgccgtagtactacgagaccgaacgtaaccgtggtaaccgacgtccctaccggtacgtccctacctactacttacgttcggtagtaccaccgtaaccaccgacccggtacggtaccctacgttccggtactacccccggtagtccgtaccggttagcgggtacggcggttacgggttacggtcggtaacggggtacgtaggttcccttaacccgtccttaccgaaacccgttaccgacctcggaaccgtcgtaacccgtaccgtagtacctttacggtacttaccgttagttacttttacggtttacgttagttttaacctttggtttaaccgtaggtttaaccgaagttaaccgtttaaaagtttacaaccgggttaacggttccccgttaacggttaccccggtaacggtttttaccgggtacccgggttttacccgtttaaacgggtttaacccgggggccccggtaaacccgggggttaaacccgaggttcccccggggttaaaaggg

SEQ ID NO: 189690 - DNA, 694 bp, Homo sapiens
  misc_feature: GYAE6OF01A9RNE.35.36.D03.1.454.CMB.1.raw
  modified_base (157)..(157): a, c, t, g, unknown or other
  misc_feature (157)..(157): n is a, c, g, or t
  modified_base (168)..(168): a, c, t, g, unknown or other
  misc_feature (168)..(168): n is a, c, g, or t
  modified_base (216)..(216): a, c, t, g, unknown or other
  misc_feature (216)..(216): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgagaaccncgtggagaacngtgatgacgcagtcctccagccatcctgtctgtcgtctccgagggganagacgcccacctctcctgcgagggccagtcagtactagttacgacctaacgttagcctaggtactcgacgtaccgaaacgtaacccgttggtacgacggtcctacccgacggcccttacgtcaacttcgtaagtcggtacgactacgtcccaaccggtacggaccctacggttacggtacctccccgaggtacccgtaggttactacgggtcgggacctagggtcgggtacgtacgggaacgtagggttaccgtacctaccgttccgtacccacctagtaccgacgaccacgtcctagcgttaacgttcgtagtacgttacgttacgtttacgttacgttaaggtttttacttcggttattaccgacgttactaatttacgtagtaacttaccggtcgttacccgttaccgggtttgaccgggttacccgacggtaacggtaaccggtaagggtacgggtaacgtaccggtaaaccgg

SEQ ID NO: 189691 - DNA, 748 bp, Homo sapiens
  misc_feature: GYAE6OF01CDRFS.35.36.D03.1.454.CMB.1.raw
  modified_base (161)..(161): a, c, t, g, unknown or other
  misc_feature (161)..(161): n is a, c, g, or t
  modified_base (166)..(166): a, c, t, g, unknown or other
  misc_feature (166)..(166): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctctgctactctggctccgagaccagtgganaaacngtgatgacgcagtctaccagccatccgtgtcctgtcgtcgaccggagggganagccgcccaccctgtccngcgacggcagtcagacttatacgtacctaacgtcgccgttagtactacacgacaacgtaaccgtggtaccgacggtccctacccgtacggtacccttaccgtactacttacgttagtcggacgtcctacgtaccccaaccggacggtacccgtaacgtcggtaacctcccgtaacggtaccgttacggtacggaggtcggacgtagggttccgggtcgtacgggaacctaggttaccgtccgtaacctccgtacccaacgcgtacgacgtcgacgtccgtaggacctacggttcgtaaggttacttacggttttacgtttacggttaaccgttttaacggttttaaccgtttcggtttaactagttacgttacttaacgggtttactaaaccgggttaacccgttacggtcccgggtttaccgttacgggttacggttaacccggtttacccgggaaccggaaacggggtttcccggaaagggttacccggtaaacgtaacccggtaaacgg

SEQ ID NO: 189692 - DNA, 857 bp, Homo sapiens
  misc_feature: GYAE6OF01B3N6A.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcttgggttttccttgttgtcttttttagaaggtgtccagtgtgaggtgcagcgtggtggagtcgtgggggaggccgtggtcaaggcccgtagggacgacgttccctaggacgacctccttccgtggtacgccaggtccgttcgtcggtactttccgtaaccctttcgtaaggttagttagtgggactagtcggcctacggttcggggtcccgacccgaggtccctaccggaaggggtaccgaaggggggtccttagggggagtggggggtggtaccgtaagttttaagtagttggggttaatggaagttaggggaaacttaccgaaagttaaaacgaccgttagtacggaacgtacggtaacccgtaccggtaacgggtaaccggggtacccgtaactttaccccgaaccttaaacgttcccgtaaccgaacggtaaacggtaaccccttaaacgttaaccccgtaaaacgggtaaacccctaaccggttaacccgtttaaggtttaacgttacccgttaaaccgggtaaaccgttaaaaacgttaaccggaaaccccgtaacggtacccgttaacgggaaaccgggtaaccccggaaccccgggtaaacccggaacccgggtacccgggtacggtttacggttacggtttaaaccgtttacggtacgggttacggaaccggtaaaccggtaaacgtaaaccgggg

SEQ ID NO: 189693 - DNA, 891 bp, Homo sapiens
  misc_feature: GYAE6OF01DM71Q.35.36.D03.1.454.CMB.1.raw
  modified_base (162)..(162): a, c, t, g, unknown or other
  misc_feature (162)..(162): n is a, c, g, or t
  modified_base (167)..(167): a, c, t, g, unknown or other
  misc_feature (167)..(167): n is a, c, g, or t
  modified_base (217)..(217): a, c, t, g, unknown or other
  misc_feature (217)..(217): n is a, c, g, or t
tcagtacagatcgttcacgaccggtgctcgatttagctgcgtcacgatctctcttggggcagagctctggggagaactgctcagttaggacccagacggaaccatggaagccccagcgcagcttctcttcctcctgctactctggctccgagaccatggaanaaacngtgatcgacgcagtcctcacgccatcctgtctgtcgtcgtccgagggganacgacgccctaccctctcctggcgacgggccagtcgaagtacttagttacgtaacctaaacgttcgccgttaggtactacgagactaacggtaaccgtggtaccacggtccctaccgaggtccctacctatacgttcgttaagtcgggtactaccgtacccgtacccgaaccggtaccggacccttaacggttacggtacccgtacccgtaaggtaccccggtaggttttaccggaacgggttccgggacggttaacggggtttcggggttaacccgggtagggggtaaacccgttaaacggggttaccccggttttaaccctacccggttacccgtaacccttaacccggtaacgttacccgggaaccggtacccgtaacccggttccccgttacggtaacccgtttaaccgggttttgtttacggttaccgttttaagggttttaaccgtttttccggttaaacggtttttaactttttaacggtttaccgtttaacgttacgtacgtttaactttaaagtttaccgtaaacggttaaccggtttaccgggttcccggtttaaccccgggtttacgggtacccgggttaaccgggttaaccggaaaccccgggttaacgggggtaaaccggttaacggggtttaccggaaaccggttacccccgtaaagggg

SEQ ID NO: 189694 - DNA, 836 bp, Homo sapiens
  misc_feature: GYAE6OF01BYKGH.35.36.D03.1.454.CMB.1.raw
  modified_base (158)..(158): a, c, t, g, unknown or other
  misc_feature (158)..(158): n is a, c, g, or t
  modified_base (223)..(223): a, c, t, g, unknown or other
  misc_feature (223)..(223): n is a, c, g, or t
tcagtacagatcgtcacgaccggtgctcgatttagctgcgtcacgatctctcttggggggagaggaactgctcagttaggacccagacggaaccatggaagccccagcgcagctttctcttcctcctgctactctggctcgagaaccatggaagaacngtgatgacgcagtcctaccacgccctaattcccgttgtcgttgtcgttcctaccggaaggggganaacggacgtcccctaacccgttctccgtgacgacgggccagtacagtactatacgtacctattacgctagtactacacgacgaaacgaaccgtggtaccaacggtcctacccggtacgcccttacctcgtaacgttttcgttttgggtactccggtacccgtacgtacggggccttcgttcggtcgtacccgtaggtacgtaggttcagggtcggactacgggtcgaccgtacggggtagggtacgtaacggttcgtttaacctccgtaccgtacctaaccgtaacgccgtaacgtaccttaccggtccgttacggccttaaacggttccgtaaaggttaacggtttacgttttacgggtacgtttttaaaacgtttttacctttacggtacgttaaacgtaacgttaaacgtaaaactttaaacgttaacggttaacccgtacgttacccggtttaccggtaacccgggttttacgttaccggttaacccgttttaaccggggtttaccggggaaacccggtaaaccggggtttaaacccgaacggtttaaccggacgggtaaaacgtaaccggtaaacccggtaaaaacgttacgggttaaccgtaacggg

SEQ ID NO: 189695 - DNA, 913 bp, Homo sapiens
  misc_feature: GYAE6OF01C61RP.35.36.D03.1.454.CMB.1.raw
tcagtacagatcgtcacgaccggtgctcgatttagctgcgtcacgatctctcttggggtctgagagaggagccttagccctggattccaagcctatccacttggtgatcagcactgagcacgagattcaccagtggacgtgggcctccgtcgttcgggttttcctttgtttgttcgtttttttaaggaaggttcgtaccgtaggttggtaggtagggttcgactaggtcgttggggtcgggtacggttcgggtaggggggacggtcccgttggggtaccaaacggtcccggttaggggaagtaccggtttcccccgttaggaaccggtacctttccgttccggttcggttacggttaccggtccccttggtttacggttacctttaccctaccctttataaatttagttagtaacttacgactacgttaccggttaccgtccggggtaccccgaccggtaccggtccgttacggggtacgggggtaacgggtcgtacgggtacgggttccgggttactacgttacggtttacgttaagggtttaaggggtaacgtttagggttttcgtttaacgttttaatacttaaagtttaagtttaacgggtagggtaaacggtacccgggggtacggggggttacgggggtacccttaacgttaacccgtacccctaacgttacccgttaccggaaacggaacccgtaaaccgaaccggttaacccgaaaacggtcccgttacggttaacgttttactttaaccggtagaaaccgttaaacgaccgaacgtaaccggtacccgagggaacggttaacggaacggtaggacccgtggtcgtttacggatttaccgtggtacggagcggtaagtcgggtggtacggcgggttacccggttccccggtttaccggggtacgg

SEQ ID NO: 189696 - DNA, 779 bp, Homo sapiens
  misc_feature: GYAE6OF01AXFOA.35.36.D03.1.454.CMB.1.raw
  modified_base (170)..(170): a, c, t, g, unknown or other
  misc_feature (170)..(170): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (374)..(374): a, c, t, g, unknown or other
  misc_feature (374)..(374): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctctgctactctggctccgaggaaccacgtggaagaaacngtgatcgacgcagtcctccagccatccgtgtctggtntcctacgagggganagcgacccacccttctccgtgcgacgggtccagtacagtactactttaacgtaacccgaactttacggccttaggtactacgacgtaccaaacgtaaccgttggtaccacggccttaccggacggtcctcctactaactcttaagtgggtacncctaacgtacccgaccggaacgggtccctaacggtcgggtaaccctacccgtaggtacccgtacggtttacgacgggtacggtaccgtaagggttccgggtcgttaggggaaccttacggttaaccttccgtaccgttccctaacccgaaccttacgaccgaagccgtacgtccgtactacggttaacgtccgtaacggttacgtttagtttccgtaacgtttttacgtttaactttacggttacgtaaccgtaaacgtaacttaaccggtttaaataccggttacgttaccggtacccggttcccgttaacggttaaccggtttcgtttacccggtttaacgggttacccggtaacccgggggtaaacggtaccgaaccggttggggttaaacccggtaaacgg

SEQ ID NO: 189697 - DNA, 810 bp, Homo sapiens
  misc_feature: GYAE6OF01BW6DV.35.36.D03.1.454.CMB.1.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
tcagtacagatcgtcacgaccggtgctcgatttagctgcgtcacgatctctcttggggtctgagagaggagccttagccctggattccaaggcctatccacttggtgatcagcactgagccaccggagattccaccagtggaactggggctccgcgttgggttttccttgttgtntttttagaggtgtccagtgtgagtgcngngtggtggagtggtggggagtccgtggtcagccgtggacgacgtcctgacgtcctcgtcctggtcgtacgtccgtcgtggtacttcctaccttacaattatagttactagccgtagtaccggtaccggttccgggtcccgccggtaccggtccggtccgggtaggggaaggggtcggtggggtagggttcgggttcctagttacgttacgtttaaggttaagggtaacggtttaggttttaggtttttacggttttaattaaacgttaagtttaagtttagggttaaggggtaacgggtaccgggggttcgggggggttaccggggggttacccttacggtttacccgtaaccccgtaaccgtttccccgtaaccggaaccggaacgtaaaccccgaaacccggaacccgtaaacgaacggtactaacgtttactttacgtacgaacgtaaacgtaacgaaccgcgtaccgtaggacgaacgggacgtaccgggccgtacggtcgtaggttacgtttacgttaggttcggtagagggtaggacgggttaggggacgggttaccgggttcccgggggttcccccccgggtttccgggtttaaccgggg

SEQ ID NO: 189698 - DNA, 762 bp, Homo sapiens
  misc_feature: GYAE6OF01AVFH4.35.36.D03.1.454.CMB.1.raw
  modified_base (690)..(690): a, c, t, g, unknown or other
  misc_feature (690)..(690): n is a, c, g, or t
  modified_base (706)..(706): a, c, t, g, unknown or other
  misc_feature (706)..(706): n is a, c, g, or t
  modified_base (752)..(752): a, c, t, g, unknown or other
  misc_feature (752)..(752): n is a, c, g, or t
tcagtacagatcgtcacgaccggtgctcgatttagctgcgtcacgatctctcttggggcagagctcgtggggagaactgctcagttaggacccagacggaaccatggaacgccccagccgtcagcttctcttcctctgctactctggctccgagaccacgtggagaaactgtgatgacgcagtcctaccacgcctattccgtggtctggttcgtccgtaccggaagggggactacggaccgtccccgtaccccgttcctaccgttgggaccgtaccggggtccaaggtcctaagggtacggttacgttacgactaacggaaccttaaaccgtttacgcccggtttacgaacccgaagggtactaaacgggtaaacggtttccgggaaaccgtccggtacccgttacccggaacggtccccgttacccgttacgtacgttttccggttttaggtccggtcggttaaccccgtacgggttaccggggccccgttggttacgggttaccctaacccggtaggtttacccgtacggggtttacccaggggtttccgtaaacgtcggtttggtcccgttgggtaacggggacttaaggtaccgttcctaacgtccgtactaaaccgtctaccgaggccacggtccgacgtacgtccgttatacggtattacgtttcgatttacgtacttacgttnacggtatacaaagttnaacgtcgtcgacgtcgtacgtgtctcgtacgttcggaacaggtacngtgtcggtac

SEQ ID NO: 189699 - DNA, 720 bp, Homo sapiens
  misc_feature: GYAE6OF01AV6KA.35.36.D03.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
tcagtacagatcgtcacgaccggtgctcgatttagctgcgtcacgatctctcgttggggcagagctcgtgggggagaactgctcagttacggacccagacggaaccatggaacgccccagcgcagtcttctcttcctcctgctactctggctccgagaccacgtggaanaacngtgatcgacgcagtcctccagcctactccgtgtcgtgtcgtaccgtacggaggggacacgaccgcccctacccttccgtccgtggaccggacgggcctagtcacgtacttattaacgtacctaacgttacgtccgttaggtactacgacgaccgtaacgtaacgtcggtacacggccctacccgacggtcctcctactacgttacgtacggtcggtacgtaccaccgtacccgaccggtacggaccctacggtcgtaccctccgaccgtcgtacggtcgacggtcggacgtcggtcgggtacgacggacgtcggtactaccgcgtaccctaccacgtacgtacgaccgcgtacgtactcgacgtacgtcttggtaactttcggtttaattaccgttacgttttaagttacttacgtacggttacacgttaacttagtaacgtacgtaacgtttacgggtcccgttaccggtacggggtccgtacccggggtaccaaacggggtaccggtaagggtaaccgttaacggtacccgtaacggtaacccgg

SEQ ID NO: 189700 - DNA, 689 bp, Homo sapiens
  misc_feature: GYAE6OF01BBKXT.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctggttttccttgttgtctttttagaaggtgtccagtgtgaggtgcagcgtgggtggagtcgtgggggagcctggtcaagccgtggacgtacgtccctgacgtacttcctcctgttgtacgtccttctggtactttcctaaccttactaaattattagtatacgctagtcggaccgttggggtccccgccgacggtccgttccggagggggaacggggtcgtagggtaggttggggttcctactaacttcgttagttagggtaagtttaggttgttttagtttaatacgtaatttagttagtggtacggacgggtcgggggtcgggggacctagttaccgaaccgtactccgtacgaagaacgacgaaccgacaaacgacgctagttattacgagtaactaagtacacgagtccgtagacgtaggacggaaggaccgtacggtcgttaggtacgttacgttacgtggtcggacggtaaggtacgggtacgggacgggtaccggttaccgggttccccgggttacccccgggtttaggg

SEQ ID NO: 189701 - DNA, 747 bp, Homo sapiens
  misc_feature: GYAE6OF01BR5L1.35.36.D03.1.454.CMB.1.raw
  modified_base (173)..(173): a, c, t, g, unknown or other
  misc_feature (173)..(173): n is a, c, g, or t
  modified_base (225)..(225): a, c, t, g, unknown or other
  misc_feature (225)..(225): n is a, c, g, or t
  modified_base (537)..(537): a, c, t, g, unknown or other
  misc_feature (537)..(537): n is a, c, g, or t
tcagtacagatcgtcacgaccggtgctcgatttagctgcgtcacgatcctctcttggggcagagctcgtggggaggaactgctcagttacggacccagacggaaccatggaagccccagcgctagcttctcttcctcctgctactctggctccgaggaaccactggagaaacngtgatgacgcagtcctaccagtccatcctgtctgtcgtcgtccggagggganacgacgacccctaccctctcctggccgagggcctagtacacgtacgttagttaacgtaacccgtaactttacgccttaggtaactcgacgtacaaacggtaacccgtggaccgacggtcccgtaccgacggtccttacctcgtaacttcgttagtacggtacacctaacctcccgaaccggtacggaccctaggttaccgtaccctccgacgtaccgtaggttaccagggtcgtcgtaaggggtccgggttacggacgggtaacgtacggtaccgttaccgtacccttacgtaccctaacgcgtaccggacncgtaccgtccgtacgtacctaggttcttaagtcgtttattaggttttaccgtaccttttaaaggttttataccgggttacttacgaaacgttcttaaaaacgttcttaaacgtaccgttccggtaaccgttaccgtacgggtttcgtaccgttaacccggtttacggttcccgggtaccgtaaaccgggttccaagggttccgtaacggg

SEQ ID NO: 189702 - DNA, 805 bp, Homo sapiens
  misc_feature: GYAE6OF01DKBHI.35.36.D03.1.454.CMB.1.raw
  modified_base (324)..(324): a, c, t, g, unknown or other
  misc_feature (324)..(324): n is a, c, g, or t
tcagtacagatcgtcacgaccggtgctcgatttagctgcgtcacgatctctcttggggtctgagagaggagccttagccctggattccaaggcctatccacttggtgatcagcactgagcacggaggattcacatggaactggggcctccgtcgttggttttccttgttgttcgtttttagaagtcgtcagtgtgagtgcagtcgtgggtgaggtcggtagggggacgtccgtggtaccaacggtccgtaggacgtacgtcccgtagaacgtctccgtacgtgtcgtacgtccgttgtacggtacttacctaccttataagttntaggtaatgacgtacggttcggacccggtcgggtcccgaccggacgttccggtacggggtaaggggtacgggtcggtacggtacggtcggtacctagttaacgtttacgttaaggttacggtaacgtttgttttacggtttaagttaacttaagtagtttacgttaggtacggggacggtccggggtagggggtccggggtaaccttacgttaccgtaacccgtagttacccgaacggtaacgaacgtaacccgtacccgggaacaaaaccggtacgtacgttaagtttccgttacgtaggtaaacctaagacgaaaccgccgttacgacgggtaacgaacggtaaccggacggtaccgtaggtccggtttaaagtcgttaaaccggtttaggtgggtacccggtaaggttagggacggtaacggggtacgggtccccgggttttaacccgggttacccccggggttacccgggtttaggg

SEQ ID NO: 189703 - DNA, 776 bp, Homo sapiens
  misc_feature: GYAE6OF01C1W27.35.36.D03.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgagattcaccatggaactgggctcgctggttttcttgttgtctttttagagtgtcngtgtgaggtncagcgtgggtaggagtcgtgggggacgcctggtacaagccgtggagacgtccctgacgtaccttctccttgtcgtagtcccttgttgtactttcctaaccgtttacaagttatgtaatgactagtcggaccgttcgggtcccgacgtacggtctccggtaggggagggtccgttggacggttggcttcagtttacgtaggttacgggaagttgtttggttttagtttaataactagtttaagttaggtgggtaggtaccgggtggggggtaccgggggtacctactttaccgaacctttaacgtcccttaaccgaaggaacgacccgtaaaccgaacccggaaaacgtaccggacttaagttttacgtttacgtaacggtaactaaacggttaaccgaaacgtaccgggtacccgtgggaacccggtaacgggaccggaagggtacccgtaaacgggtcgttaggttacggttaaacgttttacggacggttaccgggaaggtagggttacgggtaccggggtaacggggttcccgggttaaaccccggggtttccccccggggttttccccccggggtttaaaggg

SEQ ID NO: 189704 - DNA, 806 bp, Homo sapiens
  misc_feature: GYAE6OF01C91SL.35.36.D03.1.454.CMB.1.raw
  modified_base (154)..(154): a, c, t, g, unknown or other
  misc_feature (154)..(154): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
tcagtacagatcgtcacgaccggtgctcgatttagctgcgtcacgatctctcttggggtctgagagaggacgccttagccctggattaccaaggcctatccacttggtgatcagcactgagcaccggagattcaccatggaactggggctccgngttgggttttcctgttgtctttttagaaggtgtcagtgtggaggtncancgtgggtggagttcgngggggggacgtccgttgggtacaaaggcccgttagggaacgtacggttccccgtaggaacgtaccttcctaccggttggtacgtaaccggtcccttggtacggtaacttttaccaacctttanaaatttnttaggtaatacgaactaagtcgtaacccggtcggggtaccccaccgtagggccgttaccgggagggggtaagggcttgggaacgggttcgtactactagttacgttagtaacggtaagttggttacgttttaaggttataacgtatttagtacgtagggacgtacgggtcgggggtacggggtaccgtactttaccgactaagttccgtacgaaggaacgtaccgaacgtaaccgaaagaacggtctaagtttatttaccgaagtaactaaacgtacgaaaccgtacgtccgtaggaaaccggtaggaaccgggaacgggtaaacccggtaacgtccggttagttacggttaaacgtttaacggtcgggttaagggaacccggtaaggtaaccgggtagggaaacccgggtgttaaaccccggggttcccccgggttttacccccgggtttaaaggg

SEQ ID NO: 189705 - DNA, 808 bp, Homo sapiens
  misc_feature: GYAE6OF01CAE3H.35.36.D03.1.454.CMB.1.raw
  modified_base (752)..(752): a, c, t, g, unknown or other
  misc_feature (752)..(752): n is a, c, g, or t
tcagtacagatcgtcacgaccggtgctcgatttagctgcgtcacgagtctctcttggggtctgagagaggagccttagccctggattccaaggcctatccacttggtgatcagcactgagcacgaggattcacatggaactgggctccgtcttgggttttccttgttgtctttttagaagtgtcagtgtgaggtgcgagtcgtggtggagtcggtgggggaggcccgttggtacgaacgccgttggacgtacgtccctagacgtacttcgtccgtgtcgtacgtccttgtaggtaactttccaaccgtttacaaaagttacgttaggttaactaggtacctaagttacggacccggttaggggttaccccgacggtaacggtccgttacccggtagggggaacggggtctaggggtacggttacgggtactacgtaacgttacgttaaagtttacggggaaagtttaggtttaaccggttttaagttttaaataacgtaatttaagttttaaggagggttaaacggaccgggttcggggggttacggggggtaccccttaacgtttacccgaaccgttaacgttaccccgttaaccgaaggtaaccgaaccgaaccggaaaccgtaaaacggacggtaaacttaagtttaaccgtttcgtaacgtaacgtaaacgttaacggaaactaccgggcgttacgaacgggaacgacggtaacgggaccgtacggttcgtaggttagttacgttagnggttggacggagaggtcggacggtacgtcgggtttaccccggtcccgggtttacgg

SEQ ID NO: 189706 - DNA, 613 bp, Homo sapiens
  misc_feature: GYAE6OF01C3LJN.35.36.D03.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
  modified_base (602)..(602): a, c, t, g, unknown or other
  misc_feature (602)..(602): n is a, c, g, or t
tcagtacagatcgtcacgaccggtgctcgatttagctgcgtcacgatctctcgttggggcagagctcgtggggacgaactgctcgagttacggacccagaacggaaccagtggaacgccccagcgcagtcttctctcctactgacttacctcgtcggacctccggaagaaccctagtagggaaacaaataggtgatcgaaccgctagtccnccacgcctattccgtgtcgtgtacgtccgacgaggggganaagcnccctaccgtctcngaccgaggtccagcaagtactagtaacgtaccaacgttgctaggatcacgacaagttaacctggcacggtccaccgngtcttcacattccgagttggcaacgcttacccacgggacggccctttaagcggtaacccccgaaggcccttgggtttacagtccggatagggtgggtcgaaggagttgacgttccncttacncccaacttanccgaaacgccggcttaagcgttatccgtaattntntttgacctttntttaacggtngtaccaggnttaatggtnaccctatccggccttaagggcaggtccccgagaacggttacaggtaacgngtaaccagttg

SEQ ID NO: 189707 - DNA, 733 bp, Homo sapiens
  misc_feature: GYAE6OF01DDRIG.35.36.D03.1.454.CMB.1.raw
  modified_base (171)..(171): a, c, t, g, unknown or other
  misc_feature (171)..(171): n is a, c, g, or t
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
tcagtacagatcgtcacgaccggtgctcgatttagctgcgtcacgatctctcttggggcagagctctgggggaggaactgctcagttaggacccagacggaccatggaagccccagcgcagcttctcttcctcctgctactctggctccgaggaaccacgtggaagaaacngtgatgacgnagtctccagccatcctgtctgtgtctccggagggganacgacgccctaccctctccgtggccgacgggccagtcgagtacttaacttaacgaaccttaaccttacggcctaggtaacacgaaacgaacgtaaaccttcggacgacggccctaccgagtcccttcctactattccgtaagtttcggtacctacctacccgaaccgtcgggacctacgttacggtacctacccgacgtaccgtaggtacgaggttcgacgttagggtcgggtacgtacggggaacgtacgttacgttacccacgttacccacctaacccgtaatcgaaccggcgtaccggtcccttaggaccgtttacgtcgttaacggttagttccggttttattttacggtaacttttaggttttaacttccgtagtctaacgttcttaagtttgaacgttaacggtaccgttcgggtacccggttacggttaccgggtacggttaacccggaaccgggtaaacgggaacgtaacggggtaaacgtaacggtaacccgaagttacggtcggg

SEQ ID NO: 189708 - DNA, 755 bp, Homo sapiens
  misc_feature: GYAE6OF01ENBG7.35.36.D03.1.454.CMB.1.raw
  modified_base (160)..(160): a, c, t, g, unknown or other
  misc_feature (160)..(160): n is a, c, g, or t
  modified_base (168)..(168): a, c, t, g, unknown or other
  misc_feature (168)..(168): n is a, c, g, or t
  modified_base (173)..(173): a, c, t, g, unknown or other
  misc_feature (173)..(173): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (317)..(317): a, c, t, g, unknown or other
  misc_feature (317)..(317): n is a, c, g, or t
  modified_base (498)..(498): a, c, t, g, unknown or other
  misc_feature (498)..(498): n is a, c, g, or t
tcagtacagatcgtcacgaccggtgctcgatttagctgcgtcacgatctctcttggggcagagctcgtgggggaggaactgctcagttaggacccagacggaaccatggaagccccagcgcagcttctccttcctctgctactctggctccgaggaaccncgtggaanaaacngtgatcgacncagtcctcngccacttctgtctgtacgttcnccggaagggganacggcnccctaccgtcctccgtgcgacgggccaggtcacgtactagttacgtaacctacttcgcctagtactacgagaccaacgtaaccgnggtccgaggtccctacccgaggtccctctacgtacttacgtcggtcggtacacgtaccaaccgtaccggacgggtaccctacgggtacgttaccaccggtacgcggttacgtggtacggcggtacgacggttgggtccgtagtacggtaaccggttataccgtactcccgttacaaccgtntaccgagacctacggtcttacgcgttactgggtaattacgttcggtttacgttaccggtaacttttacggggttttaacttaaccggtcgtttaacggacttaaccggttttgtttaaccgtagtaacgtttaaccgggtcccggtttaacccgggtacgggtttaccgggcccgtttaaacccgggggaacccgggttaaaacgggaacggttaaccggggtaaaccggtttaacgggtaaacccgttaccggggg

SEQ ID NO: 189709 - DNA, 838 bp, Homo sapiens
  misc_feature: GYAE6OF01DGCAY.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcacatggactgggctccgctggtttccttgttgtctttttagaaggtgtcagtgtgaggtgcagtcgtaggtgggagtcggtagggggacgggtccgtggtacgaaagtcccgttagggaacgtacgtaccccgtaggaacgtaaccttccttaccgtgttacgtaagtcccgttcgttaggtaatttacctaccctttaccgtaaattataaggttataaggtacctaagttacggacccgtttaggggtccccgacgtaaccggggtcttaccccgggtaggggaaaccgggggtacttggggtaaggttccggggttactaccgtaactttacctaaggtttagggaaaggtttacggtttggttttagttttaataaccgtaatttaacgttttaaggtagggtaacggtaacggggtaccgggggtttacgggggggacccgttaagtttaccgaaccgtaattccccgttaaccgaacgtaaccggaaaccgtaaccggaaccgtaaaacggtaaaccggacttaaggttacttttaccgtaagtaacgtaaattaacgtaaccgacggtcccgtaaggaccgaaggtaccggaaggaaccgtacggacggttcgtaacgttattaacggtggtcgtacggtaaggaaggtagggtaacggaccgtaccgggttacccggtttacccccggggttttaacgg

SEQ ID NO: 189710 - DNA, 947 bp, Homo sapiens
  misc_feature: GYAE6OF01D6IZ0.35.36.D03.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
tcagtacagatcgtcacgaccggtgctcgatttagctgcgtcacgatctctcgttggggcagagctcgtgggggaggaactgctcagttaggacccagacggaaccagtggaacgccccagcgcagcttctcttcctctgctactctggctccgaggaaccagtggaanaaacngtgagtgacgcacgtcctccgacgccctagttccgtgttccgtggttcgttaccggtaccgggaagggggaacgacgtacccgaccccctaccccgttcccgtccgtacggccggaccgggacctacggtacgaacgttaacgtttaacgtttaaaccgtaacccgttaaacgtttaccggtaccgtttagggttaacacgtaacggaaccgtaaaacggttaacccggtcggtaaccggaccggtaccctcccggtacggtcccctttacctctaacgtttaccgtacggttccggtacgtaccctactaaccccggaccgggtaaccggtcccgttaaaccggttcgtaccctaccccgggtagtacccgggtaacggttaccggtcggttacgggtacggttaggggttccgggtacggtaacggggtaacgttacggttaacccgtttacctaccgtttacctaacccgtaaccgtacgttaccggaccgtacccgtaacggttacccggtaccgtacgttacgtaacggtttcgtaacgggttttaacgttttggtttaaccggtttaacgttttacgtttttaacgtttacgttagttaaccgtacggtaacttttaggttaacgttaccgttaacgttacccgggttccggttacccggttcccgggttaaacgggtaccgggttaaaccccggggtaacgggtaaacccggggttaaccggtaaaagggtacccggggttaaaacctaaccggggtaaaaccggg

SEQ ID NO: 189711 - DNA, 802 bp, Homo sapiens
  misc_feature: GYAE6OF01AL501.35.36.D03.1.454.CMB.1.raw
  modified_base (107)..(107): a, c, t, g, unknown or other
  misc_feature (107)..(107): n is a, c, g, or t
  modified_base (152)..(152): a, c, t, g, unknown or other
  misc_feature (152)..(152): n is a, c, g, or t
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
tcagtacagatcgtcacgaccggtgctcgatttagctgcgtcacgatctctcttggggtctgagagaggagccttagccctggattccaaggcctatccacttggtnatcagtcactgagcgaccgagacttccacatggaactgggctcgnttggtttctgttgtcttttagaggtntcagtgtgaggtgnacgngtggtcggagtcggtggggacgcctgggtacaaggccgtaggacgtacgtcccgtagacgtactcctcgtgtacgtacgtccttcgtacggtaactttcctaacctactaaagtagttagttaacgacggtcctaaagttccggaacccggttccgggggtacccctaccggtacgggtacccgttaccggggtaagggggtaacggggtccgttaggggacggtttccgggtactacgaacgtttacttaagggttaggtaaaggtttgtagttttaccggttaataacgttattaacgtttaaggacggtaacgggtaccgggtacgggggtacgggggtacctacggtttacccgaacgtacgttaccaacggtaacggtaaaccggaaccggtaaacctaaccggtaaaacggtaacccgtacgttaaacgtttacccgtttaagtaaaccgtaaacgttaaacgaacggttacccgacggtaacccgtttagggaaacccggttaggaacgtaacggacccgttaggtccttagggtaacttcgtagtggacgtaaggatacggaggtaccgaccggttcggtacccggttcccggtaagg

SEQ ID NO: 189712 - DNA, 757 bp, Homo sapiens
  misc_feature: GYAE6OF01EBKEA.35.36.D03.1.454.CMB.1.raw
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (415)..(415): a, c, t, g, unknown or other
  misc_feature (415)..(415): n is a, c, g, or t
tcagtacagatcgtcacgaccggtgctcgatttagctgcgtcacgatctctcgttggggtctgagagaggagccttagcccgtggacttccgaaggccttatccacgttggtgatcagcactgagcatacggagattcaaccatggaactgggctcgcttggtttctgtgtctttttagaggtntcagtgtgagtncngcgtggtggagtcggtagggggngtccgtaggtacaaggccgtaggacncgtacctggactaccgtnttccgtgtcgtacggtcctcgttaggtactttaccaacgtttacaagttatgtaataccgcagttacgaccggtcgggtaccaccgaggtcctacgggtagggaacgggtcgtgggtacggtggtacctcgaatttagtaagttaacggngtttagttcggttttataacttactaattagtttaacggggtaaacggcggggtacgggtacgggggtccctaacgttccgaacttattacgaaccgaaggaacccgaacgtaacccgaaccggaaacgtaacggtaacttaacgtttaccgtttaacgaggtaaacctaaagtaaccgaacgacgttacccgtacggaacggaacggaccggaaacgggttaaccggacggttccgttaggttaaacgtttacgttaaccggtaggttaccggaagggtaaagggtggtaaccgggttagaaaccgggttcccggggttaccccgggtttaacccccgggg

SEQ ID NO: 189713 - DNA, 846 bp, Homo sapiens
  misc_feature: GYAE6OF01BLBNL.35.36.D03.1.454.CMB.1.raw
  modified_base (401)..(401): a, c, t, g, unknown or other
  misc_feature (401)..(401): n is a, c, g, or t
tcagtacagatcgtcacgaccggtgctcgatttagctgcgtcacgatctctcttggggcagagctcgtggggaggaactgctcagttaggacccagacggaaccagtggaacgcccccagccgcacgtcttcctccttccctctgctacgtctggcctaccggaacggaaccctacgtagggaaacgaaaacaggtcgaatcggaaccgcgtacgtcctaccgacgtccctaagttcccgttcgttccgttggtccgttaccgtccgggaaggggacgacggacccgacccctaccccgtcctccgtcggacggaccgggccaggtccagtaacttataacggtaacctacttcggccgttaggtctacgagactaacgtaacgtggcgacgtcccgccgngtcctcctagtactcgtacgttggtactccgaacctaccccggaaccggtcggccttacggtacccgttacccgcgtacggtccgtaggtacgcggttcggacgacggggtttcgggtacgtacgggtacgtaacggttacctaccgtcttacccgtaaccgtaccgtcgtaaccgaccgacgaccgttaccggtcgtaccgttaggttaaccgttggttaaacgtttcgttttacggttaaccgttttaacggttaacggtttacccgtgtttaaacccggaattaccgttaaaagtttaacctaacgggttaccggtacccgggtttacccgttaccccgtagggtttacccgtttaccggtttacccggggtttacggttaaccccgggtaacggggttaacccgggttaaacggttcgggtacgggtaaaggtaaccccgg

SEQ ID NO: 189714 - DNA, 803 bp, Homo sapiens
  misc_feature: GYAE6OF01AJDRE.35.36.D03.1.454.CMB.1.raw
  modified_base (665)..(665): a, c, t, g, unknown or other
  misc_feature (665)..(665): n is a, c, g, or t
  modified_base (748)..(748): a, c, t, g, unknown or other
  misc_feature (748)..(748): n is a, c, g, or t
tcagtacagatcgtcacgaccggtgctcgatttagctgcgtcacgagtcgtctcttggggtctgagacgaggagccttagccctggattccaaggcctatccacttggtgatcagcactgagcaccgaggtatcaccatggaactggggctccgcgttgggtttccttgttgtctttttagaaggttgtccagtgtgaggtgcagcgtggtggaggtcgtgggggagtccgtggtacaagccgtaggacgtacgtcccgtaggacgtacctcgtaccgtggttcgtacgccgttcgtaggtacttaccgtaccttacaaattacgtcggttaataggctacgtacggtcccgttcggggtacccgtcggaacggtcccttcccgggggtagggggtaaaccgggggtccgttaaggggtcgggtttaccggggtacccttccgtaagtttacccgttaaggtttaggtaacgggtttagtttacggtttaagtttttaaccaacgtttaagtacgttaaggtgggacggtaacggggtcgggggtcgggggtacctaacgtttcccgacctacgttccctaaccggaacggaacgtaacccgaaccggaaccgaaacgacgtccgtaaatttcgtttacgtacgtaacgtaacgaagaaacccgngtaccccgttaggaaccggacggtaacggaacggtacgtaccggtcgtttacgtaagttaccgttagtcggacggtggggaanagggtacggtaacgggtacccggtaccggggttccccgttcccgggggtttaagg

SEQ ID NO: 189715 - DNA, 739 bp, Homo sapiens
  misc_feature: GYAE6OF01B03X5.35.36.D03.1.454.CMB.1.raw
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcgttgggttttcctgttgtctttttagaaggtgtccagtgtgagtgcagctggtggagtcggtggggagccgtggtacaagccgtgggaagtcgtccctgacgactccgtcctgtgtacgtcctcgtaggtactttccaccgtttanaacgttatgttagtaacgctacgtacgacccggttcgggtccnccgacggtcctccgggtaggggaacgggtctggggagttcgggtcctacgtagttccgttaaggtttacgggtaaaggtttggttaggttttagtttaataacgtagtttaagttaagtgggtaacggtacgggtccggggggtggggacctacggttccaccgtactccttacgaagtacgaaccgtaaccgacgaaaacgccgtacgtaggttttaacccttgagtaacaaagttacggaacctaacgggtccgaggaaaccggtcggaacggtaacgggccgtaaccgggtcgttaggttacgttaacggtttaccgtgggttcgaacggttaagggtccggtagggaccggtaccggttacccggggttcccccgggttacccgggtttaacgg

SEQ ID NO: 189716 - DNA, 552 bp, Homo sapiens
  misc_feature: GYAE6OF02G4WYF.35.36.D03.1.454.CMB.1.raw
  modified_base (314)..(314): a, c, t, g, unknown or other
  misc_feature (314)..(314): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccagggggagagagccaccctctcctgcagggccagtcagactattagaccaacttagcctggtatcagcagaaacctggtcaggctcccaggctcctcatctatggtncatccaccaggccactggtactcccagccaggtttcaggtcggctaggtcgggtcgtgggacaggtacgttcactctaccaacctatcagcacgcctgactagtcgtagacttgttacttttgacgtttagttttacttacgttgtactagtacttagttatagtaacttaacgtcggtaccttccggtggtaccgttcggaccgtaacgggacctagggtacggtacgtaccaacgg

SEQ ID NO: 189717 - DNA, 509 bp, Homo sapiens
  misc_feature: GYAE6OF02H7PX5.35.36.D03.1.454.CMB.1.raw
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccaggggganagagccaccctctcctgcagggccagtcagactattagtaccaattagcctggtatcagcaagaaacctggtacaggcctcccaggcctcctcatctanggtncatccacaggccatggatcccagccaggttcagtggcaggtgggtctgggacaggtagttcactctcacactcagcacgcctgcagtctgatgtatttgctagtttattactgtcagctattatgtatactggtccctcggtacggtacgttcggaccgaagggaccgtaagggtacggaacgtacaacgg

SEQ ID NO: 189718 - DNA, 519 bp, Homo sapiens
  misc_feature: GYAE6OF02IMCJV.35.36.D03.1.454.CMB.1.raw
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcagaaacctggtcaggctcccaggctcctcatctatggtncatccacaggccactggtactcccagccaggttcagtggcaggtgggtctgggacaggtagttcactctcaccatcagcagcctgcagtctgatgtattttgcttagtttattactgtcagtctattatgtataacgtcggtcccttccggtggtaccgttcggaccgtaacgggaccgtaagggtcggtaacggtacctaacgg

SEQ ID NO: 189719 - DNA, 533 bp, Homo sapiens
  misc_feature: GYAE6OF02IHJ73.35.36.D03.1.454.CMB.1.raw
  modified_base (279)..(279): a, c, t, g, unknown or other
  misc_feature (279)..(279): n is a, c, g, or t
  modified_base (494)..(494): a, c, t, g, unknown or other
  misc_feature (494)..(494): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctgggagagtccctgagactctcctgtgtagcctctggattcaccttnaatatgtatagcatgacctgggtccgccaggctccgtggggaaggggctgggagtgggtctcatctattggaagtagtgtttgtttatactattattatggagacggcgggtgggggccgattcaccatctccagagacaacgaccaaagaacgcaagttattctagacaaatgaaacagcctagcgaagacgaggacacggctggtgtattacngtagcgagagtggagggcgaggtcccggtccccggttag

SEQ ID NO: 189720 - DNA, 509 bp, Homo sapiens
  misc_feature: GYAE6OF02JAWBN.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccgccaggctcctgggaaggggctgggagtgggtctcatctattggagtagtgttgttatacatattatggagacgcggtgggggccgattcaccatctccagagacaacgccaagaacgacagtattctgcaaatagaacagcctgcgagacgagacgacgctgtgtattactgtgcgagagtgaggcgacggtcgtccccggttag

SEQ ID NO: 189721 - DNA, 515 bp, Homo sapiens
  misc_feature: GYAE6OF02H4DRJ.35.36.D03.1.454.CMB.1.raw
  modified_base (213)..(213): a, c, t, g, unknown or other
  misc_feature (213)..(213): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctcagggganagagccacctctcctgcagggccagtcagactattagtaccaacttagcctggtatcagcagaacctggtcaggctccaggctcctnatctttggngtgtccatagggccnctggtncccagtcaggttcaggtggctagtggctgtgggacagagttcactctcacatcagcagcctgcagtctgatgtatttgactagtttattctgtcagtcagttatagtattacgtcggtccttccggttggaccggtttcggaccgaacgggaccgtaagggtacggtaagtcccgaaacgtaacg

SEQ ID NO: 189722 - DNA, 529 bp, Homo sapiens
  misc_feature: GYAE6OF02IQPHC.35.36.D03.1.454.CMB.1.raw
  modified_base (169)..(169): a, c, t, g, unknown or other
  misc_feature (169)..(169): n is a, c, g, or t
  modified_base (216)..(216): a, c, t, g, unknown or other
  misc_feature (216)..(216): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagagcccaccctctcctgcagggccagtcagactattagtaccaacttagcctggtatcagcagaaacctggtcaggctcccgaggctcctcatctatggtgcatccaccagggccactggtactcccagccaggttcagtgcagtgggtctgggacagagttcactctcaccatcagcagcctgcagtctgatgtattttgctagtttattacgtgttcagtctattatgtaattacgtggtccttcggtacggtaccgtttcggaccgtaacgggtacccgtaagggtacggtaacggtacccgtaaacgg

SEQ ID NO: 189723 - DNA, 533 bp, Homo sapiens
  misc_feature: GYAE6OF02F6BUF.35.36.D03.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcaagaacctggtcaggctcccaggctcctcatctatggtncatccaccagggccactggtactcccagccaggttcaggtggcaggtcgggtctgggacagtagttcactctcaccatcagcacgcctgctagtctgattgtatttgcttagtttattacttgtcagtctattatagtattaacgtcggtacccttcggtacggtaccgttacggaccgtaacgggtaccgaagggtacggaacgtaccgtaaaccgg

SEQ ID NO: 189724 - DNA, 660 bp, Homo sapiens
  misc_feature: GYAE6OF02II74C.35.36.D03.1.454.CMB.1.raw
  modified_base (169)..(169): a, c, t, g, unknown or other
  misc_feature (169)..(169): n is a, c, g, or t
  modified_base (214)..(214): a, c, t, g, unknown or other
  misc_feature (214)..(214): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctcgagggganagacgccaccctctccgtgcgagggccagtcaagtactattacgtaaccaacgttacgccttagggtaatcgaagcaaacgtaaaccgtggtaccaaggtcctcccgaaggtcctcctcaacttctaagtggttcacctacgttcccaaccggacgggtaccctaacgttcgggtaacctccccgaaggtcccgtaagggttccaaggttcgggacctagggttcgggtccgtacggggacgtaggtacgttccgacgtctacgaacctatcgacggcaacgtccgtagcgtaagtcgtagacttgttattttacgacgtttagtttacttacgttgtactacgtcctaattacgtacgtaacgttacgtcggtacccgttacgggtacggttaccggtacggaccggtaacgggtaaccgtaaggggtacgtacgtaccgaacgg

SEQ ID NO: 189725 - DNA, 690 bp, Homo sapiens
  misc_feature: GYAE6OF02IGT2H.35.36.D03.1.454.CMB.1.raw
  modified_base (312)..(312): a, c, t, g, unknown or other
  misc_feature (312)..(312): n is a, c, g, or t
tcagtacagatcgtcacgaccggtgctcgatttagctgcgtcacgatctctcttggggtctgagagaggagccttagccctggattccaaggcctatccacttggtgatcagcactgatcaccgaggattcaccatggaactggggctccgctgggttttccttgttgcttttttagaaggtgtccagtgtgaggtgcagctgggtggagtcgtgggggaggccgtgggtcaagcctgggagagtccctggagactctcctgtgtagcctctggattcaccttcaatatgtatagcatcgacctgggtcccnccaggctccgtggggaacgggctgggagttgggctgatctagttggaagtgttgtttggtttatacgtaatttaattagtcgggagtacgggtcggggtcggggggtccgtagtttccgaacgtacttctaccgaaggacgaaccaacggacccgaaaacggaaccgaccgtaaggttaacttttacgtacgtaacgtaaaagttacggaaaacacggtacccgtaggaccggaaacggaacggaacggaaccggaacgggcccgttaaggttcgggttaactttaaccggttaggtacgggtaccggaagggtacgggttaggacggggtaccggtacggggtttacccccgggttaccccccggggttttaacggg

SEQ ID NO: 189726 - DNA, 524 bp, Homo sapiens
  misc_feature: GYAE6OF02GGFRY.35.36.D03.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcagaacctggtcaggctcccaggctcctcatctatggtncatccaccaggccactggtactcccagccaggttcagtggcaggtgggtctgggacagagttcactctcaccatcagcagcctgcagtctgatgtattttgctagttttattacttgtcagtctattatgtataacgtcggtaccttccggtacggtaccgttcggacccgtaacgggtacccgtaagggtacggaacgtaccgtaaacgg

SEQ ID NO: 189727 - DNA, 536 bp, Homo sapiens
  misc_feature: GYAE6OF02ICDWH.35.36.D03.1.454.CMB.1.raw
  modified_base (169)..(169): a, c, t, g, unknown or other
  misc_feature (169)..(169): n is a, c, g, or t
  modified_base (216)..(216): a, c, t, g, unknown or other
  misc_feature (216)..(216): n is a, c, g, or t
  modified_base (308)..(308): a, c, t, g, unknown or other
  misc_feature (308)..(308): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagacgccaccctctcctgcagggccagtcagactattagtaccaacttagcctggtatcagcagaacctggtcaggcctcccaggcctcctnattctatggtgcatccaccgacgggcccagtcggtactccccagtcccagggttcagtggctaggtgggtctgggacagtagttcactctcaccatcacgcacgcctgcagtctgattgtattttgctagttttattcgttgtctagctattatgtattaacgtcgtccttcggtcggtaccgttcggaccgaacgggtaccgtaagggtcggtaacgtccgtaacgg

SEQ ID NO: 189728 - DNA, 519 bp, Homo sapiens
  misc_feature: GYAE6OF02HYIXJ.35.36.D03.1.454.CMB.1.raw
  modified_base (438)..(438): a, c, t, g, unknown or other
  misc_feature (438)..(438): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccgccaggctccgtgggaaggggctgggagtgggtctcatctattggaagttagtgttgtttatacattattatggagacgcgggtggggggccgagttcacatctccagagacaacgccaaagacgcagtatttcngacaaatgaacagcctgcgagacgagacacggctgtgtattactgtgcgagagtggagggcgaggtccgtcccgtaacggg

SEQ ID NO: 189729 - DNA, 542 bp, Homo sapiens
  misc_feature: GYAE6OF02GSOI1.35.36.D03.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
tcagtacagatcgtcacgaccggtgctcgatttagctgcgtcacgatctctcttggggggagaggaactgctcagttaggacccagacggaaccatggaagcccagcgcagcttctcttcctcctgctactctggctccgaggaaccactggagaaacagtgatgacgcagtctccagccatcctgtctgtgtctccaggggganagagcccaccctctcctgcagggccagtcagactattagtaccaacttagcctggtatcagcagaacctggtcaggctcccaggctcctcatctatggtcncatccaccgagggccacgtggtactcccagccaggttcagtggcaggtggtctgggacaggagttcactctcacatcagcacgctgctagtctagtaagtatttgctagtttattacttgtactagtactaattattaatacgtactcggtaccttccggtagttcgtacgttacgttttcggaccggtaacggggtacctaaggtcgtaggtacgtactacgaacgtacgtacgg

SEQ ID NO: 189730 - DNA, 616 bp, Homo sapiens
  misc_feature: GYAE6OF02JYEUE.35.36.D03.1.454.CMB.1.raw
  modified_base (202)..(202): a, c, t, g, unknown or other
  misc_feature (202)..(202): n is a, c, g, or t
tcagtacagatcgtcacgaccggtgctcgatttagctgcgtcacgatctctcttgggcagagctctgggaggaactgctcagttaggacccagacggaaccatggaagccccagcgcagcttctcttcctcctgctattctggctcccagatatcactggagaaatgtgactgacgtcagtctccaaccatctgtcctggtntcctccgaggggacagacgccaccctctcctgcagggcccagtcagagtgttagcagccaattacgcctggtaccagcagaagttcggaccaggcctcccgaggtcctcctcattctttggtgtgtccgacgtacggccgtcgtggtcgtcccgagtccgtaggttcaggtgctaggtggctcgtggacaggtagttcccgactcgtaccaccagtaccgagccgaacgtcccgtaggtcctaacgtcgtacgaagttcgttttacgacttaggttttaacttaccgttagggttcctaaggtacctaagttaaacttaggttaccgtacgttccggtaccgttccggtaaggttttcgccgtttaaccggtttcggaacccgttacggggaacccgtaggttccggtaacggg

SEQ ID NO: 189731 - DNA, 575 bp, Homo sapiens
  misc_feature: GYAE6OF02I9MXO.35.36.D03.1.454.CMB.1.raw
  modified_base (163)..(163): a, c, t, g, unknown or other
  misc_feature (163)..(163): n is a, c, g, or t
  modified_base (216)..(216): a, c, t, g, unknown or other
  misc_feature (216)..(216): n is a, c, g, or t
  modified_base (276)..(276): a, c, t, g, unknown or other
  misc_feature (276)..(276): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
tcagtacagatcgtcacgaccggtgctcgatttagctgcgtcacgatctctcttgggcagagctctggggaggaactgctcagttaggacccagacggaaccatggaagccccagcgcagcttctcttcctcctgctactctggctccgaggaaccactgganaaacagtgatgacgcagtctccagcccatcctgtctgtgtactccgagggganagagcccaccctctcctagccagggccagtccagactattagaccaacttagcctggtancagcagaaccttggcaggcctccaggctctcatctatggncatccacgaggccatggtacncccgagccaggttcagttcgctggtggctggacagagttcacgtctcacatcagtcagtcctgacacgtctagattcgtattttcgacgttagtttacttacgtgttacgacgtacttaagtttacgtacgtaagttacggtccggttaacccgttcggttaaccgggttaccgtttaccggtacccgggtaacggtacccggtaaacgggtcgggtaaccggtacccgtaaaccggg

SEQ ID NO: 189732 - DNA, 508 bp, Homo sapiens
  misc_feature: GYAE6OF02HEK65.35.36.D03.1.454.CMB.1.raw
tcagtacagatcgtcacgaccggtgctcgatttagctgcgtcacgatctctcttggggcagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtgtcgtccactagggcccgctggtcgtcccagtcaggttcagtggcaggtggctcgtgggacagagttcactctcacatcagcacgcctgcagtctagaagtatttgctagtttattacttgtcagtctaatataatagcgtggcctcggtagttcgcttacgtttcggaccgtacggggacctacggcgtacgg

SEQ ID NO: 189733 - DNA, 547 bp, Homo sapiens
  misc_feature: GYAE6OF02G4XU1.35.36.D03.1.454.CMB.1.raw
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactggagaaacagtgatgacgcagtctccagccatcctgtctgtgtctccgagggggagagacgcccaccctctcctgcgagggccagtcagactattagtaccaacttagcctggtatcagcagaacctggcaggctccaggcctcctcatctatggtgcatccaccgagggccacgtgtactccacgccaggttcagtgcaggtgggtctgggacagtacgttcgactctcaccatcagcacgctgcagtctagatgtattttcgctagttttacttacgtgtctacgtctatttacgtgtaacgttacgtcggtaccttccggtacggtaccggtttccggaccgtaacgggaccggtaagggtacggtacggtaccgtaaaccgg

SEQ ID NO: 189734 - DNA, 489 bp, Homo sapiens
  misc_feature: GYAE6OF02GS826.35.36.D03.1.454.CMB.1.raw
  modified_base (434)..(434): a, c, t, g, unknown or other
  misc_feature (434)..(434): n is a, c, g, or t
  modified_base (483)..(483): a, c, t, g, unknown or other
  misc_feature (483)..(483): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcagaaagttggccaggctcccaggctcctcatctttggtgtgtccacgtaggccgctggtgtcccagtcaggttcagtggcagtggctcgtgggacagagttcactctcaccatcagcacgcctgcagtctagaagtatttgtctagtttattactgtcancaatatatagctggcctcgagttcgctcgtttcggccgtagggactagngtacgg

SEQ ID NO: 189735 - DNA, 523 bp, Homo sapiens
  misc_feature: GYAE6OF02HLMEH.35.36.D03.1.454.CMB.1.raw
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (433)..(433): a, c, t, g, unknown or other
  misc_feature (433)..(433): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggaggcctggtcaagcctggagagtccctgagactctcctgtgtagcctctggattcaccttcaatatgtatagcatgacctgggtccncaggctctggggaaggctggagtggtctcatctattggaagtagtgttntttanactatattagtggagtacggngggtgggggcctattcacctatctccgagagacacgacaagacgcagtattcngacaatagaacagcctgacgagacggacgacacggctgtgtagttactggtgcgagagtggaggtcgacggtccggttccccggtttagg

SEQ ID NO: 189736 - DNA, 541 bp, Homo sapiens
  misc_feature: GYAE6OF02F89E8.35.36.D03.1.454.CMB.1.raw
  modified_base (485)..(485): a, c, t, g, unknown or other
  misc_feature (485)..(485): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggaggcctggtcaagcctggagagtccctgagactctcctgtgtagcctctggattcaccttcaatatgtatagcatgacctgggtcccgccaggcctccgtggggaaggggctgggagtgggtctcgatctagttggaagtagtgtttgttaatacattattatggagacggcggggtgggggccgagttcacctatctccagagacaacgaccaaagaacgcagttatttctagacaaagtgaacagcctgcgagacgagacacggntgtgtaattacgtgtgcgagagtggagggcgacgggtcccggtcccccggtttagg

SEQ ID NO: 189737 - DNA, 556 bp, Homo sapiens
  misc_feature: GYAE6OF02F1QP5.35.36.D03.1.454.CMB.1.raw
  modified_base (168)..(168): a, c, t, g, unknown or other
  misc_feature (168)..(168): n is a, c, g, or t
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
tcagtacagatcgtcacgaccggtgctcgatttagctgcgtcacgatctctcttgggtcagagctcttgggaggaactgctcagttaggacccagacggaaccatggaagccccagcgcagcttctcttcctctgctactctggctccgaggaaccactggagaaacngtgatgacgcagtctccagccatcctgtctgtgtctccgaggggganagagcccaccctctcctgcagggccagtcagactattagtaccaattagcctggtatcagcagaacctggtcaggctccgagctcctnatctatggtgcatccaccgaggcccacgtggtactcccgagcccgtaaggttcagtcggacgtaggttcggggtctaggggacaggagttcacgtctacacagtcagcagcctgctagtcagatgtattgacgttagtttacttactgttacacggtctaattactagtactaacgttcggtacccttcgggtacggtaccgttccggtaccggtaacgggaccgtaagggtacggtaacggacctaaaccgg

SEQ ID NO: 189738 - DNA, 531 bp, Homo sapiens
  misc_feature: GYAE6OF02GIRFY.35.36.D03.1.454.CMB.1.raw
  modified_base (433)..(433): a, c, t, g, unknown or other
  misc_feature (433)..(433): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccgccaggctcctggggaaggggctgggagtgggtctcatctattggaatagtgttgtttatacatattatggagacgcgggtgggggccgattcaccatctccagagacaacgcaagaacgcagtatttcngcaaatagaacagacctgacgagacgaggacacggcgtagtgtattacgttgtgcgagaggtggagggcgacggtcccggttcccccgggtttaacgg

SEQ ID NO: 189739 - DNA, 523 bp, Homo sapiens
  misc_feature: GYAE6OF02JGW7I.35.36.D03.1.454.CMB.1.raw
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggtttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccgccaggctcctgggaacggggctggagtgggtctcatctagttggaagtagtgttgtttagtactattattatggtagacggtcgggtagggggccgagttcgacatctccagagacacgccaagaacncgagtattctgacaatagacagacctgacgngacgagacacgctgtgtattactgtgcgagagtggaggcgacggtccggtccccggttagg

SEQ ID NO: 189740 - DNA, 573 bp, Homo sapiens
  misc_feature: GYAE6OF02J12X8.35.36.D03.1.454.CMB.1.raw
  modified_base (339)..(339): a, c, t, g, unknown or other
  misc_feature (339)..(339): n is a, c, g, or t
tcagtacagatcgtcacgaccggtgctcgatttagctgcgtcacgatctctcttggggcagagctctggggaggaactgctcagttaggacccagacggaaccatggaagcccgagcgcagcttcgtcttcctcctgctattctggctcccagatatcactggagaaatagtgatgacgcagtctccaaccactctgtctgtcgtctccgaggggacaggagccaccctctcctgcagggccagtcagagtgttagacagcaacttagcctggtaccagcagaagtcgaccaggctccaggcctcctcatctttggtcgtcgtccacgtagggcccgtntcgggtcgtcccagtcaaggttcaaggtcggctaggtcgggctacgtcgggtacgacgtagttctacgtctcctacctacttacagccgtacgtccgtgactacgtctaggtaacgtagtttacgtacgtagtttacgttacgttcgtacgtacgtactaatactatacgtacgtcggtaccgtccgtacgttcgtcgtacgtttcggaccgtacgggaccgtacgtcgtacgg

SEQ ID NO: 189741 - DNA, 541 bp, Homo sapiens
  misc_feature: GYAE6OF02HN4TW.35.36.D03.1.454.CMB.1.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagtacagatcgtcacgaccggtgctcgatttagctgcgtcacgatctctcttggggtctgagagaggagccttagccctggattccaaggcctatccacttggtgatcagcactgatcaccgaggattcaccatggaactggggctccgctgggttttcctgttgctttttagaggtgtccagtgtgaggtgcagctggtggagtcgtgggggagcctggtcaagcctggagagtccctgagactctcctgtgtagcctctggattcaccttnaatatgtatagcatgacctgggtccncaggctccgtgggaagggctggagtgggctnatctattggaagttagttgttgtttatactatattagnggagacggcgggtgggggcctagtcactatctacagacgacgaacgaccaagaacgcagttattctagtacaaagtgaacagcctgcgagacgaggacgacggcgtagtgttaagttactgtacgcgtagaggtggacggcggtacggttcccggttacccccgggttagg

SEQ ID NO: 189742 - DNA, 572 bp, Homo sapiens
  misc_feature: GYAE6OF02HVU81.35.36.D03.1.454.CMB.1.raw
  modified_base (216)..(216): a, c, t, g, unknown or other
  misc_feature (216)..(216): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaagggggnagacgcccaccctctcctgcagggccagtcagactattacgtaccaacttagcctggtatcagcaagaacctggtcaggcctccgaggcctcctcactctagtggtcgcatcccacgacgggcccaacgttcggtactcccgagccgtaaggttccaggtcggacaggttcgggtcgtagggacaggtagttcgtactctacacctatcacgcacgccgtagctagtctgattgtatttgacgttagtttacttacgttgtcagtactaattataagttacgtacgttcggtcccttacggtagttcgtacttacgttttacgggaccggtaacggggtaacctaggtcgtacggg

SEQ ID NO: 189743 - DNA, 561 bp, Homo sapiens
  misc_feature: GYAE6OF02GH7JB.35.36.D03.1.454.CMB.1.raw
  modified_base (217)..(217): a, c, t, g, unknown or other
  misc_feature (217)..(217): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggganagagccaccctctcctgcagggccagtcagactattagtaccaacttagcctggtatcagcagaacctggtcaggctcccaggcctcctcatctatggtgcatccaccgagggcccacgtggtactcccgagcccgaggttcaggtcggcaggttggggtctgggacaggtagttcactcctcaccactcagcacgcctgcagtctgattgtattttgacttagtttacttacgttgtcacgtactattatagtataacgtcggtaccgttccggttacggttaccggtttaccggaccggtaacgggaaccgtaacgggtacgggtaacggtacccgtaacgg

SEQ ID NO: 189744 - DNA, 566 bp, Homo sapiens
  misc_feature: GYAE6OF02I35EO.35.36.D03.1.454.CMB.1.raw
  modified_base (214)..(214): a, c, t, g, unknown or other
  misc_feature (214)..(214): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggnagagccaccctctcctgcagggccagtcagactattagtaccaacttagcctggtatcagcagaacctggtcaggcctccaggctcctnactctagtggtncactccaccgacgggcccacgtcggtaactccccgaggccctaaggttcaggtcggctaggtcggggtctaggggacaggtagttcactcgtccactactcgacgccacgtccgtgaccgtcgttcgtacgtagttgttaacttttcgacgttagttttacttacgttcgttactagtactagttatagtactaacgtcgtccgtcggtcgtacggtcgaccgacggaccgaggtcgtacgtacgtaacgg

SEQ ID NO: 189745 - DNA, 667 bp, Homo sapiens
  misc_feature: GYAE6OF02JN38L.35.36.D03.1.454.CMB.1.raw
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (362)..(362): a, c, t, g, unknown or other
  misc_feature (362)..(362): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgctttttagaaggtgtccagtgtgaggtgcagctggtggagtcgtgggggaggcctggtcaagcctggagagtccctgagactctcctgtgtagcctctggattcatcttcaatatgtatagcatgacctgggtccnccaggctcgtgggagggctggagtgggtcncatctagtggaagttagtgttagtttanacgtattagttagtgggagacggcggggtgggggaccgtagttccgaccgtagtccgtaccgaagtaacgaactaaaccgaccgaaaacggaaccggtacctaaaggtttacttttaccgttagtaacctaaaaagttcggaaaaccgacgtacccgttacggacggaaacggaacgggaacgggaccgtaacgggccgttacggtacggttaaatttaccggtaagttacgggtaccggtaaggtagggtacgggaacgggggtacctaccgggggttacccccgggttttaacccccccgggg

SEQ ID NO: 189746 - DNA, 548 bp, Homo sapiens
  misc_feature: GYAE6OF02FRFRK.35.36.D03.1.454.CMB.1.raw
  modified_base (304)..(304): a, c, t, g, unknown or other
  misc_feature (304)..(304): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccnccaggctcctggggaaggggctgggagtgggtctcatctattggaagttagtgtttgtttatactattattagtggagacggcggggtggggggccagttcaccattcctaccagacgacaacgaccaaagaacgcagttatttcgngacaaagtgaacncgcctgcgagacgagacgacggntgtagtattactgtcgagagtaggtggagggcacgggttccccggttaccccgggtttagg

SEQ ID NO: 189747 - DNA, 546 bp, Homo sapiens
  misc_feature: GYAE6OF02HG7UQ.35.36.D03.1.454.CMB.1.raw
  modified_base (215)..(215): a, c, t, g, unknown or other
  misc_feature (215)..(215): n is a, c, g, or t
  modified_base (318)..(318): a, c, t, g, unknown or other
  misc_feature (318)..(318): n is a, c, g, or t
  modified_base (467)..(467): a, c, t, g, unknown or other
  misc_feature (467)..(467): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccaggggganagagccaccctctcctgcagggccagtcagactattacgtaccaacttagcctggtatcagcagaacctggtcaggcctcccgaggcctcctcatctatggtnacatccacagggcccactggtactcccagcccagggttcaggttggctaggtggggtctggggactaggtagttcactctcaccatcagccagcctgctagtctgacttgtattttcgacttagttttattacgtgtacagtctattangtaattacgtcggtccttcggtaggtaccgttccggaccgtaacgggtaccgtaagggtcggtaaccgtaccgtaacgg

SEQ ID NO: 189748 - DNA, 662 bp, Homo sapiens
  misc_feature: GYAE6OF02I7VET.35.36.D03.1.454.CMB.1.raw
  modified_base (168)..(168): a, c, t, g, unknown or other
  misc_feature (168)..(168): n is a, c, g, or t
  modified_base (213)..(213): a, c, t, g, unknown or other
  misc_feature (213)..(213): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaccactggagaaacngtgatgaagcagtctccagccatcctgtctgtgtctccgaggggngagacgccaccctctcctgcgagggccagtcagactattacgtaccaacttagcctggtatcgagcacgtaaacctggtcacggcctcccgaggcctccgtcatctagtggtcgctactccgaccgaggcccacgttcggtactacccgagtcccgtaggtttcgaacggttcggacgtacgggttcggggtacgttacggggacgtacggtacgtttccgtaaccgttccctaccgaaccctagtaccgacggacgtaacgtcccgttgacccgttagggttcctagtaacgttgtttaacgtttcgtactttaacggttttacttacgttcgtcgtagtacttagtttactagtaagttaacgtccggtaccgttccgggtcggtaaccggtttccgggaacgttaaccgggaaccggtacggtacggtaacggtacccgtaaccgg

SEQ ID NO: 189749 - DNA, 556 bp, Homo sapiens
  misc_feature: GYAE6OF02I5YTS.35.36.D03.1.454.CMB.1.raw
  modified_base (305)..(305): a, c, t, g, unknown or other
  misc_feature (305)..(305): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctgggagagtccctgagactctcctgtgtagcctctggattcaccttcaatatgtatagcatgacctgggtccnccaggctccgtgggaaggggctggagtgggtctcgatctattggaagttagtgtttgtttatacgtatattagtggagacggcgggtgggggccgtagttcacatctcagagacaacgaccaagaacgacagtatttactgacaaatacgaacacgccgtagcgaggacggaaggacgacggctgtagttattactggtgacggagtaggtaggagggaccgacgggtcccggttcccccgggtttaacgg

SEQ ID NO: 189750 - DNA, 547 bp, Homo sapiens
  misc_feature: GYAE6OF02I4Z1U.35.36.D03.1.454.CMB.1.raw
  modified_base (408)..(408): a, c, t, g, unknown or other
  misc_feature (408)..(408): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggagagagcccaccctctcctgcagggccagtcagactattagtaccaacttagcctggtatcagcagaaactggtcaggctccaggctctcatctatgtgcatccaccaggccactggtactcccgagccaggttcagtcggcaggtcgggtctggggacaggtagttcactcgcaccatcagcagcctgcagtcngattcgtattttgctaagttttacttacgttgtcacgtctatttagtagtacttaacgtcggttcccgttacggtcgggtaccgttccggaccggtaacgggtaccgtaaagggttcgggaaccgtacccgtaaacggg

SEQ ID NO: 189751 - DNA, 520 bp, Homo sapiens
  misc_feature: GYAE6OF02HQVC8.35.36.D03.1.454.CMB.1.raw
  modified_base (305)..(305): a, c, t, g, unknown or other
  misc_feature (305)..(305): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctgggagagtccctgagactctcctgtgtagcctctggattcaccttcaatatgtatagcatgacctgggtccnccaggctccgtgggaagggctgggagtgggtctcatcgtattggaagtgtgttgttatacattattagtggagacggtcgggtgggggccgtagttccaccatctcagagacaacgaccaaagacgcagttattctgacaatagaacagctgcgagacgagacacgctgtgtattactgtgcgagagtggaggcgacggtccgtccccggttagg

SEQ ID NO: 189752 - DNA, 548 bp, Homo sapiens
  misc_feature: GYAE6OF02HYFOO.35.36.D03.1.454.CMB.1.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (319)..(319): a, c, t, g, unknown or other
  misc_feature (319)..(319): n is a, c, g, or t
tcagtacagatcgtcacgaccggtgctcgatttagctgcgtcacgatctctcttggggcagagctctgggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagacgccaccctctcctgcagggccagtcagactattagtaccaacttagcctggtatcagcagaaacctggtcaggcctccgaggctcctcatctatggtncatccaccgacgggccacgtggtactcccagccaggttcaggtggctaggtgggtctagggacaggagttcactctacaccatcacgcacgcctgcagtctgattgtatttgacttagttttattacgttcgttcacgtactatttatagtaacttaacgtcggtacccgttcggtcggtaccgttcggaccgaacgggtaccgaagggtacggtacgtaccgtaacgg

SEQ ID NO: 189753 - DNA, 506 bp, Homo sapiens
  misc_feature: GYAE6OF02HJHBL.35.36.D03.1.454.CMB.1.raw
  modified_base (206)..(206): a, c, t, g, unknown or other
  misc_feature (206)..(206): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (503)..(503): a, c, t, g, unknown or other
  misc_feature (503)..(503): n is a, c, g, or t
tcagtacagatcgtcacgaccggtgctcgatttagctgcgtcacgatctctcttggggggagaggaactgctcagttaggacccagacggaaccatggaagccccagcgcagcttctcttcctcctgctactctggctccgaggaaccactggagaaacagtgatgacgcagtctccagccatcctgtctgtgtctccaggggganagagccaccctctcctgcagggccagtcagactattagtaccaacttagcctggtatcagcagaaacctggtcaggctcccaggctcctnatctatggtncatccacagggcccatggatcccagccaggttcaggtggcaggtgggtctgggacaggagtttcactctcaccatcagacagcctgctacgtctgatgtattttgctagtttattactgtcanctattatgaattacngtcctcgtggacgttcggaccgaagggaccagggtagacgtaccaacgtacgtagtggntcg

SEQ ID NO: 189754 - DNA, 527 bp, Homo sapiens
  misc_feature: GYAE6OF02GFTVR.35.36.D03.1.454.CMB.1.raw
  modified_base (303)..(303): a, c, t, g, unknown or other
  misc_feature (303)..(303): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggagcctggtcaagcctggagagtccctgagactctcctgtgtagcctctggattcaccttcaatatgtatagcatgacctgggtccnccaggctcctgggaagggctgggagtgggtctcatctagttggaagtgtgttgtttatactatattatggagacggcgggtgggggccgtattcacctatctccagagacaacgccaaagaacgcagtatttctgacaaatagaacagcctgcgagacgaggacgacgcgtgtggtaattactgtgcgagagtggagggcgaggtcccggtccccgggtttagg

SEQ ID NO: 189755 - DNA, 565 bp, Homo sapiens
  misc_feature: GYAE6OF02HKDWY.35.36.D03.1.454.CMB.1.raw
  modified_base (169)..(169): a, c, t, g, unknown or other
  misc_feature (169)..(169): n is a, c, g, or t
  modified_base (216)..(216): a, c, t, g, unknown or other
  misc_feature (216)..(216): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagagccaccctctcctgcagggccagtcagactattacgtaccaacttagcctggtatcagcaagaacctggtcaggcctcccgaggcctcctcatctagtggtcgcatccaccgaggccagtggtactcccgagccgaggttcagtggcgtaggtcgggtcgtgggacaggtacgttcactctacacatcagcacgcctgctagtctgatgtattttgacttagtttacttacgttgttacagtacttagttactagtaacttaacggtggtcccgttacgggtcggttaccggttacggaccggtaacggggtacccgtaagggtacggtaccggtaccgtaaacgg

SEQ ID NO: 189756 - DNA, 670 bp, Homo sapiens
  misc_feature: GYAE6OF02JHRCU.35.36.D03.1.454.CMB.1.raw
  modified_base (163)..(163): a, c, t, g, unknown or other
  misc_feature (163)..(163): n is a, c, g, or t
  modified_base (168)..(168): a, c, t, g, unknown or other
  misc_feature (168)..(168): n is a, c, g, or t
  modified_base (213)..(213): a, c, t, g, unknown or other
  misc_feature (213)..(213): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctctgctactctggctccgaggaaccactgganaaacngtgatgacgcagtctcagccatcctgtctgtgtctccgagggganagacgcccaccctctcctgcgaggccagtcagactatacgtaccaattacgcctaggtatcagacaagtaaacctggtacaggtcctacccgaggtcctcctcgactctagtggtgcacgtccaccgacggtcctacgtgtacctcccgagtcccgtaggttcaaggtcggtacgtaggttcgggtcgtagggacgtaggtacgttccacgtcctaccgaacctacgtacacgtccgtacgtacccgtacgaccgtacgttacgtacgtagtttcgttaacgttttcgaccgtttaagtttttaccgttacgttacgtactaacgttacgttaatttacgacgttaactaaccggttccggtaccgttaccgggttaccggtaaccggtttaccggaccgggtaaaccgggtaacccggttaagggtaaccggttaaccggtaacccgtaaaccggg

SEQ ID NO: 189757 - DNA, 665 bp, Homo sapiens
  misc_feature: GYAE6OF02HJCDN.35.36.D03.1.454.CMB.1.raw
  modified_base (173)..(173): a, c, t, g, unknown or other
  misc_feature (173)..(173): n is a, c, g, or t
  modified_base (221)..(221): a, c, t, g, unknown or other
  misc_feature (221)..(221): n is a, c, g, or t
  modified_base (455)..(455): a, c, t, g, unknown or other
  misc_feature (455)..(455): n is a, c, g, or t
tcagtacagatcgtcacgaccggtgctcgatttagctgcgtcacgatctctcgttggggcagagctcgtggggaggaactgctcagttaggacccagacggaaccatggaacgccccagcgcagcttctcttcctcctgctactctggctccgaggaaccacgtggagaaacngtgatgacgcagtctccagccatcctgtctgtcgtctccgaggggganagacgcccaccctctccgtgcgagggccagtcagtactattacgtaaccaacgttacgcctaggtactcgacgacaacgtaaaccttgggtacacggtcctcccgaggtcctcctcattctagtggtcgctacgtccaccgacggcctacgtcggtactcccgagtccgtaggttcaggtcggcgtaggttcggggtctacggggactaggtacgttccactcctacaccgtancgagccgtacgccgtgccgtacgttacgtgtacgttgttacgttttacggactttaacgtttttacttcgttagttcgtagttaactaagttttgacgttaacgttacccggtcggttacccgttaccggggtcggttaaccggtttccgggaacccggtaacggggtaccggttaaggggttaccgggtaaccgttaccgtaaaccggg

SEQ ID NO: 189758 - DNA, 527 bp, Homo sapiens
  misc_feature: GYAE6OF02GE1MQ.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccgccaggctcctggggaaggggctgggagtgggtctcatctattggaagttagtgttgtttatacattattatggagacggcgggtgggggccgattcgaccatctccagagacaacgccaagaacgcagtattctgacaaatagaacagctgcgagacgaggacacggctgtgtattactgtgcgagagtggagggcgacgggtccggtcccccgggtttacgg

SEQ ID NO: 189759 - DNA, 521 bp, Homo sapiens
  misc_feature: GYAE6OF02GK6NX.35.36.D03.1.454.CMB.1.raw
  modified_base (500)..(500): a, c, t, g, unknown or other
  misc_feature (500)..(500): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtctgggggaggcctggtcaagcctggagagtccctgagactctcctgtgtagcctctggattcaccttcaatatgtatagcatgacctgggtccgccaggctccgtgggaaggggctggagtgggtctcatctattggaagtagtgttgtttatactattattagtggagacggcgggtgggggccgattcaccatctccagacgacaacgccaagacgcagtattctgcaaatgaacagcctagcgagacgaggacacggtctgtgtattactgtgagagagtgagggcncgggtccgtaccccgggttag

SEQ ID NO: 189760 - DNA, 625 bp, Homo sapiens
  misc_feature: GYAE6OF02IRO30.35.36.D03.1.454.CMB.1.raw
  modified_base (439)..(439): a, c, t, g, unknown or other
  misc_feature (439)..(439): n is a, c, g, or t
tcagtacagatcgtcacgaccggtgctcgatttagctgcgtcacgatctctcttggggtctgagagaggagccttagccctggattccaaaggccctatccacttggtgatcagcactgagcaccgaggattcaccatggactggggctccgctgggttttccttgttgtcttttttagaaggtgtccagtgtgaggtgcagctggtggagtcgtgggggaggcctggtcaagcctggagagtccctgagactctcctgtgtacgcctcgtggtacttcaccttcaatatgtatacgcagtgaccgttcgggtcccgaccgacgggcctccggtagggggaacggggccgtagggtaggttcggggtctccgattccgttatttagggaaagttagtttggtttagtttaatactaattaagtttagtggagtacgggngggtgggggaccgtagttccacatcgtaccagacgaacgaacgacaagaaccgactagttacttctagactaaagtacgaacgacgcctgacgaagacggaaggacacggtcgttagttcgtaatttacgtggtcgacggaggtagtgggtacgggcgtaccgggttcccgttccccgggtttagg

SEQ ID NO: 189761 - DNA, 612 bp, Homo sapiens
  misc_feature: GYAE6OF02GJRXR.35.36.D03.1.454.CMB.1.raw
  modified_base (310)..(310): a, c, t, g, unknown or other
  misc_feature (310)..(310): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggagagacgccaccctctcctgcacgggccagtcagactattacgtaaccaacttagcctggtatcagcaagaaacctggcaggctcccaggtctcctnatctatggtcgctactccaccgacgggcccacgttggtactcccgagccctagggttccagggtcggactaggttcggggtctggggactaggtacgttcactcgtcaccactccaaggccacgtcccgtgccgtagttcctagtacgttgttacgttttgacgtttagttttaactttacgttagtcctagtacttaacgttagttacgtaacttaacggtcggtacccttcgggtacggttaccgttcgggtacccgtaagggtaacccgttaaggggtacggtacgtaccgtaaaccgg

SEQ ID NO: 189762 - DNA, 785 bp, Homo sapiens
  misc_feature: GYAE6OF02HJ25I.35.36.D03.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (226)..(226): a, c, t, g, unknown or other
  misc_feature (226)..(226): n is a, c, g, or t
  modified_base (472)..(472): a, c, t, g, unknown or other
  misc_feature (472)..(472): n is a, c, g, or t
tcagtacagatcgtcacgaccggtgctcgatttagctgcgtcacgatctctcttgggcagagctcgtggggaggaactgctcagttacggacccaggacggaaccagtggaacgcccagcgcagtcttctcttcctcctgctactctggcctcgagaaccacgtggaanaaacngtgatcgacgtcagtccaccagcctatccgtgtctgtcgtactcggaggganacgacgcctacctctcctggaccgaggcctagtacaggagttgtacgcaagctaacgttcgccgttacggaaccagtaccgtaaaggtaacggtttcggacccgtaacggtcccctacccggaaggtcccttacccttagtaacgtttcggtttttcgggcttccgtaacccgtaacgggttcggggccccgtttggttaaacgggttcccgtaccccggttaagttacccggtaaggtttaccgngggtacgggcttacggggttcgtaccgtttacgggaggtacgtacggttacgtaccgtaccttccgtaccacgtacgtactaacggctaaccggtccgttacgaccgtacgttaccgtaggttaaacggtttaacgttttcgttaacgtttaacgttttaaccgtttaacgttacgttaccgtaacggttaaacctaaagtttaacgtaacgttacgtaccgttaccggtaccgttacccggttagttaccgtaaccgtttacggtttaccggaccggttaaacgggtaaccctaaggtccgtaggtaaccgg

SEQ ID NO: 189763 - DNA, 892 bp, Homo sapiens
  misc_feature: GYAE6OF02HJWKW.35.36.D03.1.454.CMB.1.raw
  modified_base (163)..(163): a, c, t, g, unknown or other
  misc_feature (163)..(163): n is a, c, g, or t
  modified_base (168)..(168): a, c, t, g, unknown or other
  misc_feature (168)..(168): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
tcagtacagatcgtcacgaccggtgctcgatttagctgcgtcacgatctctcttggggcagagctcgtggggaggaactgctcagttaggacccaggacggaaccatggaagcccagcgcagcttctctcctcctgctactctggctccgagaccactggaanaaacngtgatgacgcagtctccagccatcctgtctgtcgtcctcgaggggganagagccctaccttcnccgtcgcgagggcctaagtcaagtactagttacgtaaccaacgttacgccgttaggtactaccaggacttaaacggaaacccgtgggtacgagggtccctacccgaacggtcccttcccctaccgaattccgttaagttcggggtacgacctaacgttaccccgaacccggaacgggacccctaaggttaccggggttaaccttaccccccggaagtaccccggttaaggggtttaaccaacggggttcggaccggaagggggtttcggggttacccggttagggggaaacttaacgggtaccgggttttaaccgacccttacccgtttaacccggaaaccgtaacttacccggaacggtacccgaacggtccccggtttagaccggttaaacgggttccctagggtaaacgttccgggttttaaagtttttttcgaaccgttttttaacgtttttaaaccgttttaccgttacgggttttaaccaacggtaacctttttaaacgggtttaataacggtttaacccgttaaaccggtttccggggtcccctttaacgggggttacgggtaacccggttttacggaaccccggggttaaacgggtaaaccgggggtaaaccgggttacgggttaaaccgggaaaccccgtttaaaaccgggg

SEQ ID NO: 189764 - DNA, 651 bp, Homo sapiens
  misc_feature: GYAE6OF02JI2TP.35.36.D03.1.454.CMB.1.raw
  modified_base (135)..(135): a, c, t, g, unknown or other
  misc_feature (135)..(135): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (433)..(433): a, c, t, g, unknown or other
  misc_feature (433)..(433): n is a, c, g, or t
tcagtacagatcgtcacgaccggtgctcgatttagctgcgtcacggtagtctctcttggggctagagctctggggtaggaactgctcagttaggacccagacggaaccatgggaagccccagcggcagtcttccncttcctcgtgcctactctggctccgaggaaccactggagaaacgtgtcgatagaaccgctaggtactccgacgcctacgtccctgtcgtcgtcgtccgtaccgaaggggggactaggacggcccgaacccgttctaccctagccacgggcctagtcaagtactagttacgtaaccaattacgccgttaggtactcgagaccgacgtaaacctggacncggccaccgagtcctccanactctaagtggtacacaactaccgacggacggtaccacgtaggacctccgaagccgtagtcngtgctaggttgctaggacagtagtccatccgtacaacgtgtacacgtcgtacgccgtggacctagtcgtagaccgttgttaacgtttcgactttaacggtttaacttcacgtcgtaactccttaagttaccgtacgtacctacgttcccggtaacctccgggtacgtacccgggtacgaacggtcggtaacggacggtacggtaaccctaccgaacgg

SEQ ID NO: 189765 - DNA, 700 bp, Homo sapiens
  misc_feature: GYAE6OF02I5L14.35.36.D03.1.454.CMB.1.raw
  modified_base (306)..(306): a, c, t, g, unknown or other
  misc_feature (306)..(306): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggtttccttgttgctttttagaaggtgtccagtgtgaggtgcagctggtggagtcgtgggggagccgtggtcaagcctggagacgtccctgacgactctcctgtgtagcctctggacttcaccttcaatatgtatagcatgacctgggtccncgaggtctccgtaggggaagggctggagtgggtctcgatctagttggaagtagttgtttagttatacattattagtggagtacggtggggtcgggggccgtagttaccacctatcctaccgaggtaacgaaccgtaaaccggacccgtaaaacggaaaccgacgtaaacgttacttttaccgtaacggtaactaaaacttacggaaaacctaacggtcccgttaggaaccgggtaaacggaaaccgggaaagggtaacccgaccgggtaccgttacggttaaggtttaaacgtttaccggtttaggtcggtaaccgggtaagggtacggtacgggaaccggggtaccggtaccggggttttacccccgggttacccccccggggttttaagggg

SEQ ID NO: 189766 - DNA, 618 bp, Homo sapiens
  misc_feature: GYAE6OF02IIBQV.35.36.D03.1.454.CMB.1.raw
  modified_base (172)..(172): a, c, t, g, unknown or other
  misc_feature (172)..(172): n is a, c, g, or t
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgcctactctggcctccgaggaaccacgtggagaaacngtgatgacgctagtctccagccatcctgtcctgtcgtactccgaggggganagcgtcccacccttctcctgcagggcctagtacagacctaattacgtaccaacgttacgcctaggtacncacgacaaggtaaaccctggtacacggtcctaccgaggtcctccgtcaacgtctagtcggtacnctaactcccgaacgcggtcctacgtacggtactcccaaggtcctaggttccagtcggacctaggtcgggtcctaggggactagtacgtctacgttccacaccgtaatcgaactcgtacgcctgaacgtgtcgtagagttgtaaccgtttgccgtagttttataccgtgttacgacttacgtagttacgtacgtaacttacggtccgtcgttcggaacgttccggtactacggacggtaacggtagtacggacgtacgtaacg

SEQ ID NO: 189767 - DNA, 690 bp, Homo sapiens
  misc_feature: GYAE6OF02HBF8Q.35.36.D03.1.454.CMB.1.raw
  modified_base (316)..(316): a, c, t, g, unknown or other
  misc_feature (316)..(316): n is a, c, g, or t
tcagtacagatcgtcacgaccggtgctcgatttagctgcgtcacgatctctcttggggggagaggaactgctcagttaggacccagacggaaccatggaagccccagcgcagcttctcttcctcctgctactctggctccgaggaaccactggagaaacagtgatgacgcagtctccagccatcctgtctgtgtctccgaggggagagacgccaccctctcctgcagggccagtcagactattagtaccaacttagcctggtactcagcaacgaaaccgtggtcaggcctcccgaggcctcctcatctagtggtcncactaccaccgacgggccctagtgtactcccgagcctaggttcaggtcgcgtaggtcgggtcgtaggggacaggtacgtttcactccgtaccaaccgtactaccgaagccgtaacgtcccgtacggacctacggttccgtagtacgtttagttagtttttcggactttaagtttttaacttacgttacgttaccgtagttaccttaagtttacgttaaggtaactttaaaccggttccgggtaccgtttcccgggttacggttacccgggtttacccgggaaccggtaaaacggggtaacccggttaaacggggttacgggaaacccggtttaccgaaaacggttaccggttacggttacggtacccgtaccgg

SEQ ID NO: 189768 - DNA, 689 bp, Homo sapiens
  misc_feature: GYAE6OF02FNC7O.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtcttttttagaaggtgtccagtgtgaggtgcagctggtggagtcgtgggggaggcctggtcaagcctggagagtccctgagactctcctgtgtagcctctggattcaccttcaatatgtatagcatgacctgggtccgccaggctccgtgggaagggctgggagtgggtcctgatctatttgggaagttagttgtttcgttttaatactattatttagtggaacggacggtcggggtgggggggccgtacgtttccgaacctacgttccgtaccgtaaggaacgtaaccgaaaccggcccgtaaaacggaaaccggaccgtaaggttacttttaccgtacgtaacctaaaacttacggaaaccgtaagtcccgttacggaccggaaggaaccggaagggtaacccgaacgggtacttcggtaggttaactttaaccggtggttacggcggtaaggtaagggtcgggaacgggggtacctaccggggtttacccggggttacccccccggggttttaacggg

SEQ ID NO: 189769 - DNA, 691 bp, Homo sapiens
  misc_feature: GYAE6OF02I1D3O.35.36.D03.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
tcagtacagatcgtcacgaccggtgctcgatttagctgcgtcacgtagttcggtactcgttaggggtctgagaccgaggagtccttagccctggagttccaaggcctagtcccacgttggtgacttcgagacgactgtacgcaccgaggattcaccagtggactggggctacgctggttttcttgttgtcttttttagaaggtntccagtgtgaggtgcagctggtggagttcgtgggggagcctggtcaagcctggagacgtccctgagactctcctgtgtacgcctntggattcaccttnaatntagtatacgctatgacctggggtcccncgaggcctccgtggggaagggctggagttgggtcttcgattctagttggaagtgttgtttgtttaatactattattagtggaagtcggcggggtaggggggccctaagtttccgacctagttcctaccgaaggactaacccgaacggtaccaaacgtaacccggtgtaacgtttacgttttacctggaaccctaaaagttccgaaacgacgttacccgagggaccgaacggaacgttaacgggaaccgaccggttacgttacggttagtttacgttaaccggttggttacgggaccgtaggtaccggttaggaacgggtccggtaccgggtttcccccgggtttacccgggttacggg

SEQ ID NO: 189770 - DNA, 558 bp, Homo sapiens
  misc_feature: GYAE6OF02I3K81.35.36.D03.1.454.CMB.1.raw
tcagtacagatcgtcacgaccggtgctcgatttagctgcgtcacgatctctcttggggtctaagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggaggcctggtcaagcctggagacgtccctgagactctcctgtgtagcctctggattcaccttcaattatgtatagcatgacctgggtccgccaggctccgtggggaaggggctgggagtgggtctcgatctagtcggaagtagtgtttgtttatacgtattattatggagacggcgggtggggggccgtagttcaccactctccagagacaaccgaccaagaacgctagttattctgacaaatgaacagcctgcgacgacgagaccgacgcgtgtgtattcgtgtgacgagaggttggacgggacgtacgggtcccggttacccccgggtttagtaccggg

SEQ ID NO: 189771 - DNA, 695 bp, Homo sapiens
  misc_feature: GYAE6OF02HFO7V.35.36.D03.1.454.CMB.1.raw
  modified_base (109)..(109): a, c, t, g, unknown or other
  misc_feature (109)..(109): n is a, c, g, or t
  modified_base (167)..(167): a, c, t, g, unknown or other
  misc_feature (167)..(167): n is a, c, g, or t
  modified_base (213)..(213): a, c, t, g, unknown or other
  misc_feature (213)..(213): n is a, c, g, or t
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
tcagtacagatcgtcacgaccggtgctcgatttagctgcgtcacgatctctcttggggcagagctctggggagaactgctcagttaggacccagacggaaccatggaancccagcgcagcttctcttcctcctgctactctggctccgaggaaccagtggagaaacngtgatgacgcagtctccagccatcctgtctgtcgtctcgagggganagcgcccacctctcctgcgagggccagtcagactattagaccaattgccttgtatcagacacggaactgcaggcctccgagtcctctcattctagtcggtcnctaactcccgaacgcggaccctagtcggtaccnccccgagtacctagggtttcgacggttcggacgtacgggttgggtacccgtaggggaactacggtagtttacccgactttccgtacaacctacgttaccgacgtaccacggtacccgttggaccttacgtcgttaacgagtttcggtttaagtttttccgaaccgtttaagtttttaccgtaccgttacggttacctaacggtacctttagtttaagtaccggttaaacttaccgggttaccggttcccgttaaccggggttaccggtaacccgggtttcccggaaccggtaaccggggtaaacccgttaacggggtaacggttaacccgtaacccgttaaaccggg

SEQ ID NO: 189772 - DNA, 585 bp, Homo sapiens
  misc_feature: GYAE6OF02FNLYX.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggaggcctgggtcaagcctggagagtccctgagactctcctgtgtagcctctggattcaccttcaatatgtatagcatgacctgggtcccgccgaggctccgtggggaagggctgggagtgggtctcatctagttggaagttaggtgtttgtttaatactattattagtggagacgggcggggtcggggggaccgtagttcgacctatctaccagagaccaacgaccaagaacgacagttatttctagactaaagtacgaacagtcctgacgagacggacggacgacggtacgtgtagttaacgttacgtggtgacggagtacggtagggacgggtcggtacgggttcccggttacccccgggtttagg

SEQ ID NO: 189773 - DNA, 535 bp, Homo sapiens
  misc_feature: GYAE6OF02HJ8JA.35.36.D03.1.454.CMB.1.raw
  modified_base (169)..(169): a, c, t, g, unknown or other
  misc_feature (169)..(169): n is a, c, g, or t
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (318)..(318): a, c, t, g, unknown or other
  misc_feature (318)..(318): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatccngtctgtgtctccgagggganagacgcccaccctctcctgcagggccagtcagactattagaccaattagcctggtatcagcaagaaacctggtcaggcctcccaggcctcctcatctatggtncatccacgaggcccatggtactcccgagccaggttcagttcggcaggtgctcgtgggacagtacgttcactctcaccatcacgcacgcctgaccagtcctagtagtagtttgcttagtttattacgtgtactagactaagtataatagtcgttcggccgttacgtacgttgtaccgttacgtttcgggaccgtaacggggacctaggtcgtaacggg

SEQ ID NO: 189774 - DNA, 716 bp, Homo sapiens
  misc_feature: GYAE6OF02I29JW.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatgaactggggctccgctgggttttccttgttgcttttttagaaggtgtcagtgtgaggtgcagctggtggagtcgtgggggaggcctgggtcaagcctgggagacgtccctgagactctcctgtgtagtcctctggtatccaccttacaatatgtaatgctagtcgaccgtgggtcccgccaggtcctcgtaggggaagggtcgtgggagtgggtctcagttcgtagttaggaagttagtgtttagtttaatactattattagtggagtacgggcggggtacgggggccgtaagtccaactataccgtaccaaggtacgaacctaaaccgaaccgaaagtaaaccgacgtaaagttactttacgtagtacgaaaagttagaaaccgtacgtacccgtagggaaccgaagggtaaacccggaaaggggaacccgaaccggggttcgttaagtttacggggttaactttaaccggttaggttacggaacggtaacgggttagggttacggggaaacccggggtacccgggtaaacccgggggttttccccccgggtttaacccccccggggtttttaacgggg

SEQ ID NO: 189775 - DNA, 650 bp, Homo sapiens
  misc_feature: GYAE6OF02F2NYM.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggactgggctcgctggtttcctgttgtctttttagaggtgtccagtgtgaggtgcagctggtggagtcgtgggggacggcctggtcaagccgtggagacgtcccgtgagactctccttgtgtagccttctggattcaccttcaatatgtaatagcagtcgaccgtgggtcccgcgaggcctccgtaggggaaggggtccgtgggaggttcgggtctcgtattacgttagttagggaaagttaggtttcggtttagtttttaacactaagttactttagtgggacggaacggtcgggggttagggggggaccctagtttaccgacccgtattcctacccaaggaacgaccgtaaaccggccgaaaccgaacggtacgtaagtttacgttttcctaggaactaaagtacgaacacgtccgtgacgagaacggacgacgtacgtctaggtacttacgtactggtgacggagtacggtgggtacgggcggtacggttccccggttaccccggtttagg

SEQ ID NO: 189776 - DNA, 722 bp, Homo sapiens
  misc_feature: GYAE6OF02GHUIF.35.36.D03.1.454.CMB.1.raw
  modified_base (169)..(169): a, c, t, g, unknown or other
  misc_feature (169)..(169): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggagagacgcccaccctctccgtgccgagggccagtcagtactattacgtaccaacttagcctggtactcagacaacgaacctggtacaggcctacccgaggtccctcctacattctagttcggtcgctactcccgaaccggtacgggacccctaccgtacgggttacctcccgacggtacccgtaagggttaccagggttcggcgtagggttcgggtcgtaggggaactagggtacgtttacgtaccttcgtacccaacctataccgaacgacctaacgcccttacggccgaacgttcgtaggtacttagggttactttttacggactttaacggtttttaacgtttaaccgttgttaaccgttacggtactttaagtttacgttacgtaacgtttaacggttccggttaccccgtttaccgggtacgggttaacccggtttaccggtaacccggtaaacggggtaaccggtaaaggggttacgggtaaacccgttaccggtaaaaccgg

SEQ ID NO: 189777 - DNA, 782 bp, Homo sapiens
  misc_feature: GYAE6OF02IGKKG.35.36.D03.1.454.CMB.1.raw
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttctcctgctactctggctccgaggaaccactggagaaacagtgatgacgcagtcnccaacactctgtctgtgtcnccgagggacaggacnccaccctntccngcgagggccagtcagagtgtagcagactaacttacgcctaggtaccagcaaggtaaacggttcgaccgacggcctcccgaacggtcctcctacgtacgtttccgtttggtcgttacgtcccgtaacggtcgggcctcgtcgggtacctcccgaaggtcgtacgggtttacagggttcgtcgtacggttcggtccgtttccggaggggtaacctacggtacgtttaccgtacccgttccgtaccctaaccgtaacgttaccgtaaccggccgtaacggtcccgtacgtacccgtaaacggttccgttaacgggttaaacgttacgtttttacggtaccgttttaacgtttttaacgtttaaccgttacggtttaccgtaacggttaaaccttaaaccgtttaaagttaaacgttacgttaccggttaccggttacccggttaccggttaacggttttaccggtacccggttttaccggttttttaccgggacccggttaaacgggggtaacccctaaacgggttccggttaacgggtaacggtttaaacccgg

SEQ ID NO: 189778 - DNA, 675 bp, Homo sapiens
  misc_feature: GYAE6OF02G3MZI.35.36.D03.1.454.CMB.1.raw
  modified_base (159)..(159): a, c, t, g, unknown or other
  misc_feature (159)..(159): n is a, c, g, or t
  modified_base (170)..(170): a, c, t, g, unknown or other
  misc_feature (170)..(170): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (543)..(543): a, c, t, g, unknown or other
  misc_feature (543)..(543): n is a, c, g, or t
tcagtacagatcgtcacgaccggtgctcgatttagctgcgtcacgatctctcgttggggcagagctctggggaggaactgctcagttaggacccagacggaaccatggaagccccagcgcagcttctcttcctcctgctactctggctccgaggaaccnctggagaaacngtgatgacgcagtcctcagccatcctgtctgtcgtctccggagggganagacncccaccctctcctgcgacgggccagtcagtagtagttacgaactacgtagtcgtacggtaccagacaagtaaaccgtggaccgacggccctaccgaggcccttccgtactactcgtagtcgggctacctactacccgaccggacgggccctacgtacggtacctacccgagcccgtaggttcaggtcgacgtagggttcgggtccgtagggtactcggtaacctttccgaaccttcctaccgaaccctagtccgaacgccgtaacgtccgttacgacgttacgtccgtaagtaagtcttacgcgttaaccttagtttacncgttaacgtgttaccgaacgttacgttaagtttacgtcggtcgttacccgggaccttccgttaccgttaccggttccgggttaccgggacgggtaccggtaccggtaagggtacggaactaacgtaaacggg

SEQ ID NO: 189779 - DNA, 529 bp, Homo sapiens
  misc_feature: GYAE6OF02HGO3E.35.36.D03.1.454.CMB.1.raw
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggaggcctggtcaagcctgggagagtccctgagactctcctgtgtagcctctggattcaccttcaatatgtatagcatgacctgggtccgccaggctcctgggaagggctgggagtgggtctcatctatttggaagttagtgttgttttatactattattatggagacggcggggtgggggccgagttcaccatctccagagacaacgccaagaacgcagtattcnganaatgaacagccngcgagacgacgacgacgcgtagtgtatgtgtgcggagagtggaggacgtcgggttccggttcccggttacgg

SEQ ID NO: 189780 - DNA, 611 bp, Homo sapiens
  misc_feature: GYAE6OF02FLGDN.35.36.D03.1.454.CMB.1.raw
  modified_base (216)..(216): a, c, t, g, unknown or other
  misc_feature (216)..(216): n is a, c, g, or t
  modified_base (309)..(309): a, c, t, g, unknown or other
  misc_feature (309)..(309): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggganagacgcccacccctctcctgcagggccagtcagactattagtaccaacttagcctggtatcagcagaacctggtcaggcctccaggcctcctnactctagtggtgcctatccaccagggccctacgtcggtacctcccgagcccgtaggttcaggtggccaggttcgggtcgtggggaactaggtacgttccacgttcctccacctatccgacgccgacgtcctgactacgtctagacttgttagttttcgacgttagttttacttacgttgttcgtacgtacttagtttatacgtaagttaaccgtcgggtacccttccgggtacgggtacccggtttaccggaccggtaaccggggtaaccgaaggggttacggtaaccgtaccgtaaaccgg

SEQ ID NO: 189781 - DNA, 718 bp, Homo sapiens
  misc_feature: GYAE6OF02F70HH.35.36.D03.1.454.CMB.1.raw
  modified_base (183)..(183): a, c, t, g, unknown or other
  misc_feature (183)..(183): n is a, c, g, or t
  modified_base (240)..(240): a, c, t, g, unknown or other
  misc_feature (240)..(240): n is a, c, g, or t
  modified_base (366)..(366): a, c, t, g, unknown or other
  misc_feature (366)..(366): n is a, c, g, or t
tcagtacagatcgtcacgaccggtgctcgatttagctgcgtcacggtagtctctcttggggcgtacgagtctctggggtaggaactgcctcagttaggacccagacggaaccatgggaagccccagcggcagcttctcttccctcgtgcctactctggctccgaggaaccactggagaaacgngtcgatagaacgcaggtactccagccagtcctgtcgtgtcgtccgtccgaagggggngaggacgcccgacccgtctcctagcgacgggccagtcaagtactatacgaacctaattcgcctggtactcaaggacgacgtaaacctggtcacggcctaccggagtccttccacactctagtggtntaccactaccgaccggaggccctagtggaacctccgaagccgtaggttcaggtgacgtaggttcgggtcgtaggggacctaggtacttacgacctcgttaccgacgttacgtacgtaccgtccggtaacgtccggtggtaccgtgttaccgtcgtacgggttacgttacgtttaccggacgttttaacgtttacctttccgtacgttaccgacgttccgttaacgttacgtacgtaaccgtaaccgggttccggttaccccggtttaccgggttaccgggtacccggttaccgggaccggtaaaccggggttaccgaaacgggttaccggtaaaccgtaccccggtaaacgg

SEQ ID NO: 189782 - DNA, 533 bp, Homo sapiens
  misc_feature: GYAE6OF02IY2E0.35.36.D03.1.454.CMB.1.raw
  modified_base (329)..(329): a, c, t, g, unknown or other
  misc_feature (329)..(329): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (507)..(507): a, c, t, g, unknown or other
  misc_feature (507)..(507): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtggggaggcctggtcaagcctggagagtccctgagactctcctgtgtagcctctggattcaccttcaatatgtatagcatgacctggggtccgccaggcctccgtggggaacggggntcggagtgggtctcgatctagtttggaagttagtgtttgtttatactatattagtggagacgnggggtggggccagtcacntctcagagacacgcaaagacgacagtattcngacaaatgaacngctagcgagacgagacgacgctgtagtagttacctgtgcgagtaggtggacggngtacgggttcccgtccccgggttaag

SEQ ID NO: 189783 - DNA, 595 bp, Homo sapiens
  misc_feature: GYAE6OF02FU6QW.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgatcaccgaggattcaccatggaactggggctccgctgggttttccttgttgcttttttagaaggtgtccagtgtgaggtgcagctggtggagtcgtgggggaggcctggtcaagcctggagagtccctgacgactctcctgtgtacgcctctggattcaccttcaatatgtatagcatgaccgtgggtcccgccgaggcctccgtggggaacgggtctgggagtgggtctcatctagttggaagttgttgttgtttatactattattagtggagacgggtcggggtcggggggaccgtagttccgacctatcctccgaaggacgaaccgaaccggaccaaagaacgactagttactttcgagtactaaatcgaactacgccgtagacgacgacggacggacacggtcgtagtgttacttacgttgtcggacggtagaggtaggagggtccgacgggttcccggtaccccgggtttagg

SEQ ID NO: 189784 - DNA, 751 bp, Homo sapiens
  misc_feature: GYAE6OF02INXZG.35.36.D03.1.454.CMB.1.raw
  modified_base (179)..(179): a, c, t, g, unknown or other
  misc_feature (179)..(179): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctcgctggtttccttgttgtctttttagaggtntccagtgtgaggtgcagcgtgggtggaggtcgtgggggaggtccgtggtcaacggccgtggaggacgtccctgagtacctctcgtggtagtcgtccgtcgtaggactttacctaccttcaattatacggtatacgcagtcgtaccgtcggtccaccgacggccttccggaggggaagggtcctagggtaggtcgggtctcgtacgtcgtaagttcgggtaaagttggtaggttttagttaacttaacgtatttaaacgtagttaagggtacggtaccggggtcggggggttaacgggggccttaacgtttccgaaccggttactcccgttaccgaaggtaccgaaccggtaaccgaaccgaaacgggtaaccgtacgtacggtttaacgtttccaaggtaaccgtaaacgttaacggaacctacggcccttaacggacggaaccggtaaacggaacggaccgtaccggtacgttacggttaacgttacggttacgtggtaccggtacgtaagggtaggtacggtaccgggtacgtaccggggtttacccccgggttaccccggttttaaggg

SEQ ID NO: 189785 - DNA, 783 bp, Homo sapiens
  misc_feature: GYAE6OF02FHCQP.35.36.D03.1.454.CMB.1.raw
  modified_base (221)..(221): a, c, t, g, unknown or other
  misc_feature (221)..(221): n is a, c, g, or t
tcagtacagatcgtcacgaccggtgctcgatttagctgcgtcacgatctctcttggggtctgagagaggagccttagccctggattccaaggcctatccacttggtgatcagcactgagccaccgaggacttcaccagtcggaacgtggggcctccggtcttcgggttttccttgttgttacgtttttaaggaacggttcgtcctaggtgtaggaggtgcngcgtgggtcggaggtcggtgggaccgtccgtggtaccacggtccgtaggacgacgttccccgtggaccgtccttccgtccgtgtcggtacctcctcgtggactttaccaccttacaatagtcgtatcgctacgtcgaccggtcgggtccacgtacggtccgttaccgggagggggtaacggttccgtacgggtcggttacggtaccttacgtacttacggttaaggtagggttaacgtttacggtttagttttaacgttacgtaacgttaagtttaacggttacgggacggggtaccggtccgggtacgggggggttcccgtaacctaacgttccccgaaaccgttcccgtaacccgaaccggaacggaaacccgtaacccggaaaccgtaccgaaaacgtcccggtttacttaacgttaccgtttacgaacctaaacgttaaccgacgaccgtaccgtcgacgtacgactacgggaacttcgacttgacgtacgttaacgcgtaggacgtaggacgtagggtccggacggtcccgttacccgggttacccggttagtcggg

SEQ ID NO: 189786 - DNA, 659 bp, Homo sapiens
  misc_feature: GYAE6OF02HJ7RL.35.36.D03.1.454.CMB.1.raw
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttcctgttgtctttttagaaggtgtccagtgtggaggtgcagctggtggagtcgtgggggaggcctggtcaagccgtagggagacgtccctgacgactctcctgtgtacgcctcgtggtattccaccttcaatatgtatagcatgaccgtgggtcccncgacggtctccgnggggaggggctgggacgtgggtctnagtctagttaggagtagttgttagttanactattattagtggaggacggtcggggtcggggggaccgtagttccaaccgtacgtcctaccgacggtacgaacgtaaccgaccgaaacgtaaccgacgtaacgttaacgtttaccgtagaactaaaacgtagaaccgaacgtccgtaggaccgtaaccggaacggaacggaccgaccgggtacgttaggttacggttaagttaccgtggtacggtacggaagtagggtacggacgggtaccggtacgggttccccgggttacccccgggtttaggg

SEQ ID NO: 189787 - DNA, 991 bp, Homo sapiens
  misc_feature: GYAE6OF02G03O1.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctggggtttttccttgtttacgttttagttttaaggtaggttccgtacgtaggttgtaggtaggtcgacgcgtcgggtgggtagggtcgttcgggggtacgggggtacgtccgggttcggtaacgaaccgtcgggtagggaacgtacccggtccgtaggaacgtccttccgttccggttggtaggtaccctcccgttacgggtacggtttaccttaccccgtttacccttaacttaattagttacggttaaagtccgtaattacggtaccggttacccggggttcccgggtaccccgaccgggtaccggttccccgttccggggggtaaggggggtaccgggttcgggtaggggtacggggttccgggttacctacgttacgttacgtttaaggggtaagggttaaaggttttaggttttaggtttttaacgttttaacgtaacgtttaagttttaaggtttagggtacggggacgggttaccgggggtacggggggggggtacccgggtaaccgttttaccgtaaccccgtaccgttacgtttaccccgaaggaaacggtaaccgaaacccggtaacccgaaacccgaaaggacccgttacgttaacggttttacctttacggacgtaaactaaacggtaaccggtaagtcccggtaacgtaccggaacgggaaaccggggaacggaaacccgggtacgggtaccggttacggttaggtttaacggttttaacggttaggtttaccgggaggtacgggttaaggtggggtaccgggggtacggttaacccggggtaccccgggggtttttaccccccccgggtttacggttaacggggg

SEQ ID NO: 189788 - DNA, 660 bp, Homo sapiens
  misc_feature: GYAE6OF02I16K8.35.36.D03.1.454.CMB.1.raw
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
  modified_base (209)..(209): a, c, t, g, unknown or other
  misc_feature (209)..(209): n is a, c, g, or t
  modified_base (508)..(508): a, c, t, g, unknown or other
  misc_feature (508)..(508): n is a, c, g, or t
  modified_base (552)..(552): a, c, t, g, unknown or other
  misc_feature (552)..(552): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctcgagaccactgganaacngtgatgacgcagtctcagccatcctgtctgtgtcctcgaggganagacgcccaccctctcctgcgacgggccagtcagtacttagttacgacctaacgtttacgccttaggtactcgagtacaacggtaaaccgttggtaccgacgggtcctaccccggaggtcccttccgttaccaacttccgtaagtcgggttcacctacgtcccaaccggacggtcccctaacgtcggttaacctcccgagtacccgtaggttccagggtcgcgtaggttcgggtctaggggactaggtacttccacttcgtactactatcgacgtctacgccttagcgtacgttcgtanacgtttgttagtttcgacgtttagttttactacgtacgttacgngttacgtagtttacgacgttacgttaccgcggttaccggttccggtacggtacccggttacggaccggtaccgggtaacgtacgggtacggaaccttccggtaacggg

SEQ ID NO: 189789 - DNA, 546 bp, Homo sapiens
  misc_feature: GYAE6OF02HH1JJ.35.36.D03.1.454.CMB.1.raw
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
  modified_base (476)..(476): a, c, t, g, unknown or other
  misc_feature (476)..(476): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggaggcctgggtcaagcctggagagtccctgagactctcctgtgtagcctctggattcaccttnaatatgtatagcatgacctgggtccgcaggctccgtgggaagggctggagtgggtctcatctagtggaagtgttgttagtttanactattagttatgggagacggtcggggtgggggccgtagttacaccgtatctaccgagtacgacaacgaccaaacgaacgacacgttatttactgacaaatacgaacagccngcgagacggagacgacggctgtagtattatgtgcgagagtggagggcgacggttccggtccccggttagg

SEQ ID NO: 189790 - DNA, 650 bp, Homo sapiens
  misc_feature: GYAE6OF02GY3LI.35.36.D03.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
tcagtacagatcgtcacgaccggtgctcgatttagctgcgtcacgatctctcttgggcagagctctgggaggaactgctcagttaggacccagacggaaccatggaagcccagcgcagcttctcttcctctgctactctggctccgaggaccactggagaacngtgatgacgcagtcnccagccatcctgtctgtgtcctaccgaggggganagagtcccaccctntcctgccggacgggcctagtccgagtaccttagtttaagaccctaaacgtttacgcccgttggtaactaccgagtacaacgtaaacccgtggtcaacggtcctacccgaggcctcctagactctagtgtgacctatcccgacgacgggtccaccgttggtaactcccgaatccgtagttaccagggccacggtggtcgggtcacgggacagtnttacgacgtctacgacactcgacgacncggcncgtacgacgtctagtacgtagttcttgtcctttaagttttaacttccgttagtcctaaaggccttaattaccgtttacgaattaaccggtcggtaccttaccggttcgggtaacgttcccggaccggtttaaccggaacgggttaaccggaccgggtttaacggtaaccggtaacccgg

SEQ ID NO: 189791 - DNA, 799 bp, Homo sapiens
  misc_feature: GYAE6OF02IKZQY.35.36.D03.1.454.CMB.1.raw
  modified_base (173)..(173): a, c, t, g, unknown or other
  misc_feature (173)..(173): n is a, c, g, or t
  modified_base (229)..(229): a, c, t, g, unknown or other
  misc_feature (229)..(229): n is a, c, g, or t
tcagtacagatcgtcacgaccggtgctcgatttagctgcgtcacgatctctcttggggcagagctcgtggggaggaactgctcagttaggacccagacggaaccatggaagcccccagcgcagcttctcttcctctgctactcgtggctccgaggaaccacgtggaagaaacngtgatgacgctagtcctccagcctatccgtgtccttgtcgttcctacgaggggganacggacgcccctacctcctccgtgccgacgggcctaggtccaagtacttaatttaaccgtaaccctaacgttcgccgttaggttactaccaaggaccaacggtaaaccctgggttaccgaaccgggtccttacccgacggtcccttacctacgtaacttcgtaaggttcgggtacactacgtaccccgaccggtaacgggtccctacggttacggtaacctcccgaggtacccgttaacggttccgagttacggggtacgtacggggttcggggtaccggtaggggaaccgttagggtaaccgtttcccaaccgttaccctaacgtacccgtacgtaccgacggtacccaccggtccgtcgtaccgttgttaccgttaggttaacttttcgttacgttacttttaaacgtttttacgtaacttaggtaccttaagttacctacgtttagttacgtaacgtttaaccggtcgggtacccgttaccggggttacgggttacccggttaccgggaaacggtaaccgggtaaacggtaccgggtaaccggtaacgtaacccggtagttaccggg

SEQ ID NO: 189792 - DNA, 590 bp, Homo sapiens
  misc_feature: GYAE6OF02H3GM1.35.36.D03.1.454.CMB.1.raw
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgcttttttagaaggtgtccagtgtgaggtgcagctggtggagtcgtgggggagcctggtcaagcctggagagtcctgagactctcctgtgtagcctctggattcaccttcaatatgtatagcatgaccgtggtccncaggctccgtggggaacgggctggagtcgggtctnatctagttggaacgttgtgtttagtttatactaattattagtggagcggtcgggtgggggccgtagtacacactctaccagagacaacgaccaagaacacgagttacttcgtagactaaagttcgaaactcgaccgtacggacgtaacggaacggaacgggaccgtaacggtcgtaggtagtactttaacgtgtaggcgaggtacggtggagggccgtaacgggttccccgggttacccccgggttttaggg

SEQ ID NO: 189793 - DNA, 710 bp, Homo sapiens
  misc_feature: GYAE6OF02INRIO.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactgggctccgctgggtttcctgttgtctttttagaggtgtccagtgtgaggtgcagctggtggagtcgtggggagccgtggtcaagccgtggagacgtccctgacgcttctccgtgtgtagcctgtggtattcaccttcaagttatgtataagctatcgaccgtgggtacccgcgacggtcctcccggtaggggaacggggtccgtagggtaggttcggggtcctcaagttccgttagtttaagggtaagtttaaggtttggtttaggttttaaatacctaagttttaagttaagtggtaaggtaccgggtcgggggtcggggggtacccgtagtttaccgaacccgtacttaccgttaccgaaggtacgaaaccaaccggaaccgaaacggaaccgtacgtaagttacgtttagacggaacctaaagttacgaaaccgtacgccgtacgacggaacgtacgaaggaccgaggtccgttagtacgttaattaccgtaggtccggaagtagggtacggtacgggacggttaccggacccgggtttaccccgggtacccccgggtttaaggg

SEQ ID NO: 189794 - DNA, 809 bp, Homo sapiens
  misc_feature: GYAE6OF02IDLAK.35.36.D03.1.454.CMB.1.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
tcagtacagatcgtcacgaccggtgctcgatttagctgcgtcacgatctctcttggggtctgagagaggagccctagccctggattccaaggcctatccacttggtgatcagcactgagcaccgaggattcaccatggaactggggctccgctgggttttccttgttgtcttttttagaaggtgtccagtgtgaggtgcagctggtggagtcgtgggggaggcctggtcaagctgggagagtccctgagactctctgtgtagccttntggattccacttacaattatgtatagcatcgtacccgtggggtacccnccgaggtccttaccggtgggggaacggggtccgttaggggacggttcggggttccttacgacgtttaccgttagttagggaaaggtttcggtttagttttaggttttaactacgtaagtttatttagggttagggacgggtaacggggtcggggggttacgggggggacccgttaaggtttccccgaaacccgtaccgttaccgttacccgaagggtaacccgaaccgtaaaccggaccctaaaagggaaccgacggtaaacggttactttttaccgagtaaacgtaaacgttaacggaaaccgtaccggtaccgttaccggaccgggtaaacggaccgggtaaacggggacccgtaccgggttacgttacgggtttaaccggttacgttttaaccgtgggtacgtaaccgggtaagggtacgggttaggggaaccggggtacccggttaaccgggggttttacccccggggttaccccccgggttttaagggg

SEQ ID NO: 189795 - DNA, 968 bp, Homo sapiens
  misc_feature: GYAE6OF02I68BP.35.36.D03.1.454.CMB.1.raw
tcagtacagatcgtcacgaccggtgctcgatttagctgcgtcacgatctctcttggggtctgagagaggagccttagccctggattccaaggcctatccacttgggtgatcagcactgagcacgaggatcaccatggactggggctcgctggttttcctgttgtctttttagaaggtgtccagtgtgaggtgcagcgtggtggagtcggtgggggacgcctggtcaagccgtggagacgtcccagacgtctctaccgtgtgtacgtcctcgtaggtacttaccgtaccttactaaattagtacgttaattacggaccttacgttaccggtacccggttcgggggtaccccggacccgtagggtccctttaccggggtacggggggaaacgggggtccggttaggggtacggttcggggttacctacgtacgtttaccgttaggttttaaccggggaaaggttttacgggttttggtttttaaaggtttttaacgttaaccgtttaagtttaaacggttttaacggttacgggggtaaacgggttaccccggggggttagggggggggttaccggggggggttaaccccggtttaaaccggtttaaccccggtaaaccctttaacccgttaacccgttacccgggtaaaacgggtaaacggtaaaaccccggtaaaccccgggtaaaccccgaaaacggggtaaaaccccgtccgggttaaaccgttttaaacctttttaccgggtaaccgttaaacggtaaaccttaagggtaaaacccgtaccgggtaacccggttaggacccgggtaaaacggtaaccggggaaacccggttaaccggtaccgggttaccgttcggtttaaacgggttaacttttacgggttacggtacgggacgggtaaggtaagggtacgggtaccgggtaccgggttaccccggttacccggggttacccccgggtttaaggg

SEQ ID NO: 189796 - DNA, 704 bp, Homo sapiens
  misc_feature: GYAE6OF02HZIO8.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtcttttttagaggtgtccagtgtgaggtgcagcgtggtggagtcgtgggggagcctggtcagcctggagacgtcctgagctctccgtgtgtacgcctctggtattccaccttcaattatgtaatagctatcggtaccgtgggtcccgccgacggcctccggtgggggaacggggtcgtaggggaggttgggtctctattcgtagtttagggtaagttaggtttgtttagttttaagtactagtttaatttaggtgggtaggacgggtcgggggtcggggggaccgtagtttcccgaccgtacttcctaccgaaggacgaaccgaaccgaccgaaaggaaccgtacgtacgtttactttcgtacgtaactaaagtacgaaacctacgtccgtacggaccgaacggaaccggaacgggaccgaccggtacgttaggttacggttaacgtttaccggttaggtccggtacggagggtagggtagggacgggtacccggtaccggggttcccccgggtttaccccccgggttttaacggg

SEQ ID NO: 189797 - DNA, 808 bp, Homo sapiens
  misc_feature: GYAE6OF02GOVZY.35.36.D03.1.454.CMB.1.raw
  modified_base (315)..(315): a, c, t, g, unknown or other
  misc_feature (315)..(315): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtcttttttagaggtgtccagtgtgaggtgcagctgggtggagtcgtgggggagccttggtcaagccgtggagacgtccctgagactctccgtgtgtacgcctcgtggattccaccttcaatatgtatagcagtgaccgtgggtcccncgaggtccttcccggtaggggaacgggggtctaggggtaggttcggggtcctcgtagttccgttaaggtttacgggtaaagtttagggtttggtttttaggtttttaaactaactaagtttaatttaaggtaggggaacggtaccgggtcggggggtcgggggggtaccctacggtttcccaacccgtaacttacccgtacccgaaggtaaccggaacccgaaaccggacccgaaaacggtaacccgacgttaagtttacttttacgtaggtaacctaaagtacgaaaccgacgtacccgtaggaccggaacggtaaccggaacgggaacccgtaacggggtaccgtttcgggttaacggtttaacggttttaaccggttaggggttaaccggtacgggtaaaggggtacgggttaggggaaaccgggggttacccgggttacccggggggttttaccccccgggtttaacccccccgggggtttttaagggg

SEQ ID NO: 189798 - DNA, 702 bp, Homo sapiens
  misc_feature: GYAE6OF02FNSX2.35.36.D03.1.454.CMB.1.raw
  modified_base (315)..(315): a, c, t, g, unknown or other
  misc_feature (315)..(315): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtcttttttagaaggtgtccagtgtgaggtgcagctgggtggagtcggtgggggaggcctggtcaagccgtggagacgtccctgacgactctcctgtgtagcctctggattccaccttcaatatgtatagcatcgaccgtgggtcccnccgacggtctccggtaggggacggggcgtgggaggtgggtcctctagttcgttagttaggggtaagttaggtttgttttagttttaactaactaactttaagtttaaggtaggggaacgggtaccgggtcggggggtcggggggggtaccctagtttaccgaacccctagttcccgtaaccgaaggaacgaaccaaacccgaaccgaaaggaaccgacgtaacgtttactttaccgtagtaactaaacgtaacgaaaccgtaggtacccgtaggaaccgaacggaacgggaacgtaccggacggtccgttaggtacgttttaacttacgtggtcgaggagtaggtgggacgggcgtaccggggttccccgttacccccggggttagg

SEQ ID NO: 189799 - DNA, 675 bp, Homo sapiens
  misc_feature: GYAE6OF02IVBGG.35.36.D03.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (628)..(628): a, c, t, g, unknown or other
  misc_feature (628)..(628): n is a, c, g, or t
tcagtacagatcgtcacgaccggtgctcgatttagctgcgtcacgatctctcttgggtctgagagaggagccttagccctggattccaaggcctatccacttggtgatcagcactgatcacgagattcacatggaactgggctccgctgggttttccttgttgtctttttagaagtgtcngtgtagnggtgcagctggtaggagtcgtgggggngccttggtcaagccgtaggacgtcgtccctagacgtactcctccgtagtacggtcgccttcgtacggtattccaccgttcaagtacgtacttacgtttcagtcgtaacctggtactcccgacagtacctacgaggggtacgactgggacgtgggtcctcgacacgactacgacggctaagttcgaggtaccaacgtccctagttacgtacgtaccgacgagtaccgtgacggtacgtaaccgggtcttaaccgttacctaacgttacggtttaaccggaactaaacgggtcccgttaagggttaccgcttacggtacgttactagtaacctaagttacgaaactacgtaccgtaaggacgtaacggtccgaaggaccggtactacccggtaattaccgacgtttacgtacggtnttaaccggaaggttccgtaaacgttagggtttaccggtggttaccgg

SEQ ID NO: 189800 - DNA, 611 bp, Homo sapiens
  misc_feature: GYAE6OF02FPAXR.35.36.D03.1.454.CMB.1.raw
  modified_base (472)..(472): a, c, t, g, unknown or other
  misc_feature (472)..(472): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtcttttttagaaggtgtccagtgtgaggtgcagctggtggagtcgtgggggaggcctggtcaagccgtggagagtccctgagactctcctgtgtagcctcgtggtacttcaccttacaatatgtatagacatcgaccgtcgggtcccgccgaggtcctccggtggggaacggggcgtgggaggttcggtctcgacttcgttagttagggaagttaggttgtttagtttaatactaattattagtggagcggcggggtcggggctagttcacctatcctacgagacgaaccaacgaccaaagacncgtacgttacttctacgacaaagtacgacacgtccgtagacgaagacggacgacgtacggtctgtacgttaattacgtggtcgtaacggaggaggtacgggtacgggcggtacgggttccccggttaccccgggttagg

SEQ ID NO: 189801 - DNA, 893 bp, Homo sapiens
  misc_feature: GYAE6OF02JQ571.35.36.D03.1.454.CMB.1.raw
  modified_base (362)..(362): a, c, t, g, unknown or other
  misc_feature (362)..(362): n is a, c, g, or t
tcagtacagatcgtcacgaccggtgctcgatttagctgcgtcacgatctctcttggggtctgagagaggagccttagccctggattccaaggcctatccacttggtgatcagcactgagccaccgaggattcaccatggaacgtggggctccgcttcggtttccttgttgtctttttagaaggtgtcagtgtgagtgcagctggtggaggtcgtgggggacggttcctgggtccaacggtccgtagggacgacggtccccgtagtacgtaccttccgttccgtaggtcgtagtcccgtgtcggtactttccaaccttcgtaaattagtgtacttagctacgtcggtaccgtcggtacccgtnacccggtcggtacgggtacggtaggggtaccgggtcggtaggggttacgggtaccggttcgtaccttaggttacgtttaaggttaggtacggtttagtttggtttaatttaagtaacttaagttaggttacgggtacgggtacggggtaccggggggacggggtaccggggttacccgtaaccgttacccgtaaccgtaaccctaccgtaacccggtaaacggaaacccggtaaacccgtaaacccggtaaaccgtaaccgtaaacggttacctttaagttaccgttaaccgtaaacgtaaaacctaaaggtacccggaacctaacgggtacccgtacggtaaaccgggtaaaccggtaaccgggaaaccgggtaacggtacccgggttacgtttaacggtttacggtttaccggtaaggggttacggaccgggttaaggggttaacgggaccgggggttaaacccggggttcccggggtttaaccccggggtttacccccggggttttacccccggggttttaacccggg

SEQ ID NO: 189802 - DNA, 752 bp, Homo sapiens
  misc_feature: GYAE6OF02I1ZK2.35.36.D03.1.454.CMB.1.raw
  modified_base (177)..(177): a, c, t, g, unknown or other
  misc_feature (177)..(177): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (559)..(559): a, c, t, g, unknown or other
  misc_feature (559)..(559): n is a, c, g, or t
  modified_base (580)..(580): a, c, t, g, unknown or other
  misc_feature (580)..(580): n is a, c, g, or t
tcagtacagatcgtcacgaccggtgctcgatttagctgcgtcacgatctctcttggggcagagctcgtggggaggaactgctcgagttaggacccagacggaaccagtggaacgccccagcgcagcttctcttcctctgctactcgtggcctaccgaggaaccacgtggaagaaacngtgatgacgctagctcaagccatccgtgtcctgtgtactcgaaggggnagacncccgtactcgtctcgcgtagggcccaagtcacgtacgtagttacgtaacctaacgtacgtcctaggtactacgaacncgtaacgtaaaccgttgtacggacgaccgtaccgacggtcctaccgtactaaccgttntaacggtttcggacctacgtaacctccccggtaacgacccgggacctaaccgtcgggtaccttaccgggacccgtaaccggtgggttaaccgtaggttaccggttacggacggttaccgggtcggttaccggggaagaccggtttacggtaccgtaccgttaccgtacctaacgcttaaacggccacggtaccncgggttcgaccgttaccggtntacgggtacttagttacgttacgttaccgtttaagtttaacgttacgttaacggttcgttaccgtagtttacgtagtacgtttaaccgtccgttaacggtcccgttcgggtaacgtaccggttacggtacggaaacggtaccggtaaggtaaccggttccggaagtaaccgg

SEQ ID NO: 189803 - DNA, 742 bp, Homo sapiens
  misc_feature: GYAE6OF02G0P4V.35.36.D03.1.454.CMB.1.raw
  modified_base (164)..(164): a, c, t, g, unknown or other
  misc_feature (164)..(164): n is a, c, g, or t
  modified_base (169)..(169): a, c, t, g, unknown or other
  misc_feature (169)..(169): n is a, c, g, or t
  modified_base (612)..(612): a, c, t, g, unknown or other
  misc_feature (612)..(612): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactgganaaacngtgatgacgcagtctccacgccatcctgtctagtcgtacctcggaggggagagaccgcccgacccctcttcctggccgacggggccagtaccgagtaactagttaacgaacctaacgttagccttggtactcgagacaacgaaccgtgggtaccacggtccctacccgaggtcctccctagtattccgtacggtggtcgtacctactaccccggaacggtaccgggtccctacggttacggtacccttacccgacggttacccgtaggttccgaagggttcggacggtacggggttcggggtaccggtagggaccgtaagggttctaaccccgagtttcccacgtaccgtacgtacgacgtaccggacgttccacgcgttacggtctaggtttacttcgttaagttttccggacttttaagttttaccgttaaggtcgttaanccggttaaacttgttaagttacgtaacctttaccgggtccgttccggttacccggtaacggttccccggtaaccgggtaacggaaccggggttaaccgtagggtaaccggttaccggaaccgtaaccggg

SEQ ID NO: 189804 - DNA, 848 bp, Homo sapiens
  misc_feature: GYAE6OF02GP5MZ.35.36.D03.1.454.CMB.1.raw
  modified_base (199)..(199): a, c, t, g, unknown or other
  misc_feature (199)..(199): n is a, c, g, or t
tcagtacagatcgtcacgaccggtgctcgatttagctgcgtcacgagtctctcgttggggcagtagcctcgtgggggacggaactggactccaaggttacggaccccaggaccggtaacccattcgggaacgcccccagccgcaggcctttcctcttccctcctggctactctggctccgaggaccacgtggacaaacngtcgactggaccgctagtcctccgaggacctatccctcgtccttcgtcgtacctccgggagggggacacgacgccctacccttctccgtagccgtacggggacctaggttaccaagtaccgttaacgttaaccggtaaacctaaccgttacggtcccgttaggttaacctccgaacggtacctaaacggtaaaccccgttggtaccgacgggtccccttaccccggacggtacccttaccgtacgtacgttaccttacggtcggtcctaccgaacccgtcccgtaaccggtacgggtaccctaacggtttcggtacctacccgaggtaccgttaacgggtctacggttcggcctagggtccgtacgggtacgacgtacgtacgtctacccgtcgtaaccctcgttaacgtcgtacggtacgttacccggttcgtacgttacgtacggttcttaccggtaagtttgttccgtttaagtaacttttacgtttaccgttacgtacgttaccgagtttaaccttggtaaccgtttacgtaaccggtccgtttaaccccggttcgtaaccggggttccggttaacccggtaacggttaacccggggaacgtttaaccgggtacgggtaaaccctttaccggaaacccgttacgg

SEQ ID NO: 189805 - DNA, 902 bp, Homo sapiens
  misc_feature: GYAE6OF02FJOIF.35.36.D03.1.454.CMB.1.raw
  modified_base (164)..(164): a, c, t, g, unknown or other
  misc_feature (164)..(164): n is a, c, g, or t
  modified_base (169)..(169): a, c, t, g, unknown or other
  misc_feature (169)..(169): n is a, c, g, or t
  modified_base (234)..(234): a, c, t, g, unknown or other
  misc_feature (234)..(234): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctctgctactctggctccgaggaaccactggaanaaacngtgatgacgcagtctcagccatcctgtctgtgtctccgaggggatagacgcccaccctcgtccgngcgacgggccagtaccgagtaacttagttacgtaaccctaaacgttacgccttaggtaataccgaagccgtaaacggtaaaccccgttgggtaccgaacgggtacccgtacccccggtaagggtccctttcccgtaccgtaacgtttaccgtttaacgttacgggggttaccaccgttaaaaccgttccccggaaaaccggtaaccgggggtacccccttaaacggggtttaccgggtttaaaccccgtaccccgtaaccgggtaaccccgtttaaaggggtttccgtaaacggggttccggtaccggtaacgggtttcgggggtacgttaccggggaaacgtaagggttaccggttttacccacgtttaccccgtaacgaacccggttaacgttacccgaacgcccggtaacggttacccgttaggtaaccctagggttttaccgaggttaccgtttaacggttttcgtttttaccggaccgtttttaaagtttttaccttaccgggtttatacccgttaaagtcctttaaacgtttgtaccggttaacgttacccggttcgggtacccgttttaaccggggttccgggttaaccgggttccgtaaaccggggaaccggttaaaccggttaagggggtaacctaaccgggttaaccctaaaccgggg

SEQ ID NO: 189806 - DNA, 811 bp, Homo sapiens
  misc_feature: GYAE6OF02G9KZP.35.36.D03.1.454.CMB.1.raw
tcagtacagatcgtcacgaccggtgctcgatttagctgcgtcacgagtctctcttggggtctgagagaggagccttagccctggattccaaggcctatccacttggtgatcagcactgagcaccgaggattcaccgatggaactgggctccgctgggtttccttgttgtctttttagaggtgtccagtgtgaggtgcagctggtggagtcgtgggggagcctggtcaagcctaggagagtccctgacactctctgtcgtagtcctcgtggacttccaccgtttacaaagttactcgtaagttacgactagttcggaacccgtttcggggtccccgtaccggtaacggggtcccttacccgggtaggggggaaacggggttccttaggggtaggttccgggggttacctacgtaacgtttccgttaaggtttcgggaaaggtttagtttcgggttttaattttaacgtaacgtaatttacgttaaggtcgggaaggtaaccgggttccggggggtggggggtacccctaagtttacccgaaacccgttacgttcccgtaaccgtaaggaaccgtaaaccgaaccgtaaccgaaacggaaacgtcgtaagtttacgttttcgacgttaacgtaaacgttacggaacgtaacggtaccgtgaaccggtaagggaccgggtaaacggtaccgtaaccgggtcgttacggttacgtttaacggttacccgttagggtcggtaacggtaaggttcggtacggggtccggtacccggtttacggggttacccccgggtttacccccggttttaagggg

SEQ ID NO: 189807 - DNA, 583 bp, Homo sapiens
  misc_feature: GYAE6OF02GW3ZX.35.36.D03.1.454.CMB.1.raw
  modified_base (214)..(214): a, c, t, g, unknown or other
  misc_feature (214)..(214): n is a, c, g, or t
  modified_base (392)..(392): a, c, t, g, unknown or other
  misc_feature (392)..(392): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaccactggagaaacagtgatgacgcagtctccagccatcctgtctgtgtctccgagggganagagcccaccctctcctgcagggccagtcagactatagtaccaattagcctggtatcagcaagaacctggtacaggcctcccgaggcctcctcattctagtggtgcctacgtcccaccgagggccctacgtggtacctcccgagtcctaggttcaaggttcggctagggtcgggtacnggggacaggtacgttcaacttccgtacacatccgaagcacgcctggcctagtctgtactgttactttgactttagttttacttacgttgtactagtctaagttatacgtactacgtcggtacccgttacggtggtacccggttcgaaccggtaacgggaccggtaagggtacggtaaccgtaccgtaacgg

SEQ ID NO: 189808 - DNA, 736 bp, Homo sapiens
  misc_feature: GYAE6OF02I4ASM.35.36.D03.1.454.CMB.1.raw
  modified_base (173)..(173): a, c, t, g, unknown or other
  misc_feature (173)..(173): n is a, c, g, or t
  modified_base (188)..(188): a, c, t, g, unknown or other
  misc_feature (188)..(188): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (417)..(417): a, c, t, g, unknown or other
  misc_feature (417)..(417): n is a, c, g, or t
  modified_base (521)..(521): a, c, t, g, unknown or other
  misc_feature (521)..(521): n is a, c, g, or t
tcagtacagatcgtcacgaccggtgctcgatttagctgcgtcacgatctctcttggggcagagctctggggagaactgctcagttaggacccagacggaaccatggaagccccagcgcagtcttctcttcctcctgctactctggcctccgaggaaccacgtgggaagaaacngtgatgacgcagtcnccagccatcctgtctgtntctccggagggganagacncccaccctctcctggacgacgggccaggtccaagtacttaagttaacgtaacctaacttacgccttaggtactcagacaacggaaaccgtggtacacggtcctacccgagtcctcctactacttctagtcggtctactaactccgaaccgacggccctaacgtcggacctacccagtaccgtaggttaccgnggtcggacgtagggtcgggttcgtacggggaactacggtacggtttaccaaccttccgtaccgtaaacctaacgtaccgtaacgaccggtaccggtccctttanacccggtaacgttcgttacggtaagtttacgtttacgtttttaccggacgtttttaaggtttttaacccttacgtagttaaacctacggttattaaacgtttgtaacgtaaccgttaaccggtccggttaacccgttacgggtacggttaaccggttacccggaacggtaaaccggtaccgggtaaaggtaccggtaacgtaaccccgtaaacgg

SEQ ID NO: 189809 - DNA, 792 bp, Homo sapiens
  misc_feature: GYAE6OF02I6S0Y.35.36.D03.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (165)..(165): a, c, t, g, unknown or other
  misc_feature (165)..(165): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (415)..(415): a, c, t, g, unknown or other
  misc_feature (415)..(415): n is a, c, g, or t
tcagtacagatcgtcacgaccggtgctcgatttagctgcgtcacgatctctcttgggacagagctctggggaggaactgctcagttaggaccagacgaaccatggaagcccagcgcagcttctcttcctcctgctactctggctccgagaaccnctgganaaacngtgatgacgcagtctacagccatccngtctgtntccgccgagggganacgacncccgtaccctctccgtgacgacgggcctagtccagtacttagttacgtaaccctaacgttcgccgttggtactaccgagaccgaacgtaaaccgttggtaccgaaggtccctccgacggtcccttacctacgtacttacgtagttcggtcgactaacctccgtaacccggacggtccctaacgtttacgggttaccnccccgggtacgtacccgtagggttacccgaggttccggtacgttaccgggggtttacgggtttacccggacggggtaacccgttagggtaacccgttttaccccgacgttaccctaaacccgtacgtaacgtaacccggacgttacccgtaccgtttcgacccgttacgttaccggtgttaccgttagtttaactttacggtaccgtttaacgttttaacgttaccgtccgttaactacggttacttaacgtttaacgttacgtacgtttaccgttaccggtcccgtttacggtaaccgtttaccgggtaacccgttaaccgggaacggttaccgggaaccgttaacggggtaaacctacccgggtaaaccgtacgg

SEQ ID NO: 189810 - DNA, 772 bp, Homo sapiens
  misc_feature: GYAE6OF02G0EE5.35.36.D03.1.454.CMB.1.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgcctactctggcctccgaggaaccacgtggaacaaacagtgatgacgcagtctcagccatcctgtctgtcgtctccgagggganagacgcccaccctctccngcgacggccagtcagacttatacgtaacctaacttagccgttagtctcgaagacaacgtaaccgtggaccacggtccctacccggaggtcctaccctcacttacgtacggttcggtcacctaccgtaccccggaaccggaacccgggtaccctaaccggttaccggtacccttacccggaccggtaacccgttacgggttaccgacggggttcggaccggttggggttcggggtacggtacgggggactaacggtaccgttacgtacccgtccacctactaactcgaaccgtacgccggacctacgaccgttacggtcgtagtacgtttacggtttagttttaccgtaacgtttttacgttttaacttacggttcgttaacgtacgtttaactttagttacgttacgttaaccggtttaacccggttccgggttaacccggtttcccggggtaaaccgggttaccccggttaacgggtaaccggaaacgggttaaccggtaacgggtaaccgggttaacccgttaacggaaacgg

SEQ ID NO: 189811 - DNA, 806 bp, Homo sapiens
  misc_feature: GYAE6OF02IVYI6.35.36.D03.1.454.CMB.1.raw
  modified_base (161)..(161): a, c, t, g, unknown or other
  misc_feature (161)..(161): n is a, c, g, or t
  modified_base (166)..(166): a, c, t, g, unknown or other
  misc_feature (166)..(166): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (667)..(667): a, c, t, g, unknown or other
  misc_feature (667)..(667): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctcgagaccactgganaaacngtgatgacgcagtctccagccatcctgtctgtcgtctccgagggganagacgccacctctctgcncgggcctagtcagtacttattacgtaacctaacttacgccttggtaactcgagtacaacgtaaccttgggtaccacgggtaccttccccgaagggtcccttaccgtccgtaactttccgttaaggtccgggtttagacccttaacgttacccccgtaaaccggtacgggtacccctaaccggtttccggggtaaaccttaccccggacggttacccggtaacgggttttaccgaacggtttcggggaaccttagggggtttccggggttacgtacgggggtaaacacgggttaacgtttacccgaaaccgtttccgtaacccgaaaccgttacgacccggtacgtaccggaccgtacccgttacgaccgtaagggtttcccaggtacgttttacggttacgttttacggtacgttttaaagtttcctttaacggtnttaccgtagtccgttaagttaccgtagtaacgttaccggtaccggttcccgtacgggggttacgtacccgggtttaccggacccggtaaaacgggtccggttaaacggggtacggttaacccgtaacccgtaaaccggg

SEQ ID NO: 189812 - DNA, 889 bp, Homo sapiens
  misc_feature: GYAE6OF02F6NR8.35.36.D03.1.454.CMB.1.raw
  modified_base (169)..(169): a, c, t, g, unknown or other
  misc_feature (169)..(169): n is a, c, g, or t
  modified_base (216)..(216): a, c, t, g, unknown or other
  misc_feature (216)..(216): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacngtgatgacgcagtctccagccatcctgtctgtcgtctccgagggganagacgcccaccctctcctgcgagggccagtcagtactattacgacctaacgttacgccgttaggtactcgagacctaaggtaaacccttgggtaccacgggtcccttaccccgaggtcccttcctacgtacttccgttaagtcgggtactacctaacgttccccgaaccggtacgggtaccctaacggtttcgggtaaccgtacccccgtaacggtcccgttaagggtttaccccgaagggttcccggggaccgttaacggggttccgggggtttaccgtacggggggaaacccttagggttaaccggttttaccccgaacccgttttaccgtaacccgtaaaccccgttacgttacccggaaacggcccgtttaacgggacccccgtttagggtacccgtttaacggttacccgggttaggttaaaccgtttccgggttttaatttttccggaaccgtttttaaagttttttaaccggtttacgttacggtacttaaacggttcctttaaaggttttacgtacggttaaaccttttaacccggtcggggttacccttttaacccggggttaaccgggttacccggtttaccggggtaaacccgggtaaaccggggttaaacccggttaagggtaacccgggggttaacccgttaacccggttaaaacccggg

SEQ ID NO: 189813 - DNA, 611 bp, Homo sapiens
  misc_feature: GYAE6OF02F8IND.35.36.D03.1.454.CMB.1.raw
  modified_base (172)..(172): a, c, t, g, unknown or other
  misc_feature (172)..(172): n is a, c, g, or t
  modified_base (188)..(188): a, c, t, g, unknown or other
  misc_feature (188)..(188): n is a, c, g, or t
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
tcagtacagatcgtcacgaccggtgctcgatttagctgcgtcacgatctctcttggggcagagctctggggaggaactgctcagttaggacccagacggaaccatggaacgccccagcgcagcttctcttcctctgctactctggctccggaggaaccacgtggaagaaacngtagatgacgcagtcnccagccatcctgtctgtgtccgtcggagggagagcaccctcctctcgtgacgtacggctagcagtaactattaacgacctaacttcggcctagtacacagacaagtacctggtcgacgtccaccgngtcctcactactgtagtcggtcgacaccgtccgacgtacggcacgttcgaccnccgacgtcgaggttcgagtcggctagggtcgtagacgggactacggtcgtacctactcctanacctgtaacgacgtcggactcgtacgtcgtacgttcgcgttagttcgtttaacgttcggtacttttaaggtttacttaccggttagcttaagttacgtattacggtactacgttcgtcgtaccggtcgtaccgggtacgtacggaccggtacggaaaccgtagggtaccgtacgagtaacgg

SEQ ID NO: 189814 - DNA, 705 bp, Homo sapiens
  misc_feature: GYAE6OF02JORJH.35.36.D03.1.454.CMB.1.raw
  modified_base (165)..(165): a, c, t, g, unknown or other
  misc_feature (165)..(165): n is a, c, g, or t
  modified_base (170)..(170): a, c, t, g, unknown or other
  misc_feature (170)..(170): n is a, c, g, or t
  modified_base (220)..(220): a, c, t, g, unknown or other
  misc_feature (220)..(220): n is a, c, g, or t
tcagtacagatcgtcacgaccggtgctcgatttagctgcgtcacgatctctcttggggcagagctctggggaggaactgctcagttaggacccagacggaaccatggaagccccagcgcagtcttctcttcctcctgctactctggctccgaggaacctatgganaaacngtgatgacgcagtcctcacgccatcctgtctgtacgtctccggagggganagacgccccaccctcgtcctgccgtagggcccagtcaggtaaccttagttacaacctaacgttacgccttggtatcaagcaacgtaacccttgggtaccgacggtcctacccgaggtccttccgtacactttcctaggttggtccgacctacaccccgtacgacgggtaccctacgttacgggtaacctccgaaaccgtcgacgggttcaacggccgtacgtggttacgggtacgtacgggacgtaagtaccggtactacccgtcgtaaccacgtctacgacggcctacgtcgtcggactcgtacgtgtacttgtagtttcgacgtttagttaacttccgtatccggtaatccgttaagttacgtacgtaaccgtttcgggtaaccccggttcgtaaccggggtttacgaccggtttaacccgggtaacccgggtaaccggttaaaccggtaaggggttacccggtaaggttaccccgtaaacgg

SEQ ID NO: 189815 - DNA, 800 bp, Homo sapiens
  misc_feature: GYAE6OF02HCS1F.35.36.D03.1.454.CMB.1.raw
tcagtacagatcgtcacgaccggtgctcgatttagctgcgtcacgatctctcttggggcagagctctggggaggaactgctcagttaggacccagacggaaccatggaagccccagcgcagcttctcttcctcctgctactctggctccgaggaaccactggagaaacagtgatgacgcagtctccagccatcctgtctgtcgtctccgagggggatagacgcccaccctctccgtacgcgacgggcctagtcagtaccttagttaacgtaaccctaacttacgccgttggtaactacgacgacaacgtaaaccgtggtaccaacggtccacccggaggcctccgtactattcgtagtcggcgtccacgtacccgacggccggtacctacggtacggtacctacccgaacggtcccgttaggttaccgtacggtcggtacgttacggggtcgggttcggtacggggaacgtcggttacggtacctaccggttccctaccaaccgttactaccgacggtccgttaaccggcccgttacgacgttacgttccgtagttacgtttaacgtttcgtttttacgggaaccttttttaacggttttaaccgtttacggttaccgtttaaccggaaacgtttacgttaaccggttttattaaaccgggtacgtttacccccggttcgggttaccccgggtttaacgggttcccgggtttaacccggtaccggggtaaccccggggtaaacgggttaaccggggtacggggtaaaccggtttaaccggaacccgggtttaaacccggg

SEQ ID NO: 189816 - DNA, 731 bp, Homo sapiens
  misc_feature: GYAE6OF02JHAFA.35.36.D03.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (230)..(230): a, c, t, g, unknown or other
  misc_feature (230)..(230): n is a, c, g, or t
tcagtacagatcgtcacgaccggtgctcgatttagctgcgtcacgatctctcttggggcagagctcgtggggagaactgctcagttaggacccagacggaaccatggaacgccccagcgcagcttctcttcctcctgctactcgtggctaccgagaacccacgtggaanaaacngtgatgacgctagtcctaccgagcccagtcctgtctgttcgtcctcggaggggtanagacgccctacctcgtccgtgaccgacggtccagtcacgacgtattacgtaccaacttacgcctaggtactcagctaacgtaaaccgtgacgtcgaccgtccgacggccttacctactacgtacttagtcggtcgactacgtccaccgtacgggacctacgtacggttccgtacccacgtaccgtacggttctacggttcggaccgttagggttcgggtttacgtaaccggggtaactaccgggtagttacccgtaccgttccgtaaccgaaaccgttcacgtacgaccttacgtccgtacggtactaccgtctacgtcgttacgttacgttgtccgtttaagttttacgttccttacgtacgttacgttcgttaagtttgtaccgttagtttacccgtacggggttacccgtttacggttaccggttaccggttcccgttaacgggtaaccgggttaaccgtaagggtttaccggtaaacggtacccccgttaaaacggg

SEQ ID NO: 189817 - DNA, 703 bp, Homo sapiens
  misc_feature: GYAE6OF02JOQ1A.35.36.D03.1.454.CMB.1.raw
  modified_base (221)..(221): a, c, t, g, unknown or other
  misc_feature (221)..(221): n is a, c, g, or t
  modified_base (511)..(511): a, c, t, g, unknown or other
  misc_feature (511)..(511): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcgtgggttttccttgttgtctttttagtaaggtgtccagtgtgaggtgcagctggtggagtcgtgggggngccgtgggtcaacggcgtggagacggtccctgacgactctcgtgtcgtacgcctctggtacttccacctttcaattattgtaagttacggcaagtcggaccgttcgggtacccgccgagggtccttccgtagggggaacgggtccgtagggtacggggttcggtcgtaccgtagttcgttaggtttacgggtaaagttagggtttcgtttaaggttttaacgtaactacgttaaagtttagttaggggacgtacgggtcgggggtacgggggtccgtacgttcgtaaccngtctaccgagtacgtaccgaccgtaacgaacacgacgttaagtatttaccgtataacgtaatacgaacgacgtccggtagacgaacggaacgacgaacgtaccggagttgttacggttacttacgttggtacggtacgtaggaaggttcgggaggtaccggtacgggttccccgggttaccccgggttacgg

SEQ ID NO: 189818 - DNA, 880 bp, Homo sapiens
  misc_feature: GYAE6OF02GK8YD.35.36.D03.1.454.CMB.1.raw
tcagtacagatcgtcacgaccggtgctcgatttagctgcgtcacgatctctcttggggtctgagagaggagccttagccctggattccaaaggccctatccacttggtgatcagcactgagcaccgaggattcaccatggaacgtggggctccgcttgggttttccttgttgtctttttagaggtgtccagtgtggaggtgcagcgtggtggagtcggtgggggacggccgtggtacaacggccgtgggacggtacgtccccgtggacgaccttcctccgttaggttcgtacggcccttcgtcggtaacttttcctaaccctttacaaattagttacggttatacggactacgttcggtacccggttacgggtccccgccgaacggtccgtcccggtagggggaacggggcgttgggaggttcgggtcctcgtactacttaggttagggaaggtttaggtttaggtttagttttaagacttaagttaagttaggtaggacgggtacgggtcggggggtacgggggtccgtacgttaccgaacccgtattacccgtaacgaacggaaccgtaaccgaacccgggtaaacccgtaaaacggaacccgtaaccgttaagttttaccgttttaactaaccggtaacctaaaacggttaacccggaaacgtaacccgggttccccgttaacgggaaccggtaacccggggaaaccggggaacccggtaacccgggacccgggtttaccgttgggttaacgttttacggtttaaccgttggggttaccggtaacgggtaaggtacggggttaggggtaacccggggtcgggtttaaccccgggggttttacccccccggtttaaccccgggggtttttaaccgggg

SEQ ID NO: 189819 - DNA, 881 bp, Homo sapiens
  misc_feature: GYAE6OF02GXGZ9.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctgggttttccttgttgtctttttagaggtgtccagtgtgaggtgcagctggtggagtcggtgggggaggccgtggtcaacggccgtgggacgacgtccctgacgtactcctccgtgtcgtagccttcgtggtattccgacccttacaattagtgtattagctagtcgacccgttcgggtcccgccgaggtcctccggtagggggaacggggtcgttaggggaggtcgggtctcgtagttcgttacgttagggtaagttaggtttagtttttacgtttttaacgtaagttttaagtttaggtagggtaaccggtaacggggttccggggggttacgggggggtccctaacggtttacccgaacccgtaacgttcccgtaacccgtaaggaaccggaaaccctaaacccggaacccgtaaaacgggtaaaccggtaccgttaaacggtttaacgttttaccgtaacggtaaacccgttaaaacgtaacgggtaaaacccgtaccgtaacccgttacgggaacggtaaacccgggaaaccggggtaccggtaaacccgggtacccggggtactttacggggtttaacgttttaaacggttttaccggtaacgggttacgggtaacccgggtaaggtaacgggttaccggggaacgggggttacccggttaacccccggggggtttaccccccgggtttttaccccccgggggtttaaggttacccccggggg

SEQ ID NO: 189820 - DNA, 868 bp, Homo sapiens
  misc_feature: GYAE6OF02FRRXC.35.36.D03.1.454.CMB.1.raw
  modified_base (166)..(166): a, c, t, g, unknown or other
  misc_feature (166)..(166): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctctgctactctggctccgaggaccactggagaacngtgatgacgcagtctccgagccactctgtctgtgtctccgaggggagagacgccaccctctcctgccacgggccaggtacagactattaacgtacctaacgttacgtccgtaggtactaccgaggtaccaaacggtaaacccgttgggtaccgtaacgggtccctaccccgtacggtaccttacccttacgtacttaccgttaacgttcgggttacgcctacgttacccgaacccggacgggtccctaacggttacgggtaaccttacccgtaccggacccgttaacggggttacccacggggtttacgggaccggttacggggttacggggggtttacccgtaggggggtaaccgtaaacgggttaaccggtttcccgtaacccgttcccgtttacccgaaacccgtacgtttaacccgaacggcccgttaaccggtcccgttcgtaacccgtttcggtacgttaaggttaaaccgtttacgtttttccggtaacgtttttaacggtttttacgttttaacgggttacggtttaaccgtaaagtaccgtttaaaagttaacttaacggttacggttacgttacccgggttacccgtttaaccgggttaccggtttaccggttacccgtttaccggggtttttacggaccccgggttaaagggggtaccccttaacggggtcccggtttaagggtaaaccgg

SEQ ID NO: 189821 - DNA, 540 bp, Homo sapiens
  misc_feature: GYAE6OF02FZWGT.35.36.D03.1.454.CMB.1.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
tcagtacagatcgtcacgaccggtgctcgatttagctgcgtcacgatctctcttggggtctgagagaggagccttagccctggattccaaggcctatccacttggtgatcagcatgagcaccgaggattcaccatggaactggggctccgctgggttttccttgttgcttttttagaaggtgtccagtgtgaggtgcagctggtggagtcgtgggggagccttggcaagcctggagngtcccngagactctccgtgtgtacgcctgtaggactttcacctttcaattatggtaatgccagttgaccgttgggccnccaaggtcttccgaggggaagggtntgggaagtcgggtctcaatntagtttggaagttgtnttgtttanactatagtttnggacgcgtggggtggggacattcaccattcncganagacacgcaagacnctaagtnttcnggataanggacagccttgcagacgagancggtnaggnttaatccngtgaccgagttgngacggttnaggtcccgtcccgttaagg

SEQ ID NO: 189822 - DNA, 763 bp, Homo sapiens
  misc_feature: GYAE6OF02GRT6F.35.36.D03.1.454.CMB.1.raw
  modified_base (156)..(156): a, c, t, g, unknown or other
  misc_feature (156)..(156): n is a, c, g, or t
  modified_base (184)..(184): a, c, t, g, unknown or other
  misc_feature (184)..(184): n is a, c, g, or t
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
tcagtacagatcgtcacgaccggtgctcgatttagctgcgtcacgatctctcttggggcagagctctggggaggaactgctcagttaggacccagacggaaccatggaagccccagcgcagcttctcttcctctgctactctggctccgagaaccncgtggaagaaacagtgatgacgcagtcncagccatccgtgtctggtgtctcgagggganagacgcctaccctntcctagcgaggccagtcagactattacgaacctaacgtttagacccttagggtactacgacgaccgtaacgaaaacccgttgggtacctaacgggtcctaccccgaagggtccttaccccgtatacttacggttttaggggtcgttaccggttacccgtaacggttaagggggccccgtacgttaggggtccgttaccccgtaaggttaccgttaagggtttaccaacgggtttcgggacctaaggggtcgtacccgttaccgggtacgggaacgtaaggttaccggttaacctaacccgtacctttaacccgaaccgttacgtaccgaacggtaccgaccgtacgttacggacgttacggtaccgtaggtaacgtttatttcgacttaacgttttactttaacgtcgttaacgaacgttaacgttaaactaaattaacgttaagcgttaccgggacctttccggagtttacggaccgtttacggtttccggaaccggtaacgggtaaccgtaacgcggttacggacgtaaccg

SEQ ID NO: 189823 - DNA, 832 bp, Homo sapiens
  misc_feature: GYAE6OF02HBLYP.35.36.D03.1.454.CMB.1.raw
  modified_base (145)..(145): a, c, t, g, unknown or other
  misc_feature (145)..(145): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (184)..(184): a, c, t, g, unknown or other
  misc_feature (184)..(184): n is a, c, g, or t
  modified_base (218)..(218): a, c, t, g, unknown or other
  misc_feature (218)..(218): n is a, c, g, or t
tcagtacagatcgtcacgaccggtgctcgatttagctgcgtcacgagtctctcttggggcagagctctggggaggaactgctcagttaggacccagacggaaccatggaagccccaagcgcagtcttctcttcctctgctactcnggctccgagaccactggaanaacngtgatgacgcagtcnccagccatccgtgtctgtcgtcctccgaaggggnacgacgcccaccctctaccgtgcgacgggccagtccagtacttagttaacgaacccttaacgtcgtccgttaggtaactacgacggtactaaacggtaaacccgtcgggtaccacggtccctaccccggagggtcccttaccgtactactttaccgtaaggttcgggtaactccgtaaccgttacccgaaacccggtaccgggtaacccgtaccgtttagggttaacccccaccggtaacccggttaccggtaacggggtttccaaggggttcgggaccgttaacgggggttccgggtagggttaccggggaacgttacggttaaccggtttacccgtaacccgttccctaaaccgaccttaacgggtaccctacggtaccgtaaccgttccgtaccgacccgttaggtcctagtacggtttagtttacgttcgttaacgtttaagttttaccgttacttaccggttaaccgtagttaacttaggttaacctaggttaacccgtttacccgtacgggttacccttccgggggtttaaccgccggttaaccgggaacccgggttaaaaccgggtacggttaacgggtaacgggtaacccgtaacccggtaacggg

SEQ ID NO: 189824 - DNA, 728 bp, Homo sapiens
  misc_feature: GYAE6OF02IYBA6.35.36.D03.1.454.CMB.1.raw
  modified_base (171)..(171): a, c, t, g, unknown or other
  misc_feature (171)..(171): n is a, c, g, or t
tcagtacagatcgtcacgaccggtgctcgatttagctgcgtcacgatctctcttggggcagagctcgtggggaggaactgctcagttaggacccagacggaaccatggaagccccagcgcagcttctcttcctcgtgctactctggcctccgaggaccacgtggaagaacngtgatgacgacagtcctccagcctatcctgtctgtcgtcctacggaggggacacgaccgccctaccctcctccgtcgcgacgggccagtcaagtacttacttacgacctaacgtacgtaccgtggtactcgagtaccgaacgtaaccgtggtacgacggtccctacccgtacggtcctcctactacgttactaggtcggtactacgacctacccgaccggaccggtacctacgtacggtacctaccggtacgaccggttacggtaccgtaggtcggacgtacgggtcggtacggtacgggtaacgtacgttacgtaccgtaccgtcctaccgaaccgtacgtaccacggtccaaccggtcgtaccgtacgtaccgttcgtaacggtacttcgttagttaccgttacgtttaacgtttacttcggtattaccgagttaccgttaagttcgtacgttaaccgtacgtccggttaacccgggtcggtttaacggtcccggtaacggtaacccggggttaacgaaccggtacggtaacggttaaccggtaccgttaaacgg

SEQ ID NO: 189825 - DNA, 831 bp, Homo sapiens
  misc_feature: GYAE6OF02G46CF.35.36.D03.1.454.CMB.1.raw
tcagtacagatcgtcacgaccggtgctcgatttagctgcgtcacgatctctcttggggtctgagagaggagccttagccctggattccaaggcctatccacttggtgatcagcactgagcaccgaggattcaccatggaactgggctccgctgggttttcctgttgtctttttagagtgtccagtgtgagtgcagcgtggtggagtcgtgggggagcctggtacaaggcctggagacgtcccgtggacgacttcctccgtggttagtacgcccttgtacggtactttacctacctttacaaacgttattaggtaactacggtacctaattacggtacccggtcgggggtcccaccggtaacgggtccgttcccggtaggggggtaaacggggtcgtgggggttaacggttcgggggttccttacgtaacgtttccggttaaggtttacggggtaaaaggtttggttttacggttttaggttttaactaacgtaattttaagttaagttacggggacggtaccgggtcggggggttacgggggggacccttagtttacccgaaacctagttacccgtacgaaaggtaacgtaaacccaaccgaccggtaaacgaccgtacgttaacgtttactttccgagtaactaacgtacgaacgtacgtcctagggaccgtaggtaaaccgaacgggtaccgaacggttaccggttaggtttaacggtaactttacgggttacggtacggtaacgggtaaggttacgggaacggggttaccggggtaccggttaccccggggtttacccccggggtttaccccccgggttttaacgggg

SEQ ID NO: 189826 - DNA, 788 bp, Homo sapiens
  misc_feature: GYAE6OF02G1HBO.35.36.D03.1.454.CMB.1.raw
  modified_base (192)..(192): a, c, t, g, unknown or other
  misc_feature (192)..(192): n is a, c, g, or t
  modified_base (234)..(234): a, c, t, g, unknown or other
  misc_feature (234)..(234): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgctggtttcctgttgtctttttagagtgtccagtgtgaggtncagctggtggagtcgtggggaggcctgggtcaagcctggagngtccctgagctctcctgtgtagcctcgtggacttccacctttacaatagtggtaataggctatcggtaccgttcgggtcccgaccgaggccttccggaggggtaacggggcttcggggaaggttcggggtctccgtaagttcttaacggtttagggaaagtttagggttcgttttagtttttaaagtaccgttaatttaaacgtttaacggttggggaacggtaccggggtaccgggggttcggggggggtacccgtaacggtttacccgaacccggtaacgttcccgttaaccgaaggtaaccggaaccgtaaacccggtaccgaaaacggtaaccggtaacgtaacggttacgttttacctacggtaaccctaaaagttacggaaaccgacggacccgttacgggacgtaaacgggaaccggtaacgggaacccgaccgggtacgttaacgttcggtttaaacgtttacggtacggtcgggtaccgacggtaaggttacgggagggtacccggtaccgggtttaccccgggtaccccccgggtttttaaggg

SEQ ID NO: 189827 - DNA, 781 bp, Homo sapiens
  misc_feature: GYAE6OF02JH5EW.35.36.D03.1.454.CMB.1.raw
  modified_base (249)..(249): a, c, t, g, unknown or other
  misc_feature (249)..(249): n is a, c, g, or t
tcagtacagatcgtcacgaccggtgctcgatttagctgcgtcacgatctctcttggggtctgagagaggagccttagccctggattccaaggcctatccacttgggtgatcagcactgagcaccgaggattccaccatggaacgtggggcctccgcgttggttttccttgttgtcgtttttagaggtgtccagtgtggagtgcagcgtgggtgagtcggtggggacgccgtggtcaggtcctggaacgngtcccgtgacgtaccttcctccgtagtcggtactcccttgttcggtaacttcctaaccttgtaaattagtagttacttaaagctaagttaccgtacccggtccggtccggccacgggcccttaccgggttagggggacggtccgttgggacggttcggtactcgtagttacgtaggtttggaagttggttttagtttgtttatacgtatttagttaggaggtcgacggggtacgggggtcggggtacgtacttaccggaccctacgacccgtcggaaaggtaaccgtaacccgaaccgaaccgaaacggtaccctaacggttacgttaacgttccgttaagaacgttaaccgtaacggaaccctagtacccggttagaacccgggtaacgaaccgggttaaccgggacgtaaccgggtacgttaacggttagtacgtttacggaggtaaccggtaccggtaagggaacggttacgggtaaccggggtacccgtttaccccggggtttccccggtttacccccggggttaggg

SEQ ID NO: 189828 - DNA, 771 bp, Homo sapiens
  misc_feature: GYAE6OF02H1H51.35.36.D03.1.454.CMB.1.raw
  modified_base (323)..(323): a, c, t, g, unknown or other
  misc_feature (323)..(323): n is a, c, g, or t
  modified_base (701)..(701): a, c, t, g, unknown or other
  misc_feature (701)..(701): n is a, c, g, or t
tcagtacagatcgtcacgaccggtgctcgatttagctgcgtcacgatctctcttggggtctgagagaggagccttagccctggattccaaggcctatccacttggtgatcagcactgagcaccggaggattcaccagtggaacgtggggctccgcttgggttttccttgttgtcttttttaggaaggtgtccagtgtggaggtgcagtcgtgggtggagtcggtgggggacgccgtagggtacaacgtcgtaggacgacgttcccgtggacgtacctccttccgtaggttgtaccggtccttcgtggtacttccgtaaccttnaagttacgttagtaagtcgactagttacggtacccggttgggtacccctccggacggtcccgtccgggtaggggtaacgggggtcctaggggtacgggttcgggttctacgtcgttacgttagttaacggtaaggttgtttacgttttagtttaacgtaacgtagtttaagttaagtagggaccgggtacgggggtgggggttaccgggggccttaacggttaccgtaccgtaattccgtaccgaaaggaccgtaaacgaacgtaaccaaacggtaccgtactaggttacgtttacgtacgtaactaaacgacgtaaacgcgtaccgtggaaccgtacgacggaacgacgtacggtcgttaggtagttacgttaccgnggtagaccggtaggtagggtaccggacgggtaccggttaccgggtttccccggttaccgggttaaccggg

SEQ ID NO: 189829 - DNA, 650 bp, Homo sapiens
  misc_feature: GYAE6OF02HEZY5.35.36.D03.1.454.CMB.1.raw
  modified_base (166)..(166): a, c, t, g, unknown or other
  misc_feature (166)..(166): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagtacagatcgtcacgaccggtgctcgatttagctgcgtcacgatctctcgttggggcagagctcgtggggagactgctcagttacggacccaggacggaaccagtgggaacgccccagcgcacgtcttcctcttcctcctgctactctggcctccggagaccncgtggaagtaactgtgatagacgctacgtcctacgacgcctactccgtgttcgtgttcgtaccgtacggaggggancggaccnccctacctcgtccgnggacggacggtcagtacacgtactatacgactacgttcgcttagactcgagtacgaacgtacgtgtacgccggtaccncgacgccttccatntacgagtcggacncgtaccaccgacgacgtacatcggtaccncgacgtcgtaggtcaggtacgtggtacggtcggcgtagggacgtacgttacgactacccgttactaccgaccgtaggtcctacgcgtcgccgttagactcggttccgtattcgtttacgttcgttaactttccgtttagtacttacgattaagtactaactttaagcgttaccggtcgtaccggtccgtacgttccgtacgttaccgtacggttcgaccgggttaacgtccgggtagtccggtaggtaaccg

SEQ ID NO: 189830 - DNA, 734 bp, Homo sapiens
  misc_feature: GYAE6OF02JV7QJ.35.36.D03.1.454.CMB.1.raw
  modified_base (119)..(119): a, c, t, g, unknown or other
  misc_feature (119)..(119): n is a, c, g, or t
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
tcagtacagatcgtcacgaccggtgctcgatttagctgcgtcacgatctctcttggggtctgagagaggagccttagccctggattccaaggcctatccacttggtgatcagcactgancaccgagattcaccatggaactggggctccgctgggtttcctgttgtctttttagagtgtccagtgtgagtgcagctggtggagtcgtggggagctggtcaagccgtgggancgtccctgagactctcctgtgtagtcctcgtggacttcaccttcaattntaggtattaggcctagtccgtaccgtcgggtacccgcctagggcccttaccggtagggggtaacggggtccgtagggtggggttgggtccctaagtcgttacgtagtttacgggaagttagtttgggtttatttacagttaacttagttagtagggtagaccggtggggtcggggggtacctacgttaccgaaccctagtcccgttacgagggaaccgaacgaaccggacgaaaccggtacgacgtaagttaccgtttacgacggtaataaacggttacggaaactccggttaccgaaggtacccgggaacggtaccggtaaggtacccgtaacgggtcttaacgggttgtttaaacggttccttcggtaccggtaacgggtagttacggggtaacgtacgggggtaacccctacggggggttttaccccccggtaacccgggttttaacgggg

SEQ ID NO: 189831 - DNA, 836 bp, Homo sapiens
  misc_feature: GYAE6OF02FV9P0.35.36.D03.1.454.CMB.1.raw
  modified_base (325)..(325): a, c, t, g, unknown or other
  misc_feature (325)..(325): n is a, c, g, or t
tcagtacagatcgtcacgaccggtgctcgatttagctgcgtcacgagtctctcttggggtctgagagaggagccttagccctggattccaaggcctatccacttggtgatcagcactgagcaccgaggattcaccatggaactggggctccgctggtttcctgtgtctttttagaaggtgtccagtgtgaggtgcagcgtgggtggagtccggtagggggcggtacccgttggtacaacggcccgtagggaagtcgtaccccttaggaacgtaccttccgttccgtaggtagtacgcccttacgttggtactttcctacccttanaacttattaggtaatacggactacgtcggtaccggttgggtaccccgccgaaggttcccgtaccggtaggggaacggggtccgtagggacggttcgggtcctacgtacttaccgttaagggttaggtaaacggttgtttacggttttagttttaaactaaccgttaagttttaacgtttaacggtaggggtaaacccgggtaccgggggttaccgggggggttaccgggggggtaaccctttaacgggtttaccccgaaaccccggttaagtttaccccgaaaccggtaaaccgggtaaaccggtaaaccccggtaaacccgggaaacccgttaaaaacgggaacccgttacgtttaacgggtttaacctttacggtaacggtaaacctaagttaccggaacgtacgtccgtaagaccgtaagacggacgtacgagtgtacgtcgttaactcggtagtccggacgtagcggtacggacggtccggtaccgggttcccggtacccggttagg

SEQ ID NO: 189832 - DNA, 839 bp, Homo sapiens
  misc_feature: GYAE6OF02G5UYT.35.36.D03.1.454.CMB.1.raw
  modified_base (271)..(271): a, c, t, g, unknown or other
  misc_feature (271)..(271): n is a, c, g, or t
tcagtacagatcgtcacgaccggtgctcgatttagctgcgtcacgatctctcttggggtctgagagaggagccttagccctggattccaaggcctatccacttggtgatcagcactgatcaccgaggattacaccatggaactggggctccgcgtgggttttccttgttgtctttttagaggtgtccagtgtgacggtgcagcgtgggtggacgtcggtgggggacgtccgtggtacaagcctaggagtcgtccctggacgtactctccgngtgacgtcctgtcggtatcctaccttacaagttactaggttacttaacgctacgtacgtaacccggtcggtcccgaaccggcggtccgtcccggtaaggggggaacggggtccgtaagggtacgggggtcggttccgtacgtaacgttaccgttaagggttttaggaaaggtttaggtttacggttttacggtttttaaaacggaccttaagttttaaagtttaacggtacgggtacgggtaaaccggggttcgggggggtaccggggggttaccggttacgttacccggtaaaccgacgtttacccggtacgtaacggtaaaccggaacgtaaacccggtaaccaacgggtaaaccctcgggtaaatttaaccgtttactaacgtaaccgtaaacgtacgtaaaccgacggttaccgaccggaacgggttaaggaaccggtaacggaacctacggggtacttacggtaaggttaaccgtttaaccggtggtaacggtcggtaagggtcggttaacggggaacgggtccggttacccgggttaccgggttacccccgggtttaagggg

SEQ ID NO: 189833 - DNA, 798 bp, Homo sapiens
  misc_feature: GYAE6OF02ITC62.35.36.D03.1.454.CMB.1.raw
tcagtacagatcgtcacgaccggtgctcgatttagctgcgtcacgatctctcttggggtctgagagaggagccttagccctggattccgaaggcctatccacttggtgatcagcactgagcacgaggattcaccagtggaacgtggggcctccgcgttcgggttttccttgtttgttcgtttttttaaggaaggtgtaccagttgtggtaggtgcagtcgtgggtggaggttcggttagggggacggtccgttgggttacgaacggtcccgtgggaagtaccggttacccctaggacgtacctccgtccgttgtacggtacgtccctcgttagggtacttaccgtaacctttactaaagttattaggttaattacgacgtacgtacggttaccggtacggggtcccgtcgacgggtccgttaccgggtaagggggaccggggttgacgggtaggttacgggtctacgacgttacgttaggtttaggtaaggtttacgttttggtttacgttttaactaacgtatttacgttaaggtacgggtaacggtcgggcgggggtacgggggtacccgtacgttacccgacttcgttaaccgaccgaaggaacgaaccgaaaccgtaaccgaaacggacgtacgttacgttaacttttcgaagtaacgtaaacgtacgacgtagacgtagaccgagaccggagaccgtacgtcgttaagtgttacgttaaggtcggaagtacggaacggttaggtcgggtacggtccggtaacccggggtttccccggttaaccggtttacggg

SEQ ID NO: 189834 - DNA, 781 bp, Homo sapiens
  misc_feature: GYAE6OF02F4PA9.35.36.D03.1.454.CMB.1.raw
  modified_base (193)..(193): a, c, t, g, unknown or other
  misc_feature (193)..(193): n is a, c, g, or t
  modified_base (335)..(335): a, c, t, g, unknown or other
  misc_feature (335)..(335): n is a, c, g, or t
tcagtacagatcgtcacgaccggtgctcgatttagctgcgtcacgatctctcttggggtctgagagaggagccttagccctggattaccaaggcctatccacttggtgatcagcactgagcaccgaggattcaccatggaactgggctcgctggtttccttgttgtctttttagaggtgtccagtgtgaggtncagctggtgagttcgtgggggagccgtggtcaagcctaggagacgtccctagacgacctcctcctgtcgtacgcttacctggtactttaccgtaccttactaattagttagttaatcgactagtcgtaccgttcgggtcccnccggaggtcccgttcccggtaggggaaacgggtcgttggggtaacgttcgggtcttaccgtagttaccgttaagttagggtaaagtttacggtttaggttttagttttaaactacgtagtttaagttagtacggggaaacggtcgggtcccggggggtaggggggttaccctacgtttaacccgaaccgttactaacccgttaccgaaacgggtagaaaacccgtaacccggtaccgtaaaacggaaccgttacgtaagttttacctttacgaaggttaaccaaaggttacgaaccacgggttccacgggtaacgtacggaaaccggaacgtaacccgtacggtacgttaggtaccgtttaacctagtttccggtaggacggtaaggtaggtagggtacccgggtagttaccccggggtttaccccgggttccggtttaaacgggg

SEQ ID NO: 189835 - DNA, 837 bp, Homo sapiens
  misc_feature: GYAE6OF02HE4SB.35.36.D03.1.454.CMB.1.raw
tcagtacagatcgtcacgaccggtgctcgatttagctgcgtcacgagtctctcttggggtctgagagaggagccttagccctggattccaaggcctatccacttggtgatcagcactgagcacgaggatcacatggactgggctcgctggtttctgttgtctttttagagtgtcagtgtgaggtgcgagcgtgggtggtagtcggtgggggagtcctgggtaccgaagccgtagggacgtcgttccctgtagacctctccgtggtcgctaacggcccttcgtaaggttacttaccgtacccctttgaagttacgcgttaagtcggaacgtacgttcggaccgtaaccggttcgggggtacccccgaccggacggggttaccccgtaccggaaggggtaaccggtaacggggggttccgttagggggtacggggttacggggttaccgggaccgtttaaggttttacgtaaccgttaagttaacgtaggttacggtaaagtttaacgggggtaaaaacgtttacggtaagggtttaaacgtttaccgttaacgtccggtaaacgtaaccggttaaccggttaagggttaaccgggaaccgggtaccggttaactttacccgaaccgttaacgttacccgtttaaaccgaacggttaaccgaaacctttaaccgttaaacccgaaacggtaaccctaccgggttattacgttaaacgttcgtacgaaactaaaccggtaagtaacccggacgtacgttacggaaacggtcgtacggtaacggaaccggtacgtagggtacgttacggtagtttaacgtacgttacggttaaggaaccgg

SEQ ID NO: 189836 - DNA, 915 bp, Homo sapiens
  misc_feature: GYAE6OF02IOT3A.35.36.D03.1.454.CMB.1.raw
  modified_base (172)..(172): a, c, t, g, unknown or other
  misc_feature (172)..(172): n is a, c, g, or t
  modified_base (242)..(242): a, c, t, g, unknown or other
  misc_feature (242)..(242): n is a, c, g, or t
  modified_base (673)..(673): a, c, t, g, unknown or other
  misc_feature (673)..(673): n is a, c, g, or t
tcagtacagatcgtcacgaccggtgctcgatttagctgcgtcacgatctctcttggggcagagctctggggaggaactgctcagttaggacccagacggaaccatggaacgccccagcgcagcttctcttcctctgctactcgtggctccgaggaaccacgtggaagaaacngtgatggaccgcgtacgtcctaccgagcccgtacttccgtcgttcgtggtcgtccgtaccggaggggganaaggaccgacccctaccccgttccgtacccgtcggaccggaacggggtccctaacgtcgaacggtaaccgtttaacttaaaccggttaaccctaaacgttttaccgaccggtttacgggttactaaccgacggtaaacccgtaaaccggttaaaccggtcgggttacccgtaaccgggtacccggttacccccggtaaacgggtccccttaaccgttaccgtaacgtttaccgttacggtacggttaccgtaaccttaacccgtaaccccgtaacccgggtacccggtaccccgttaaacgggttccggttaacccgtacccggaacggttaccccggttaggttaccgaacgggttcggtacgtacgggggtttccgggtacgggtacgggaactaggtaccgttacgtcctaccgttacaccgttaccncgtaccgccgtaaccgtccgtacgcgtacgttcgtaagtccgttatttccgtttaggttaccgtttaattttacgtttaacgtcgttaacgtacgttacgttaagttacgttagttaccgttacccgggttccggtacccggtttaccggggtaccgggtttacccggttaaccggggaaccgggtaaaccgggtccggttaaacggggtaacccggttaaccgggtacccggttaaaccgg

SEQ ID NO: 189837 - DNA, 915 bp, Homo sapiens
  misc_feature: GYAE6OF02GUP1F.35.36.D03.1.454.CMB.1.raw
  modified_base (154)..(154): a, c, t, g, unknown or other
  misc_feature (154)..(154): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
tcagtacagatcgtcacgaccggtgctcgatttagctgcgtcacgatctctcttgggggtctgagagaggagccttagccctggattccaaggcctatccacttggtgatcagcactgagcaccggaggattcaccatggaactggggctccgnttgggttttccttgttgtctttttagaggtntcagtgtgnggtgcagctggtggagtcggtgggggagtccgtggtcaagccgtgggacgacgttcccgagacgaccttccttccgtaggttcgtacggccttcgtacggtactttacctacccctttacctaagttattacggttaacttacgctaagtaccgggtacccgttcggggttaccccgccggtacgggtccggttaccgggtacggggaacgggggtcgtacggggttacggggttcgggttccgtactacggttacgttaggttagggttaacggtttaggtttcggttttagttttaacgttaacgttaacgttttaagtttaagggttacggggtaacggggtccggggggtaccggggggggttaccgggggggtaaccccttaaggtttaaccccggtaaccgtaaccgttcccggttaaccgaacgggtaaccgaaaccgaaacccggtaaccgaaacgggtaacccttacggtaacggttttaacctttaccggtaacgtaaccgtaaacttacggaaaccgttcgaacccggtcgggtaaccgggaaacgggtaacccggtaaggggacccgtaccgggttacgttaccggttaacggtttaagtttaccgggtttacggtacggttaaccggggagggtacggtacggggttacgggggtacccggttacccggggggttttacccccgggtttacccccgggtttaacgggg

SEQ ID NO: 189838 - DNA, 656 bp, Homo sapiens
  misc_feature: GYAE6OF02JJD7J.35.36.D03.1.454.CMB.1.raw
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
  modified_base (488)..(488): a, c, t, g, unknown or other
  misc_feature (488)..(488): n is a, c, g, or t
  modified_base (538)..(538): a, c, t, g, unknown or other
  misc_feature (538)..(538): n is a, c, g, or t
tcagtacagatcgtcacgaccggtgctcgatttagctgcgtcacgatctctcttggggtctgagagaggagccttagccctggattccaaggcctatccacttggtgatcagcactgagcacgaggattcaccatggaactggggctccgcgttgggttttcccttgttcgtcgtttttttagaaggtgtccagtgtgaggtgcagctggtggagtcgtgggggacgcctggtcaaggccctagggagacggttcccgtaggacgtaccttccgtccgtgttcgtacggccttgtggtacttcaccgttcaattactagtatacgctagtcgacgtcgggccacgtaacggtcgtccggtagggggaagggtcgtggtacggtgggtactacgnttacgtagttaggtagttaggttgtttacgtttaanacgtattaattagtacggtaagtcgggtcggggttacgggggacttagtccaaccgtntaccgtcgagacgacaacgcgaagaccgatacgttattcgagaactaagngaaaccgtcgctagaccgtagacggacggacgacggtcttggtagtttacgacgttgagtacggtagacggttaggaagggtccggttaacggttcccgggtttacccgggttaacgg

SEQ ID NO: 189839 - DNA, 698 bp, Homo sapiens
  misc_feature: GYAE6OF02J08KZ.35.36.D03.1.454.CMB.1.raw
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagtacagatcgtcacgaccggtgctcgatttagctgcgtcacgatctctcttggggcagagctctggggaggaactgctcagttaggacccagacggaaccagtggaacgccccagcgcagcttctcttcctctgctactctggctccgaggaaccacgtggaanaaacngtgactgacgcagtctccagccatcctgtctgtgtctcggagggancgacgcccaccctntcctgcgacgggcctagtcagacttagttacgtaacctattacgccgtaggtatcagctaacgtaaccgtggtcgacgtcctaccgtacggcccttccgtactaactctaggtggctacgtacctccgaaccggaccggtacctacgtacggttacctacccgacggtaccgtaacgggttctaacgggtcggacggtacgggttcggggtcggtaacgggtacgtaacgggtaacgttccgtaaccgtccgttaaccgaccctagtacccgtacgtccgacgtacccgtagtccgtacgtcgtgtacgttcgttacgtttacgtacgtttaacgtttgttacgtacgtaccgtagtcttaagtttacgacgttaacgttacggtccgtccggttacggtaccggtaccggtacccggtaacgtaaccgggtaaccgtagggtaccgtaacccggtacgtaaccgg

SEQ ID NO: 189840 - DNA, 954 bp, Homo sapiens
  misc_feature: GYAE6OF02GKUPB.35.36.D03.1.454.CMB.1.raw
tcagtacagatcgtcacgaccggtgctcgatttagctgcgtcacgatctctcttgggggagagaggagccttagccctggattccaaggcctatccacttggtgatcagcactgagcaccggaggattcaccatggaacgtggggctccgcgttgggttttccttgttgtctttttagaggttgtccgagtgtgaggtgcgagtcgtgggtggaggttcggtaggggggacggtccgttaggtaccaacggtccgtagggaaggtaccggttaccccgtggaaccgtaccttccgttacccgtggttacggttaaccggccctttccggtagggtacttttacccgaccccttttaacaaacgttaagttggttaagttaacggaccgtaactttaccggggtaaccccggttcgggggtacccccgtaccggtaaccggggtacccggttaccggggttaaggggggggtaaacgggggtccgggtttacggggttaagggggtttccggggttacccctacgttagttaaaccggtttaacggtttaagggggttaaaacgtttagggttttcggttttaaaggtttttaaccgtaaacgtttaagttttaaacggtttaacgggttaggggaacgggttaaccgggggggtttccgggggttaacgggggggggtacccttacggtttaacccgaaccgttaccgtttaccgtacccgtaaacggaaaccggtaacccgaaaccggtaacccgaaaacggtaaccgtacgttaaacgtttagtttaacctcgtaaactaacgtagaaaccgtcgacgtacgacgggaacgaacggacgaacgtacggtacgttgtacgttagttacggtggtcgtaacgggaagtagggtcggaacgggttccgtaccggggttccccgggtttacccggttttagggccgggttaccggg

SEQ ID NO: 189841 - DNA, 877 bp, Homo sapiens
  misc_feature: GYAE6OF02G76GT.35.36.D03.1.454.CMB.1.raw
  modified_base (194)..(194): a, c, t, g, unknown or other
  misc_feature (194)..(194): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactggggctccgcttgggttttcctgttgtctttttagagtgtcagtgtgaggtncagctggtggagtcggtgggggagccgtggtacaagccgtgggatcggtcctggacgtacctcctccgtggtgtacgtccgtcgtcggtacttccgtaccttactaacttaagttgtaagttacgcctaagtcggtacccggttcgggtcccggcccgacgggtccgtccgggttagggggaacgggggtcgtggggtacgggttcgggttccttccgtactttacgttaggttttaaggggtaaaggtttcggttttagggtttttacggttttaaattaaaccgttaagtttaacgttttaaggtacgggggtaaacgggtaccgggggttccgggggggggttaccggggggtacccgttaacggtttaccccgaacccgtttaccgttacccggtaaccggtaagtaaccgggaaacccgaacccggaaccgtaaaacccgggtaaccggtactaaaccgtttacttttaccggactaacgtaaacgttaaaccggaacgtaaccggtccgttaacggacggtaaaccgggaacggtaaacgggacccgacgggttcgttacggttaccggtttaagtttaccggtcggggtacgaacggtaacggggttaaggtacgggtacgggggtcccggtttaaccccggggtttaccccgggtttacccccggtttaacgggg

SEQ ID NO: 189842 - DNA, 810 bp, Homo sapiens
  misc_feature: GYAE6OF02F9Q92.35.36.D03.1.454.CMB.1.raw
  modified_base (196)..(196): a, c, t, g, unknown or other
  misc_feature (196)..(196): n is a, c, g, or t
  modified_base (319)..(319): a, c, t, g, unknown or other
  misc_feature (319)..(319): n is a, c, g, or t
tcagtacagatcgtcacgaccggtgctcgatttagctgcgtcacgatctctcttggggtctgagagaggagccttagccctggattccaaggcctatccacttggtgatcagcactgagcaccgaggattcaccatggaactgggctccgctggttttccttgttgtctttttagaaggtgtccagtgtgaggtgnagctggtggagtcgtggggacgccgtggtacaagccgtaggagacgtcccgtgagacctctccgtgtgtacgctcctggtacttccacttcaatctagtatagcactcgaccgtcgggtcccncgacggtccgtccggtaggggaacggggctaggggaggttcgggtcctacacgtttacgttaaggttagggtaaacggttgtttacgggttttatttttaacgtaacttaagtttagtttaaaggtacgggtaacgggaccggggttcggggggtccggggggtacccgtaacgtttacccgtaacctacttacccgtaaccgaagggtaaaccgtaacccgaaccgaacgaaaccggtaccgaaccgttaacgttacgtttaccgtacgaaaccgtaaaacgtacgtaaacccgtacgtacgtaccggtaaccgggaaacggaacccgggtaagaaccccgggtacggttaccggttacggtttaagggtttaaccctttacgggttacggtaacggtacggttaacgggtaggggttaaccggggccggggtttaaccgggtacccggggttttaccccccgggtttaaccccccggggttttaggggg

SEQ ID NO: 189843 - DNA, 443 bp, Homo sapiens
  misc_feature: GYAE6OF01D1B03.39.39.D06.1.454.CMB.1.raw
  modified_base (438)..(443): a, c, t, g, unknown or other
  misc_feature (438)..(443): n is a, c, g, or t
tcagtcgcactagtcacgaccggtgctcgatttagtgacatctcgcagttctttgggttttgggggaagaggaagactgacggtcctgccacaggtggtgctgggcacgggggcaccaactacaatgcgtccctcaggggtcgagtcaccatatctgcagacaagtccaagaaccacttctccctgaggctgacctctgtgaccgccgcggactcggccatatattattgtgcgagagtttttgcaggatcttggggcggtatcgacgtctggggtcaagggatcacggtcatcgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnnn

SEQ ID NO: 189844 - DNA, 488 bp, Homo sapiens
  misc_feature: GYAE6OF01EU6OE.39.39.D06.1.454.CMB.1.raw
  modified_base (482)..(482): a, c, t, g, unknown or other
  misc_feature (482)..(482): n is a, c, g, or t
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgagtctttcgtcggccctgagggtttctagtcgcttctccggctcaagtctggcaacacggcctcctgaccatctctagctccaggctgaggacgagctgactattatgcagctcatatactgaagtcaatggtatccatggctggtcggcggaggaccaaggttgaccgtctaggtcngacccg

SEQ ID NO: 189845 - DNA, 590 bp, Homo sapiens
  misc_feature: GYAE6OF01DTB33.39.39.D06.1.454.CMB.1.raw
  modified_base (271)..(271): a, c, t, g, unknown or other
  misc_feature (271)..(271): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcacgccgaccccgtaaattcttaaatttagtggtacgtttcgttcggtccgtcctcggttacggttcgtacgtctcttcgcgtctactagtcgtcgacaacgaccgtcctccgtacgacctactcctactacgtacctccgacgtcgtacggaacggacggtacggtctacgtaactttagtttacgttcgacgtcgtctacgtattactacgtagtaacgtacgtaagttacgtacctacgtacgttcggtcgttaggttcgggacgggtaccgaagttacggtcgtaccgtgttacgtccgcgtaccg

SEQ ID NO: 189846 - DNA, 510 bp, Homo sapiens
  misc_feature: GYAE6OF01BL08M.39.39.D06.1.454.CMB.1.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaatcttaattatgagtctttcgtcggccctgagggtttctagtcgcttctccggctccaagtctggcaacacggcctccctgacccatctctacgacctccgaggtctggagggacgaggcctgacttattattgcagctcattatactgaacgtcaagtggtactccagtggcttggttcggcggaggacctagttcgacccgtctaggtcacgtacccg

SEQ ID NO: 189847 - DNA, 496 bp, Homo sapiens
  misc_feature: GYAE6OF01DH7ZZ.39.39.D06.1.454.CMB.1.raw
tcagtcgcactagtcacgaccggtgctcgatttagtgacatctcgcagttctttggggggtctcaggaggcagcgctctcaggacatctccaccatggcctgggctctgctgctcctcacctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcatttcaggcagcgccccgaaactcttaatttatgaggtctttcgtcggcctcagggtttctagtcgcttctcggctccaagtctggcaacacggcctccctgaccatctctagactccaggctgaggacgaggctgacttattattgcagctcatatactgaagtcaatggtatccatggtctggttcggcggagggaccaagttgaaccgtctaggcagacccg

SEQ ID NO: 189848 - DNA, 496 bp, Homo sapiens
  misc_feature: GYAE6OF01DCSZ9.39.39.D06.1.454.CMB.1.raw
  modified_base (490)..(490): a, c, t, g, unknown or other
  misc_feature (490)..(490): n is a, c, g, or t
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgaggtctttcgtcggccctcagggtttctagtcgcttctccggctccaagtctggcaacacggcctccctgacccatctctagactccaggctgaggacgaggctgactattattgcagctcatatactgaagtcaatggtatccatggctgttcggcggagggaccaagttcgaccgtctaggtcngacccg

SEQ ID NO: 189849 - DNA, 486 bp, Homo sapiens
  misc_feature: GYAE6OF01A7N9N.39.39.D06.1.454.CMB.1.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaatcttaatttatgaggtctttcgtcgccctcagggtttcagtcgcttctcgctcaagtctggcaacacggcctcctgaccatctctagactcaggctgagacgagctgactattatgcagctcatatactgaagtcaatggtatccatggctggttcggcggaggacaagttcgaccgttctaggtcagtacccg

SEQ ID NO: 189850 - DNA, 631 bp, Homo sapiens
  misc_feature: GYAE6OF01DNNO5.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgccccgaaactcttaatttatgaggttctttcgtccggtcctcgtacgggtttctagtcgtcttcgtccggctccaagtcgtcggtcaactaccgggcccttccctcgaccctactcctactacgtaacctccaaggtccttggacgggacgagggccttaggtaacctttattactttcggctaggtcctactaattacttaacttaggtaaagttctaaacgttacggttactaccctaacgttcgggtccgttacgggtttaccgggaccgggtaaacggggtaaccttaaacggttcgggtaacccgttacccggtaagggtcccgaacggtaacccccggg

SEQ ID NO: 189851 - DNA, 615 bp, Homo sapiens
  misc_feature: GYAE6OF01BV9EY.39.39.D06.1.454.CMB.1.raw
  modified_base (267)..(267): a, c, t, g, unknown or other
  misc_feature (267)..(267): n is a, c, g, or t
tcagtcgcactagtcacgaccggtgctcgatttagtgacatctcgcagttctttggggggggtctcaggaggcagcgctctcaggacatctccaccatggcctgggctctgctgctcctcacctcctcactcagggcacagggtcctgggcccagtctggcctgacacagcctgcctccgtgtctgagactcctggacagtcgatcaccatctcctgcactggaaccagcagtgacgttggtgcttatattatgtctctgtccaacngcattcaggcacgccgaccccgtaaactctttaaatttagtgtacggttccttttcgtccggtcccttcgtaggggtttcctaggtccgtctttccgtcccggtctaccgaagttccgtggacctaaaccgaccggtcccttccctcgaccctacttcctactacgacctccgacgggtcctaggacggaccgtaggtcctaggtaaccttatttattcgacacgtccttctaattttcgactaattcgtagtacgtaggtctttagtcgttacgttacgggtaaggtacgggtaacctaagggtctacgttccgtaccgttaaggtccgaccggcccgtaaacccgg

SEQ ID NO: 189852 - DNA, 509 bp, Homo sapiens
  misc_feature: GYAE6OF01BSO4P.39.39.D06.1.454.CMB.1.raw
tcagtcgcactagtcacgaccggtgctcgatttagtgacatctcgcagttctttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgccactggaaccagcagtgacgttggtgcttataattatgtctcctggttccaacagcattcaggcagcgcccgaaactcttaatttatgaggttctttcgtcggccctctagggtttctagtcgtcttctccggctccaagtctggcaacacggcctccctgaccatctctagactccaggctgagacgaggctgactattattgcagctcatttgactaatcagtgaggtcttatgttcgttcggaagttcgggaccaaggtcagttcgtacctaggtcagcccgtaaacgg

SEQ ID NO: 189853 - DNA, 556 bp, Homo sapiens
  misc_feature: GYAE6OF01A3T2E.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaatcttaattatgagttcttcgtcgcctgagggtttctagtcgcttctccggctccaagtctggcaacgacggcctcctgaccatctctagacctccaggctgaggacgaggctagacttattatgcagctctaatattactagtaagtacaagttcgtaacttacccgaacgttgggtccttgggtttcccggggacgggtaacggggtaccctaaagggtttccggaacccgttaccgttaacgggtccaacggtaaccccgg

SEQ ID NO: 189854 - DNA, 537 bp, Homo sapiens
  misc_feature: GYAE6OF01AXX0O.39.39.D06.1.454.CMB.1.raw
  modified_base (305)..(305): a, c, t, g, unknown or other
  misc_feature (305)..(305): n is a, c, g, or t
tcagtcgcactagtcacgaccggtgctcgatttagtgacatctcgcagttctttgggtggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgccactggaaccagcagtgacgttggggttatgactatgtctcctggtaccagcaatatccaggcacacgccccaaatcatcatttangagtcagtactcggcctgtagggttctaagtcgtcttctctcgctcaagtctgacaacgccgcctccgtgacctatctcgtggcctaccgagcgtaggacggacgaggtctagtacttagttactgactacgtcttacgtagtttacgactaacgtcgaggttgacggttcttagtcggttcgtacgggtaaggttcgggaacctaaggtactacgttccgtaccgttacgg

SEQ ID NO: 189855 - DNA, 460 bp, Homo sapiens
  misc_feature: GYAE6OF01EWBZW.39.39.D06.1.454.CMB.1.raw
  modified_base (445)..(460): a, c, t, g, unknown or other
  misc_feature (445)..(460): n is a, c, g, or t
tcagtcgcactagtcacgaccggtgctcgatttagtgacatctcgcagttctttggggggaagaggaagactgacggtcctgccacaggtggtgctgggcacggcgggcaccaactacaatgcgtccctcaggggtcgagtcaccatatctgcagacaagtccaagaaccacttctccctgaggctgacctctgtgaccgccgtggactcggccatatattattgtgcgagagtttttgcaggatcttggggcggtatcgacgtctggggtcaatggatcacggtcatcgtctcctcagcctccaccaagggccccatccggtccttccccctgggccgccctgcctccaggacgccacctccgagacgcacgagccggccctgggctgcctggtcaaggaccttactccactagtgcgactgagcgggctggcaggcgcatagnnnnnnnnnnnnnnnn

SEQ ID NO: 189856 - DNA, 578 bp, Homo sapiens
  misc_feature: GYAE6OF01C4K2W.39.39.D06.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacggttggggtatgactatgtctccgtggtaccagcaatactaccgaggccacaccgaccccaaatcatctatttagngagtcaagtaagtccggtacctacgtagggtttactaactcgtacttcgtctggtcctaccgaagtcctaggacctaacgccggtcccctacctcgaacctctcctcgtcggtcctaccgaggtctagggaacggacgtaggtccttagtaatttactacgtacgcgtaacgtcttactagtttcgactaagtcgtaagtgtacgtctttagtacgttcgttacgggaagtcgggaactaggtactagttccgtacgtaggtacccg

SEQ ID NO: 189857 - DNA, 518 bp, Homo sapiens
  misc_feature: GYAE6OF01A8XBR.39.39.D06.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctcctggttccaacagcattcaggcagccgccccgaaactcttaatttatgtaggtctttcgtcggccctgagggtttctagtcgtcttctccggctccaagtctggcaacacggccctccctgacccatcctactacgactccgaggctggacggacgaggctagactattatgcagctacatatactgaatcaatggtactccagtggcttggttcggcggaaggacctaaggttcgaccgttactaggtccagtacccg

SEQ ID NO: 189858 - DNA, 584 bp, Homo sapiens
  misc_feature: GYAE6OF01DUZT4.39.39.D06.1.454.CMB.1.raw
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcagccgaccccgaaattcttaatttngagttcttcgcgtcctgtaggtttctagtcncttcgtccggctcaagtctggacaacgacggtccctcctcgacctatcctctacgactccgaggtctaggacggacgaggtctagaccttaatttagttcgactacgtctaccaattactaacgtagtaaacgttctaaagttggttaactacccgtaagttcgggtaccgttgggttccgggacgggtaacgggaacccgttaaggttaccggacccgttaccgtacgggtcgacggtaaccccgg

SEQ ID NO: 189859 - DNA, 663 bp, Homo sapiens
  misc_feature: GYAE6OF01A9FS5.39.39.D06.1.454.CMB.1.raw
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgggtctcgtaggacagtcgatcaccatctcctgcactcggaaccngcagtgtacggttggggttatgactatcgtctccgtggtaccagctaatatccaggcacgacgaccccaatcactctatttatgacggtanaagtaactccggcctacgtacgggtttactaacgtccgtactttctcgtcgaccttaccgtaacgtcgtacggacctaaccgaccggtccctacccgtacggaccctacgttccgttcggtcgggtcctacgacggtacgtacgggacggaacggacgggtccttaggtaacttacgttacgcgtaactacgtccgttacttacgtttacgactagtaccgtaggttacggtacgttacgttttacggtcggtttacggttaccgggtaacgggttacccgggtaaaccgttaacggttccgtaacgttaccggtacccggttaaggtcccgtaaacccggg

SEQ ID NO: 189860 - DNA, 682 bp, Homo sapiens
  misc_feature: GYAE6OF01DRHHE.39.39.D06.1.454.CMB.1.raw
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatctcctgcactggaaccngcagtgacgttggtgcttataattatgtctctgttccaacagcattcaggcacgcccgaccccgaaattcttaaatttagngtacggttcctttcggccgtcccgttcggtacgggtttctaacggttccgtcctttccgtcccggtacttaccgtaacgtcgtacggaccaaccgtaccggtcccttacccgtacgaccctagttcctacgtacgaccttccgacggtctaggacgggacgaggtctagtaccttatttacgttcgacgtacgtcttactaacgtttacttaacgttaggaaacgttacgaaacgtttgggtaacctacccgtaacggttcgggttccgttacggggtttaccgggaccggggtaaaccgggtaacccttaacgggttaccggaaccccggtttacccggtaacgggttacccgaaccgggtaacccccgg

SEQ ID NO: 189861 - DNA, 545 bp, Homo sapiens
  misc_feature: GYAE6OF01CXHIX.39.39.D06.1.454.CMB.1.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
  modified_base (520)..(545): a, c, t, g, unknown or other
  misc_feature (520)..(545): n is a, c, g, or t
tcagtcgcactagtcacgaccggtgctcgatttagtgacatctcgcagttctttgggttttggggggaagaggaagactgacggtcctgccacaggtggtgctgggcacggggggcaccaactacaatgcgtccctcaggggtcgagtcaccatatctgcagacaagtccaaagaaccacttctccctgaggctgacctctgtgaccgccgcggactccggccatatattattgtgcgagtagtttttgcaggtatcgttggggcggtatcgacgtcgtggggtcaagggatcacggtcatcgtctcncacgcctccaccacgggcccacgtccggttccttcccccgtgcccgccctgcctccaggacnccgaccgtcgaagacgccacgcggccggcccgtcgggtctcgtccgttaggaccgtaacggtaccttacccgttccctaaccgttaggttcgacccggtacgtcggggacggccggggtactcgggacgtaacgggccacgtagtacggnnnnnnnnnnnnnnnnnnnnnnnnnn

SEQ ID NO: 189862 - DNA, 697 bp, Homo sapiens
  misc_feature: GYAE6OF01BT2JR.39.39.D06.1.454.CMB.1.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
tcagtcgcactagtcacgaccggtgctcgatttagtgacatctcgcagttctttgggggggggtctcaggagggcagcgctctcaggacatctccacatggcctgggctctgctgctcctcacctcctcactcgagggcacaggtcctgggcccagtctggcctgacacagcctgccctccgtgtctgtacgacctccgtgggaacagtccgactcaccatctcctgcacgtggaaccngcagtgtacgttggtntcttataattatcgtctctggttaccaacngctattcaggtcagccgacccgtaaattcttaaattgcgtacggttccttacggccggtcccttggtacgggtttctacggtccgtcgttccgtccggtctaccgtaaggttctacgggacctaaaccgtccggtccctccgtacgacctacttcctacgtacgacctaccgtacggtacgttacggacggtacggtacggtacgttacgtacgttaacgtttacgttcgacgtacgtccttaccgttacgttttacgaacttaacgtaccgtacggttacggtacggttaccgtttaacgttacggttaccggttacgggtaacgggttaccggggtaacccgtaacgggttccgtaacggttcccggtaccgttacgggtaccgtaacccggtaacccggtaaaccccgg

SEQ ID NO: 189863 - DNA, 781 bp, Homo sapiens
  misc_feature: GYAE6OF01DEOG7.39.39.D06.1.454.CMB.1.raw
tcagtcgcactagtcacgaccggtgctcgatttagtgacatctcgcagttctttgggggggtctcaggaggcagcgctctcaggacatctccaccatggcctgggctctgctgctcctcacctcctcactcaggcacagggtcctgggcccagtctggcctgacacagcctgcctccgtgtcctgagacctcctggacagtcgatccaccatcctcctgcacgtcggaaccagcagtgtacgttggtgtcttaataattatgtctcctgtaccaacagtctatcagtcacgccgacccgtaaattctttaattagtaggtagtttccgttccgtccggtacccttcggttacgggtttctaacggttccgtccgtttcccgtcccggtctaccgtaaggttccgttacggaacctaaccgtacccggtcccttacccgtacgtaccctaacttccgtactacgtacccgtaccgtaacgggtccgttaacgggaaccgggtaccggtacggtaccgttaacggtaaccttttaagttaacgtttccgaacgtaacgtaccgttactaaagttaaccgttaacgtacggttaaacgtaccgttaaacgttacgggttaaccccttaccggtaacgttcccgggttaccggttttaccgggggttaaccccggggtaccgggggtaaaaccggggttaacccgtttaaacggggtttaccccggtaacccccggtttaccgggttaaaccgggttaaccccgaaccccgggttaaaccccggg

SEQ ID NO: 189864 - DNA, 524 bp, Homo sapiens
  misc_feature: GYAE6OF01DR5GZ.39.39.D06.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcactggaaccngcagtgacgttggtggttataactatgtctactggtaccaacaacacccagacaaacgccccaaactcatgatttatgaggtcaactaactcggccctctaggggtttctaatcgtcttcctcgtggtctccaagtctggcaacacggcctccctgaccatcctcgtcgggctccgaggctgaggacgaggctagatttaattactgcagcttactatttgactaatcgagtgacgtcttattgtcgttacggaagtggaccaagtcacgttcgtacctaggtcacgccgaaccgg

SEQ ID NO: 189865 - DNA, 556 bp, Homo sapiens
  misc_feature: GYAE6OF01C7H6M.39.39.D06.1.454.CMB.1.raw
  modified_base (169)..(169): a, c, t, g, unknown or other
  misc_feature (169)..(169): n is a, c, g, or t
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (542)..(542): a, c, t, g, unknown or other
  misc_feature (542)..(542): n is a, c, g, or t
tcagtcgcactagtcacgaccggtgctcgatttagtgacatctcgcagttctttggggggggtctcaggaggcagcgctctcaggacatctccaccatggcctgggctctgctgctcctcacctcctcactcagggcacagggtcctgggcccagtctggcctgacacngcctgcctccgtgtctgacgactccgtggaccagtcgatcaccatctcctgcactggaaccngcagtgacgttggtgtacttataattatgtctctgttccaangctattcaggcagccgaccccgaattcttaattatgtagttcttcgtccgtcctgtgggtttctagtcgcttcgtcgcctcagtctgcacaccggcctctactcgacctattcctacgtacgtacctccgaggtccttgacgggacgagtctagtacttagttattcgactacgtctactatactacgtagagtctaagttcgtactaccgtagtcggtcttcgggttccgggagggtaacggacctaagggttaccgtaccgttacgnggtacgtaacccgg

SEQ ID NO: 189866 - DNA, 759 bp, Homo sapiens
  misc_feature: GYAE6OF01D6CD0.39.39.D06.1.454.CMB.1.raw
tcagtcgcactagtcacgaccggtgctcgatttagtgacatctcgtcgtaggttcgtttggggggggtctcaggagggcagcgctctcaggacatctccaccatggcctgggctctgctgctcctcaccctcctcactcgagggcacagggtcctggggtcccagttctggcctgacacagcctgcctcgtgtctgagacgtccgtggactagtcgatccaccgtatcctcctcgcctacgtacggaaccagcgaggtcggtacgtttcggtgtactttaattaatttagtgttcctccgtttcggttaacccaaacacggtactaacgtttacggacgggcctacggacccgtaccccggtaaattaccgttaaatttagacggtaacgttccgtttacggtccggtaccgttacggttacgggtttactacggttcgtaccgtttccgtcccgggtaccttaccgtaagttccgtacggtaacctaacccggtcccggtacccttacccgtacggaaccctacgttaccgttactaaccgttacccgtaccggaacgttaccgtaacgggaagggtaccgaacggtaccgttacgtaagttaacttttagacgacgtaccgtaacttccggtaaatttacgttaacgttacggaacgttacgtaaagttcggtaaccttccgaaggttagtcggtagggttcggacggtacggtacgtaaggttccggtaccgttacggtacgtccgacgtacccgg

SEQ ID NO: 189867 - DNA, 544 bp, Homo sapiens
  misc_feature: GYAE6OF01DWMAV.39.39.D06.1.454.CMB.1.raw
  modified_base (271)..(271): a, c, t, g, unknown or other
  misc_feature (271)..(271): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgccactggaaccagcagtgacgttggtgcttataattatgtctcctgttcaacngcattcaggcagccgaccccgaaactcttaatttatgtaggttctttcgtcggccctcgtagggtttctagtcgcttcgtccggtctccaagtctggcaacgcgcctcctgaccatctctagctcaggctgaggacgngctgacttattatgcagcctanattactactagtaagtcaagttggttactcctaagttgggtccttgggttcgggcgggaacgggtacccgtaaggttccggaacccgttccgtaacggtccacggtaccccgg

SEQ ID NO: 189868 - DNA, 529 bp, Homo sapiens
  misc_feature: GYAE6OF01CLRUF.39.39.D06.1.454.CMB.1.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacggttgggggttatgactatgtctcctggtaccagcaatatccaggcacacgcccccaaactcatcatttangagtcagtaactcggcctcgtaggggtttctaatcgtcttctctgctcagtctgcacgcgcctcctgaccntctcgtggctccaggtctgacggacgaggtctgtattattacgtgcagtctactatttacgctaatcgaggtcgaggtactttacgtcggttacgttacgggaaggttacgggaccctaagggtacctagttccgtccgtaaggtacccg

SEQ ID NO: 189869 - DNA, 730 bp, Homo sapiens
  misc_feature: GYAE6OF01DWOVH.39.39.D06.1.454.CMB.1.raw
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgtacgttggtgtacttaataattatgttaccttccgttggttaccaaancgactattcgaggccacgcccgaccccgtaaattcttaaatttgtgacggtttcctttccggccgtccgttcggtacgggtttctacggttcgtctttaccgtccgtctaccgtaagtcctacgggacctaaccgtacccggtcccttacccgtagaaccctacttccttacgtaacgacccttccgacggtcgtacgggacggacggacggtctacggtaactttagttattcggacctagtaccttacaatttaccgtaacggttacgtaaacgttctaaacggttcgggttaaaccttcccggtaaacggtttcggtaccggttttacggggttacccggggtaaaccggggtaaccggggttaaaaccccgttaacggggtttccccgggaaccccggtttacccggttaaccggggcccgtaaacccgggtaaacccccggg

SEQ ID NO: 189870 - DNA, 806 bp, Homo sapiens
  misc_feature: GYAE6OF01DW022.39.39.D06.1.454.CMB.1.raw
  modified_base (272)..(272): a, c, t, g, unknown or other
  misc_feature (272)..(272): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatctcctgcactggaaccagcagtgacgttggtgtacttataattatgtctcctgttccaacngctatcaggcacgccgaccccgtaaacttcttaatttagtggtacggttcttttccggtccggtcccttacggttacgggttttccttaacggttccgtccgtttccgtcccggtaccttacccgtaaggttccgtacgggacctaaaccgtacccgggtccccttaccccgttacgaacccctacgttccctaccgttaacggtaaaccccttcccgtaacgggtaccttacggggaaacgggaccgggtaacggtacccgtttaacggtaaccttttaagtttacgtttacggaccgtaacggttacccgttaactaagttaaacgttacccgtttaacgggtaaaacgttacgtaaacgtttaccgggttaaactccccggtaaaggtttccggggtacccgttttggggttaaccccggggggtaaccgggtaaacccgggggttaaacccctaacggggtttttacccggtaacccccggggtttacccgttaaacggggttcccggaaacccggttaaacccccgggg

SEQ ID NO: 189871 - DNA, 488 bp, Homo sapiens
  misc_feature: GYAE6OF01BVLY9.39.39.D06.1.454.CMB.1.raw
  modified_base (457)..(457): a, c, t, g, unknown or other
  misc_feature (457)..(457): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcagcagcgcccgaaactcttaattatgagtctttcgtcgccctcagggtttctagtcgcttctccggctccaagtctggcaacacggcctccctgaccatctctagactccaggctgagacgagctgactattatgcagctcatatactgaagtcaagtggtatccacgtgctgttcggnggaggccaagttcacgtccaggtcagacccg

SEQ ID NO: 189872 - DNA, 187 bp, Homo sapiens
  misc_feature: GYAE6OF01EBI2N.39.39.D06.1.454.CMB.1.raw
  modified_base (184)..(187): a, c, t, g, unknown or other
  misc_feature (184)..(187): n is a, c, g, or t
tcagtcgcactagtcacgaccggtgctcgatttagtgacatctcgcagttctttgggttttggggggaagaggaagactgacggccctgctccaggagcacctccgagagcacagcggccctgggctgcctggtcaaggactacttccactagtgcgactgagcgggctggcaaggcgcatagnnnn

SEQ ID NO: 189873 - DNA, 614 bp, Homo sapiens
  misc_feature: GYAE6OF01DSJF7.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcacatctcctgcactggaaccagcagtgtacgttggtgtacttaataattatcgttctccttggttaccaactagtacttcgacggtcacgaccgacccgtaaacttctttaaattatggtacgttctttcggcgtcctgtacggggtttctagtcgtcttccgtccggctacgtaagtctacggaccaaacgtccggtccctccgtacgacctactcgtactacgtacctccgaacgtcgtacggaacggtacgacggtctacgtaacttagtttagtcgacgtaacgtctataactagtaacgtagaacttacgtaagttacgtactaccagtcggtacgttcggttacgggacggaacggtacgtaaagttcgaacccggttctaaggtcaaccgtcgtaacgg

SEQ ID NO: 189874 - DNA, 608 bp, Homo sapiens
  misc_feature: GYAE6OF01AHOMG.39.39.D06.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (429)..(429): a, c, t, g, unknown or other
  misc_feature (429)..(429): n is a, c, g, or t
tcagtcgcactagtcacgaccggtgctcgatttagtgacatctcgcagttctttggggggggtctcgaggaggcagcgctctcaggacatctccaccatggcctgggctctgctgctcctcaccctcctcactcagggcacagggtcctggccccagtcctgccctagactcgaggctcgccctccggtgtcctgggtctacgtaggacagtcgatcaaccntccnctgcacgtggaccngcagtgtacgttgggttangtactatgtactccgtggtaccagacaatnaccgtacggccacgaccgaaccccaacgtccatactatttagtgtacggtactagtaagtcccggaccgttacggtaggttacctaagtccgtacttcgtcgtcgtactacgtaactcgtcgacaccgaccgcttacccngtaccacttccgtacgtccggtcctccgacggtcgtacgggacggaccgtaggtccttaagacgtttacctacgtcgacggtattccgtatacttgacctagtacaggtcgtagtcgttacgtcgttagtaacgggtaggtacgtactaaggtcgttacttacgtcgtacgcgtaaccg

SEQ ID NO: 189875 - DNA, 611 bp, Homo sapiens
  misc_feature: GYAE6OF01AYPI2.39.39.D06.1.454.CMB.1.raw
  modified_base (209)..(209): a, c, t, g, unknown or other
  misc_feature (209)..(209): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcatcaccntctcctgcactggaaccagcagtgacgttggtgcttataattatgtctcctggttccaacagctattcaggcacgccgccccgaaacttcttaatttatgacggttctttcgtcgcctcgtagggtttctaatcgctttctcgtcggtctcctaagtcgtggacctaacgaccggtccctcccgtgaccctatcctcgtcgggtctccgtaggctcggtaggtacgtcggtcttagtacttattaacgtgtcaacgttccgtctaagtttcgactaacgtacgtaggtacggtaggtccttagttacggttaccgttacgggtaaacggttcggggaacccgttaaagggttcctaacggttcccggttaaccgtacgggttccgaccggtaaacccccggg

SEQ ID NO: 189876 - DNA, 566 bp, Homo sapiens
  misc_feature: GYAE6OF01A2GHH.39.39.D06.1.454.CMB.1.raw
  modified_base (229)..(229): a, c, t, g, unknown or other
  misc_feature (229)..(229): n is a, c, g, or t
  modified_base (360)..(360): a, c, t, g, unknown or other
  misc_feature (360)..(360): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctggttccaacagcattcagcagcgcccgaaactcttaatttatgagttcttcgtcggccctgagggtttctagtcgcttcgtccgctcagtctggcaacncggcctccctgaccatcctctacgactccgaggtctggacggacgaggcctagaccttattacgtgacgagtccttacaattataacgttgaagtactaaagtcggtactacccagtcgggtcttagggttcccggacggggtacgggtaaccctaaacgggtttccgaacccggttaccgttacgggttccgacggtaaccccgg

SEQ ID NO: 189877 - DNA, 618 bp, Homo sapiens
  misc_feature: GYAE6OF01DJ900.39.39.D06.1.454.CMB.1.raw
  modified_base (328)..(328): a, c, t, g, unknown or other
  misc_feature (328)..(328): n is a, c, g, or t
tcagtcgcactagtcacgaccggtgctcgatttagtgacatctcgcagttcgtttggggggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatctcctgcacgtaggaaccagcaggtcggtacggttggggttatgactagtcgtctccgtaggtaaccagacaaatactaccgaggcaaccaccgaccccaaatcatctatttangagtcagtaacgtccggtcctacgtaggttactagtcgtcttctcgtcgcttacaagtcgtacgacaaccgaccggtccctcccgtacgacctacgttccgtcgcgggtcctaccgaggtccgtaggaacgggacgtacggtactaagttaatttacgtacgtgacgtacgtcttaccttagttcgaactacgtcgtaggtacgtacggttactttaagtcggttagtaacgggtaagggtccgtaaaccggtacgttctacgttacccgttcgtacggtcctaacccgg

SEQ ID NO: 189878 - DNA, 927 bp, Homo sapiens
  misc_feature: GYAE6OF01C8QAU.39.39.D06.1.454.CMB.1.raw
tcagtcgcactagtcacgaccggtgctcgatttagtgacatctcgcagttctttgggggggggtctcaggaggcagcgctctcaggacatctccaccatggcctgggctctgctgctcctcaccctcctcactcgagggcacagggtcctgggcccagtctggcctgacacagcctcgcctcgtgtctgacgactccgtggactagtcgactccacctactcctcctgcaacgtacggaaccagcgaggtcgtacggttggtacgtacttaattaattacgttcgttcccgtttaccgttacggttaaccccaaacgtacggtaccttaacgtttacggtaacgggtaccggtaccccggtaaccccccggttaaaacttttacctttttaaaaggttttacggtacgggtttaacgggttttacccgtttttcccgggtacccccgggttacccccgtttagggtttaaccgggggggtttttccttaaccgggttcccgtttcccgtttcccggtcccggtaccttacccgtaaaggttcccgttacgggtaaccccgtaaacccggtcccgggttacccctaccccggttaacggaaccccttaccgttaccttaaccgtaccgtaacccgttacccggagggtccgttaacgggtaacgggaacggtacgggtaccttaacgtaaacttttagtttacgtaccggtactacgttcctaacggttaacttaaacgttaacgtaaggttaaacgttacgttaacgttaacgggtttaaccctacccgttaaccggttggtacccggtttcgggggtacccgggggaacgggtaaaccgggttaaccgggtttaaccggttacccgggttaaccccgttaacggggttacgaacccccggtaaccggtaccccgggttaacccggg

SEQ ID NO: 189879 - DNA, 697 bp, Homo sapiens
  misc_feature: GYAE6OF01AFA4I.39.39.D06.1.454.CMB.1.raw
  modified_base (141)..(141): a, c, t, g, unknown or other
  misc_feature (141)..(141): n is a, c, g, or t
  modified_base (175)..(175): a, c, t, g, unknown or other
  misc_feature (175)..(175): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (528)..(528): a, c, t, g, unknown or other
  misc_feature (528)..(528): n is a, c, g, or t
tcagtcgcactagtcacgaccggtgctcgatttagtgacatctcgcagttctttgggggggtctcgaggaggcagcgctctcaggacatctccaccatggcctgggctctgctgctcctccacctcctcactcgaggcagngggtcctgggaccccagtcgtcggccctgacacnggcctgccctcgtgtctagagcctccgtggaccagtcgatcaccntcctcctcgcaacgtggaaccngtcagtgtacgttggngtctattaactntagtctcctggttcctanacgtctattcgacgcgtaagcccggtacccctaaagttcctttaacgtttatacgtaggttacctttcgggttcccgtcccgttccgtaggggtttacctgggttacccgtctttccggtcccggtaccttaccgacgttccgacggttccaacgacccgggtcctcccgtacggaccctactccgtcgttaaccgactaccgacgccgttacggacggaccggtgtaccgagtaccgtnttaacgtcgtacacggtctaaccctagttaacgttacctggtaaacctacgtaagttcggttataccgtaacggttcggacggtttgacgggttaccgggaacgggtttaaccgtaaacggttccctaaccggggttcccttaaacgggtcgtaacccgggtaacccgg

SEQ ID NO: 189880 - DNA, 913 bp, Homo sapiens
  misc_feature: GYAE6OF01B8C4Z.39.39.D06.1.454.CMB.1.raw
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagactctggacngtcgatcacatctcctgcacgtaggaaccagcagtgtacgttggntacttaattaattagtcgttccgttccgttagggttacccaaacgtacgtactaacgtttaccggaacgggtaccgaccggtacccccggtaacccccgttaaaacttttaccgtttttaaaagttttaccgtacgggtttaacgggttttccccgtttttccgggtaccccgggttcccccgttacggggttttaccggggttttactaaccgggtttcccgttacccttttcccgggtccccggttacccgttaccgttaaacggttcccgtacggggtaaccctaaacccgggtacccggtccccttaccccgttacggaaccccttacttcccgttacgtaacgtacccttaccggaacggccgttacgggaacgggtaccggtaacggtcctttaggtaacctttaacgtttacgttaccgaccgttaagtcccgttactaacgttaacgttaacccttaaggtaaacgtttaaccgaaaggttttaccgggttaaacttaccccgtaccgggtttacgggtacccggtttacggggtacccggggttaaaacccgggggtaccggggttaaaacccggtttaacgggtttaaaccccggggttaccccgggttaacccggggttaacccgggtaaccccggtacccgggtaaaacccccggg

SEQ ID NO: 189881 - DNA, 987 bp, Homo sapiens
  misc_feature: GYAE6OF01BOH9H.39.39.D06.1.454.CMB.1.raw
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacgagggtcctgggcccagtctggcctgacacacgcctgccctccgtgtctgacgacctccgtggacagtcgatcaccatctcctgctacgtacggaaccagcgagtcggtacggtttggtcgtactttaattaatttacgtcggttccttccgttacggttaacccaaacgtacggtaccttaacgtttaccggaacgggtaccgtaaccggtacccccggtaaacccccggttaaaaacttttacccgtttttaaaagttttaacggtacgggtttaaccgggtttttcccgttttacccgggttcccgggttaccccgttttaccgggggtttaacggggtttttaccgttaaccgggtttcccggttcccgtttacccggtccccgggtacctttaacccggtaaacggtttccgtaccgggtaaccctaaacccggtaccccgggttccccttaaccccggtacggtaaccccttacgtttaccccgttaaccggttaaaccggtaccccgttacccgggtaacgggtacccgttaacggggaacggggtaaccccgggtagggttacccgtttaaaccggttaaaccgttttaagttttaacggtccggtaaaccgttacggttaccctttaaccgtttaagtttaaccggaaccgtttaaacgtacggttaaacgggttcggtaacgggttttaacgttttacggtttacgggtttacccgggtttaaacggggtaaacggggttaccggggtaaacccgttaacgggttaccgttaaccggtttcccggttaaccgggtacggtaacccgaaacccgggtaacccccgggtaaaccccgg

SEQ ID NO: 189882 - DNA, 791 bp, Homo sapiens
  misc_feature: GYAE6OF01BHGHK.39.39.D06.1.454.CMB.1.raw
  modified_base (170)..(170): a, c, t, g, unknown or other
  misc_feature (170)..(170): n is a, c, g, or t
  modified_base (233)..(233): a, c, t, g, unknown or other
  misc_feature (233)..(233): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacngcctgcctcgtgtctgacgactcctggacagtcgatcaccatcctcctgccactacggaaccngcagtgtacggttaggtgtacttaataattatcgttccttccgttacggttaccaaacgtcgtactacgttacgacggtccgaacggcccggtaacccccgtaaactttacttttaaagttttagtacgggttacggtttccgttttaccgggtccggttaccccgttcggtttacggggttttactacggttccgtccgtttccgtcccggtccttacccgtaacggttccgtacggtacccgtaaacccgtacccggtcccccttccccgtaacgtaaccctaccgttacccgtacgttaaaccggtacccctaccggaacggtcccggtagggaaccgggtacgggtacgtaccgttcgtaaccgtttagtttacgtacggactaacgtccttaactacttaaccgttagttacggtaaacgtacgttaaacggtcgttaccgttaccgtaacggttcggttaccggttacgggttaccggggaacgggtaacccggtaaccgttaacggttaccgggtaccgtaccggtacgggtacccgaccggtaacccggg

SEQ ID NO: 189883 - DNA, 955 bp, Homo sapiens
  misc_feature: GYAE6OF01CAGPU.39.39.D06.1.454.CMB.1.raw
  modified_base (182)..(182): a, c, t, g, unknown or other
  misc_feature (182)..(182): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctctcactcagggcacgagggtcctggcccagtctggcctgacacagcctgcctccgtntctgagactccgtggacagtcgatcaccatcctcctgcacgtacggaaccagactaggtgtacggttggtgtactttaataagttatcggttaccttccgttacggttacccaacgtacgtaccgtactttaccgaacggtccgaccggaccccggtaaacccccggttaaactttaccgttttaaaagttttacgtacggttaacgggttttacccgttttccggtacccgggtaccccggtttaccggttaacgggggtttttcctaaccgggttcccggttacccttttcccggtaccccggtaccgttaaccccggtaacggtttaccgtaccgggtacccgtaaaaccccggtcccggtccccctttaaccccggtaaccgtaaccccgtaacgtttacccgttaccgttaacggtaccccgttacccggtaagggtacccggttacggggaaaccggggtaacccgggtacgggttaaccctttagggtaaaccctttttaaggtttacgttaacccgggacggttaacccgtacccgttaaaccgttaaacgttaaccgttaaaccgtttacgggtaaaacccgttacggtaaacggtttacccgggtttaaacctaccccggttaaacggtttaccgggtaccgttttaacgggggtccgggttaaaccggggtaaaccgggttaacccgttaaccgggtttaccgggtaaaccccggttaccccgggtttaaacgggacccgtaacccgggttaaacccccggg

SEQ ID NO: 189884 - DNA, 551 bp, Homo sapiens
  misc_feature: GYAE6OF01D6JS9.39.39.D06.1.454.CMB.1.raw
  modified_base (230)..(230): a, c, t, g, unknown or other
  misc_feature (230)..(230): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacggttgggggtatgactatcgtctcctaggtaccagactaatactccgacgcacaccgaccccaatcatctatttatgagtacagtagtccgacctgtagggttcagtctcttctctgctcgagtctgacacgaccgtcctcctnacctctcgtcgtcggtccncgaggtctaggagacgtacgntagtatttacgtactcgctagtcttatagttgactatcgtacgtgtacggttactttcggttgttaccgttgggaaacggtcgggaaacccggtacggtacgttacgtccggtaccgttcggtaacccg

SEQ ID NO: 189885 - DNA, 729 bp, Homo sapiens
  misc_feature: GYAE6OF01DQAGQ.39.39.D06.1.454.CMB.1.raw
  modified_base (262)..(262): a, c, t, g, unknown or other
  misc_feature (262)..(262): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatccaccatctcctgcacgtggaaccagcaggtgtacgttggtgtacttataattnttagttccttccgtcggttaccaacagtactatttcgaggcacgccgaccccgtaacttactttaatttagtgtacggttcttacgtccggtccttcggtacgggtttctacggtcgtcgttcgtcccggtcttaccgaagttcgtcggtacaaccgtacccgggtccccttacccgtacgaaccctacttaccgttacgtaacgtacccttaccggaacgggtccgttaacgggaacggggtaccggtaacgggtaccttacggtaacctttaagttttaacgttcgaaccgtacgtccttactaacttaacgttacctaacgggtaacttagtaaacgtttcggtaacttacccgtaacggttcggttacgttcggggttacgggtaacggggaaccgggttaacccgtaacggtttaccggtacccggtaccggtttaaacgggtccgaaccggtaaccccggg

SEQ ID NO: 189886 - DNA, 875 bp, Homo sapiens
  misc_feature: GYAE6OF01EL7JN.39.39.D06.1.454.CMB.1.raw
  modified_base (178)..(178): a, c, t, g, unknown or other
  misc_feature (178)..(178): n is a, c, g, or t
  modified_base (751)..(751): a, c, t, g, unknown or other
  misc_feature (751)..(751): n is a, c, g, or t
tcagtcgcactagtcacgaccggtgctcgatttagtgacatctcgcagttcgtttgggggggggtctcaggaggcagcgctctcaggacatctccaccatggccgtgggctctgctgctcctccaccctcctcactcgagggcacgacgggtccgtcggcccagtctcggctgacacncgcctcgcctcgtgtctgactacctccgtaggactagtcgactccacctatccttcctgcctacgtacggaaccaggctaggtcggtacggttggtattactttaattaagttcgttccgttccgttacccggtttacggttaaccccaaagtcgtacgtagttaccggacggaccaccggaccccgttaaacccgttaacttttatttaacggttttagacgggtttccttttccgtttaccgggcccgtttacccgggttaggtttaccggttttacgtccggttcccgtttcgttaccccgtcccgacctttaacggacgtttccgtaaccggaccaaccggtccccggtttaccctcccggtaaccttaccctacgttttaccctaccgggttaacccgtaccggttacccgggaagggtaccgggtaagggtaacccgggggttacgaaaccgggttccctttaaaggtaacctttttaagggttttccggaccgaccttaccgttacccttaagtttaaacggtaacctttaaggttaaccggacgtttaaaccgtcgggtttaaanccccctttaaacgggtcgtttacgggggtttcgttacccggggaaccggggacccgggttaacggtaaacccttgggtaccccgttacggttaccggtaacgaccgggacccttaacccggggg

SEQ ID NO: 189887 - DNA, 772 bp, Homo sapiens
  misc_feature: GYAE6OF01BI5JV.39.39.D06.1.454.CMB.1.raw
  modified_base (224)..(224): a, c, t, g, unknown or other
  misc_feature (224)..(224): n is a, c, g, or t
  modified_base (691)..(691): a, c, t, g, unknown or other
  misc_feature (691)..(691): n is a, c, g, or t
  modified_base (735)..(735): a, c, t, g, unknown or other
  misc_feature (735)..(735): n is a, c, g, or t
  modified_base (764)..(764): a, c, t, g, unknown or other
  misc_feature (764)..(764): n is a, c, g, or t
tcagtcgcactagtcacgaccggtgctcgatttagtgacatctcgcagttcgtttggggggggtctcaggaggcagcgctctcaggacatctccaccatggcctgggctctgctgctcctcaccctcctcactcgaggcacgacgggtcctcgggcccagtcgtggcctacgacacgcgcctcgcctcgtgtctagactcctcgaggacagtcgtaactcaacntccttccgacgacctacgtacggaaacctcgacgtagtcggtacggttggtacgttactttaattaagttcgttcgttccttccgttacggttaacccagtacgtaccttacgtacgacgggacaccggtacccgaaccccgtttaaaatttccgttttaaagtttcggcggtttacccggttttccgttttccggggcccggttacccgtttacgggttaacggggtttttcctaccggttccggtttccccgttaccggtaccccggttactaaccggttacgttaccggtaccgaaacccgtaaacccgggttcccgtccccttaccggtacctaacctcgtttaccgtaaccgttaaccggtaccacggggttacggacgtaaacggggacggtaaccggtgttacccgtaagttaccgtttaagtttcgccgactaacggtactacgtattacccgttaagngtaactacgtacgttacgtcaccgtggtcgttcgtacggtacgnggttaccgagtcgttaccgacttacgcgnccgtaccg

SEQ ID NO: 189888 - DNA, 771 bp, Homo sapiens
  misc_feature: GYAE6OF01EFOQW.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagccctcgcctcgtcgtcgtcggtctcgtaggactacgtctactaccacctactcctccgtgacctacggtaccgaacgacgacgtaggtacggtacggggtttagggtatacggtacttagtcgttaccgtccggtaccggtaccgtagaactaacttacctaccggacggacccaacccggtaacccccgtaacccccctaaatacctaactacctttaatttacggacggtacggtacgttaaacgtacggtcccggttaccgtacgggttacgggtttactaacgttccgttgtttccgtcgtcggtaccctaacgtacggttcgccggaacctaaccgccccggttccctaacccgtacgaacccttcggtaccggttccggtaccgtacccgtcggtaggtacgggtacgggaacgtaccggtagtaccgttaagtttacttcggtacctagccgtacttacgtactttacggtacaactcgtaggagttacgtacggtaaccttttggtcggtttaaccgggtaggtaaacgggtccgggtaaacgttacggtcttaacggtacccggttttacaacgggtccgaaacccccggg

SEQ ID NO: 189889 - DNA, 576 bp, Homo sapiens
  misc_feature: GYAE6OF01DLAHX.39.39.D06.1.454.CMB.1.raw
  modified_base (170)..(170): a, c, t, g, unknown or other
  misc_feature (170)..(170): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
tcagtcgcactagtcacgaccggtgctcgatttagtgacatctcgcagttctttggggggggtctcaggaggcagtgctctcaggacatctccaccatggcctgggctctgctgctcctcaccctcttcactcagggcacagggtcctgggcccagtctggcctgacacngcctgcctccgtgtctgagacctccgtggacagtcgatccacctatcctcctgcactgaaccagctagngtacgttggtntcttataattatgtcctcctgttccaangctattcaggcagcccgacccaattcttaattatgacgttcttcgtccgtcctcggttaggtttctacgtcgtcttacgtccgtcctacgtatcgtgacctaaccgccgtcctccctacgacctattccgtacacggtaccctcgaaggtctaggaacgacggtacggtcctacgtacttagttacttggactagtctacattaacgctagtaacgtcaaagttggtacacctgttagtacgttcggtacgggcgacggtaacttaacgttcgtaacgtcgttacggctaccggaccg

SEQ ID NO: 189890 - DNA, 675 bp, Homo sapiens
  misc_feature: GYAE6OF01DD3ON.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacgaggtcctgggcccagtctggcctgacacagcctgcctccgtgtctgagactcctggacagtcgatccacctatcctcctgccactggaaccagcagtgacgtttggagtcttaataattatgttctccgtaggttccaactagctattcaggcacgccgaaccccgtaattcttaatttagtgtaacgttccttacgtccgccttacgtacggtttcagttcgtcttctcccggactcctaagtcgtacggacctaactagtccggtcctcccgtacgacctatctactagacctacgcggtacgtgaacggtacgacggtctacggtacttattagttcgacgtataccgtataattacgttaactaggttaaccgtactaaaacgttgggttaacccttaccggtaccgttacggggttacctttcgggggtttaccccggggaacggggttaaacccgggtaaaccgtaaccgggttttacccgggtacccccggttttaccgggtaaccgggttaccgtaaaaccccgggg

SEQ ID NO: 189891 - DNA, 733 bp, Homo sapiens
  misc_feature: GYAE6OF01CNOAK.39.39.D06.1.454.CMB.1.raw
  modified_base (199)..(199): a, c, t, g, unknown or other
  misc_feature (199)..(199): n is a, c, g, or t
  modified_base (716)..(716): a, c, t, g, unknown or other
  misc_feature (716)..(716): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcaggcacgagggtcctgggcccagtctggcctgacacagcctgcctccgtgtctgagactctggacngtcgatcacatctctgcactagaaccagcagtgacgttggtagtaacaactatgtctctagaaccaacaaccaccccggacaaaccgaccccgaagtcagtgtatttatcgacgtacaacttaacgccggtcctacggagggttctacgtaagtccgtacttcgtcgtcggtacctaccgtaagttccgtacggaacctaaacccggtacccggtccccttacccgtaacgtaacccctaacgtttcccgtttacggtaccggggtccccttacccggtaacgggtcggttacgggaaacgggggtaaccggtacgggtaacccgttaaggttaacgtttttaaacgttaaccgtcggaacgttacgtaccttaacgtaaactttacgttaaccgaaacgtaccggttaattaaaccgtttccgttacggtttacccggtttacggggaacggtaacgggtaacccgtaagtcccgttacggtacccgttacggtaaccgtacggaccgtaacccgnggtccccgtaccccggg

SEQ ID NO: 189892 - DNA, 771 bp, Homo sapiens
  misc_feature: GYAE6OF01CKZVA.39.39.D06.1.454.CMB.1.raw
  modified_base (502)..(502): a, c, t, g, unknown or other
  misc_feature (502)..(502): n is a, c, g, or t
  modified_base (638)..(638): a, c, t, g, unknown or other
  misc_feature (638)..(638): n is a, c, g, or t
  modified_base (748)..(748): a, c, t, g, unknown or other
  misc_feature (748)..(748): n is a, c, g, or t
tcagtcgcactagtcacgaccggtgctcgatttagtgacatctcgcagtttcgtttggggggggtctcgaggaggcagcgctctcgaggacatcctccaccagtcggccgtgggctcgtcgctcgctcctccacccttcctcacctcgacgggccacggtacgggtccgtcgggacccgtacggtcgtcggcctacgaaccacgaccggtccgtcggtcccgttccggttcgtcgtacggaacgtaccgttccggtacgggaacgtacggtacgactaccacctacgttcctccgtcgaccgacgtacggaacgacggcgtacggttacggtacggtttggttacttactttaaattaagtttcgttcgttaccgttccgttacgtaccaacgtcgtacttacgtacgacggcgaaccgtacccgtaacccgttaatttacgtttaagttcgtcggtttaccggtttccgttccgtcccggtcgttacggtttacggtttcncggttccgtccgttaccgccgtactacggtacgttcgaacgaccgtaccgcccgtctaccacgtacctcgtcgtacgtaccgtacgccggagacggtaggacgggtaccgtcgtaacgttactacgtttaagttcnccgacgttacacgttagaaccgttagtaacgtagttacgtaagtacggttacgtactcgtagggtccggttaggtaccgggacggtacgggaccgttacgcgggttaccncgtacggtcgaaccgcggtcccg

SEQ ID NO: 189893 - DNA, 939 bp, Homo sapiens
  misc_feature: GYAE6OF01CB695.39.39.D06.1.454.CMB.1.raw
  modified_base (176)..(176): a, c, t, g, unknown or other
  misc_feature (176)..(176): n is a, c, g, or t
  modified_base (247)..(247): a, c, t, g, unknown or other
  misc_feature (247)..(247): n is a, c, g, or t
tcagtcgcactagtcacgaccggtgctcgatttagtgacatctcgcagtttcgtttggggggggtctcaggaggcagcgctctcaggacatctccaccatggcctgggctctgctgctcctcaccctcctcactcgagggcacgacgggttcctgggcccagtctggcctgacacngcctgccctccgtgtcctgacgcctccgtggacagtcgactccaccactcctcctgaccacgtcggaaccngcgaggtcggtacgttggtcgtactttaattaacttacgttcgttccttaccgttcggtaacccaacgtacgtaccttacgttcggacgggacctaccggaccccggttaaccccgtaaacttttacttttaaacgtttacgttacgggttaaccggttttccgtttccccgggtacccggttacccggtttacggtttaaacggggtttttcctaccggttcgttcccgtttacccggtacccggttaccttaccggtaacgttccgtacgggtaaccctaacccgggtcccccgtaccctttaccccggtacgtaacccgtaccgtttaccgttaacccttaaccgggtaccccgtaccggtaaccgggtaccgttaaccggggaacgggtacccgtacgggtacgttaaccgttaacgtttacgtttaacggtacgaccgttacggttaaccttacgggtttaaaccttaacgggttaaccggttaaaggtaaaccggtttaccgtaaaacggtttacccgtttaacccggtacccgttaacgggggttaccggtttacccgggtttacccggggggttaacccggggaccgggggttaaacccgggtaaaccgggtttacccgggttaaccccgggttaacccgggtttaccgggtaaccgggtccccgggaacggtaaacccccggg

SEQ ID NO: 189894 - DNA, 716 bp, Homo sapiens
  misc_feature: GYAE6OF01AOFKK.39.39.D06.1.454.CMB.1.raw
  modified_base (146)..(146): a, c, t, g, unknown or other
  misc_feature (146)..(146): n is a, c, g, or t
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
tcagtcgcactagtcacgaccggtgctcgatttagtgacatctcgcagttcgtttgggggggggtctcaggaggcagcgctctcaggacatctccaccagtggcctgggctctgctgctcctcaccctcctcactcgagggcacgngggtcctgggcccagtctggcctagaccacngcctgccctcgtgtctgacgctccnggacngtcatcacntctccngcacgngaacngcagtgcgtgngtcttatatntntctctgtacacgagtctatcgacggctacgacccgaccgtaacttacgtttaattacgtcggtacggtttccgttcgtaccggccgtttacggtacgggtttctacgttcggtcttccgtcggtcctacgtacggtcctaggtacctaaccgtccggtcccttccgtaccggtacctacctcgttactaccggtacccgtaccgacgtacgtacggacgggtccggtaagtcccgttaagttacgttaacgttttacgacgtacgtacgtacttactaagttaacgttacggtaacgttaacgttaacgtaaccggtttacgtaaccggtttcccgtaacggttacgggttcccggttcggggttaaccgggggtccgggttaacggtacccgggtaacgggtttcccggtaaacccggtttacccgggtacggtttacccggaaccgggtaccccgggg

SEQ ID NO: 189895 - DNA, 780 bp, Homo sapiens
  misc_feature: GYAE6OF01EDQUV.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcacctatctcctgcacgtcggaaccagcagtgtacgttggtgtactttaataatttatcgttccttccgttacggttacccaaacgacgtacctaagtttccgaacgggtccgacggtcccggaacccccgtaaaatttaccttttaaattttacgtacgggttacggtttccgtttttaccggtcccggtccccgtttacggttaacggggttttcctacggttccgtccgtttccgtcccggtccttaccgtaagttccgtcggacctaaaccgtaccggtccccttacccgtacgaaccctacttaccgttacctaacggtacccttccggaacggtcgtacgggaacgggtaaccggtggtaccttaggtaacctttaagtttacgtcgcgtaagtaccttagtaacttaacgttaaccgttagtaaccgttacgtaaagtttcggtaacctaccggtacgttacgggtacgtttacggggttacgggaccggggtaaaccggtaacccggttaacggtttcccggtaaccccggttacgttaacgggttccgaacccgggtaacccgg

SEQ ID NO: 189896 - DNA, 842 bp, Homo sapiens
  misc_feature: GYAE6OF01EL9CE.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagtactccgtaggacagtcgatccacctatctcctgcacgtcggaaccagcagtgtacgtttggtctacgtttaattaattattcgttccttaccgttcggtaccaaccgacgtacctacgtttaccggaacggtccaccggaccccgtaaaccccccggtaaaactttaccgtttttaaaaacgttttagtaacgggtttaccggttttacccgtttttacccgggttaccccgggtacccccgttttacggggttaaaccggggggtttttcccttaacgggtttccccgttacccgtttcccggtttacccccgggtacccgtttacccggtttaaacggttcccggtaccggtaacccgtaaacccgtaccccgggttaccccttaccccgttacgaacccttaccttaccgttacgtaacccgtacctcccggaacggtcgtacgggaacggtacggagtccgtaggtactttaagtttacgtacgtaccgtagtacctacctaagttacttacgtaacgtaagtacgttaacgtcggttaacccgtaccgtaccggttcgggtcgttaccgggtaacggggtaccgggtaacgggtacccgtaacggttcccgtaacccgttaccggtaccggtccgtacgtaaccccgg

SEQ ID NO: 189897 - DNA, 537 bp, Homo sapiens
  misc_feature: GYAE6OF01AOOCO.39.39.D06.1.454.CMB.1.raw
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (511)..(511): a, c, t, g, unknown or other
  misc_feature (511)..(511): n is a, c, g, or t
  modified_base (513)..(522): a, c, t, g, unknown or other
  misc_feature (513)..(522): n is a, c, g, or t
  modified_base (524)..(537): a, c, t, g, unknown or other
  misc_feature (524)..(537): n is a, c, g, or t
tcagtcgcactagtcacgaccggtgctcgatttagtgacatctcgcagttctttggggggaagaggaagactgacggtcctgccacaggtggtgctgggcacggcgggcaccaactacaatgcgtccctcaggggtcgagtcaccatatctgcagacaagtccaagaaccacttctccctgaggctgacctctgtgaccgccgcggactcggccatatattattgtgcgagtagtttttgcaggatcgttgggggcggtatcgacgtctggggtcaagggatcacggtcatcgtctcctcacgcctccaccgaacgggcccatccggtccttcccccgtggccgcccctgcctccgagggacgccacccgtccgagacgccacgacggccggcccgtggggcctcgcccgtgggtaccgaacgggtaccttaccgttcccacgtaggtcggaccgtacgtggacgggccgggtcgtcgggcgaacgggccgacgagtaggntacgnanngngnnnnnnnnnngnnnnnnnnnnnnnn

SEQ ID NO: 189898 - DNA, 953 bp, Homo sapiens
  misc_feature: GYAE6OF01DD36F.39.39.D06.1.454.CMB.1.raw
  modified_base (182)..(182): a, c, t, g, unknown or other
  misc_feature (182)..(182): n is a, c, g, or t
tcagtcgcactagtcacgaccggtgctcgatttagtgacatctcgcagttcgtttgggggggggtctcaggaggcagcgctctcaggacatctccaccatggcctgggctctgctgcctcctcaccctcctcactcgagggcacgtacgggtccgtcgggcccagtcgtcggacctgacacncgcctcgccctccgtgtcgtagacgtaccttccgtagggaactacggtaccgacttacccaaccctactttcccgtcccgttcggacctaccggtaaccggaaccgacggtcgtaacgggttcggtacggttttcggtagttaacctttaaagtttaattttcgttcggttacccttccgttacggttaaccaacgtcgtactaacgttccgacggccgaaccggtaccccgaaccccgttaaactttaccgttttaaagtttacggttaggtttacccgggtttcccgtttccccgggttacccggtaccccgtttcggggtttacgggttttaccgtaccggtttcccgtcccgtttcccggtacccggtcccttaaccggttaacgtccggttaacgaacccgtaacccgtcccggtaccccttacccgtacgtaccccttcgttcccgttacgtacccgtaccgtaaccggtcgggtacgtaccgggaagggaccggttaacgtacgttacggtttaacttttacgttacgtttacgggaaccttacgtaacccttaagtaaccgtttaaacgtaacggttaacggttaacgttaacgttaaaccggtttaccgtttaacccgtccgtttaacggtcgggttttaacccgttcgggggggttaaaccccggggtacgggggaaacccggttaacccgggtttaaacgttccccgggttaaacccggttccgggtaaccggtcccggtaccccgggttaaacccgggg

SEQ ID NO: 189899 - DNA, 534 bp, Homo sapiens
  misc_feature: GYAE6OF01A94W6.39.39.D06.1.454.CMB.1.raw
  modified_base (506)..(507): a, c, t, g, unknown or other
  misc_feature (506)..(507): n is a, c, g, or t
  modified_base (509)..(534): a, c, t, g, unknown or other
  misc_feature (509)..(534): n is a, c, g, or t
tcagtcgcactagtcacgaccggtgctcgatttagtgacatctcgcagttctttgggttttggggggaagaggaagactgacggtcctgccacaggtggtgctgggcacggggggcaccaactacaatgcgtccctcaggggtcgagtcaccatatctgcagacaagtccaagaaccacttctccctgaggctgacctctgtgaccgccgcggactcggtcatatattattgtgcgagagtttttgcaggatcttggggcggtatcgacgtcgtggggtcaagggatcgacggtcatcgtctcctcagcctccaccgaagggccccatccggtccttcccccgtgggccgtcccctgcctccgagggacgccaacctccggagacgccacgacggccggtcccctgggggcctcggcccttgggtaccaaacggggtaccttaccgttcccaacgttacgtgcccggactggacggccgggctgggaccgaaggccgacagtaggnngnnnnnnnnnnnnnnnnnnnnnnnnnn

SEQ ID NO: 189900 - DNA, 689 bp, Homo sapiens
  misc_feature: GYAE6OF01B8CTK.39.39.D06.1.454.CMB.1.raw
  modified_base (235)..(235): a, c, t, g, unknown or other
  misc_feature (235)..(235): n is a, c, g, or t
  modified_base (519)..(519): a, c, t, g, unknown or other
  misc_feature (519)..(519): n is a, c, g, or t
tcagtcgcactagtcacgaccggtgctcgatttagtgacatctcgcagttctttggggggggtctcaggaggcagcgctctcgaggacatctccaccatggcctgggctctgctgctcctcaccctcctcactcagggcacgacgggtcctgggcccagtctgccctgactcagcctgcctcgtgtcgtgggtctccgtggacagtcgctcaccatcctcctgctactggaaccngcaggtcgacggttggtaggttaacactagtcgttcgttccgtaggtaaccaaaccaccgaacccccggacaaaacccggacccccgaaagtccagtacgtacttttacgacgtacctacaactaacgtccggtacccgtacggtacggggtacttctaaacgttccgtactttcgtccgtacggtacctaccgtaacgtcgttacgggaccaaacgacccggtcccttcccgtacgtaccctacttccgtcgttcgggacctccggtagcgtaggacggacgnggtactggtattacgttacgcgacgtcgtcgtaactaactacgttacaaccgtagtaacttaaaccgttcgttacggtttccgtttaccgggacgggtaacggtaaccgaggtctacccgggtaccgttacccgtaggtccacggtacccgtgacccgtccgtaccccgg

SEQ ID NO: 189901 - DNA, 802 bp, Homo sapiens
  misc_feature: GYAE6OF01AHY2K.39.39.D06.1.454.CMB.1.raw
  modified_base (739)..(739): a, c, t, g, unknown or other
  misc_feature (739)..(739): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctgacgacctcctggacagtcgatccacctatcctcctgccacgtcggaaccagcgtaggtggtacggtttggtcgttactttaattaagtttacttcggttaccttccgtttacgggttacccaaacgtagtaactactttccggaaggtaccgaaccggtacccggacccccggtaaaacttttaccgttttaaagttttacgtacgggttaacgggttttcccgtttttacccgggtcccgggtaccccgtttacggggttaaccgggggtttttaccttaaccgggttcccgttcccttttacccgggtccccggtaccttaccggtaacggttccgtacgggaacctaaccggtacccggtcccttaccccgtacgtaaccctagttcccgtacgtaaccgtacccgttaccggacggtcgtagggaacggtccggaacggtctacgtaacgttaactttacgtcgtacgtctacgtaactaacttagtactaggttaacgtactaagtcggttactaccgtagttacgggttcgtagggtacccgggngggaacggtaacgttacggttaccgggtacccggttaccgtacggtcccgaacggtaacccgg

SEQ ID NO: 189902 - DNA, 969 bp, Homo sapiens
  misc_feature: GYAE6OF01BFSQQ.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgaccacagccctggccttccgtgtcctagagaccttccgtgggaccagttccgattcccaaccctattcccttcccgtgacctaaccgtacgggaaacccaggccgtaagttcggtaccggttttgggttacgtacctttttaattaaagttttacgttcgtttccgttccttacgggtttaccccaaacgtacggtacctaacttttccgggacgggttaccgaacccggggtacccggtaacccccccggttaaaacttttacccttttttaaaagtttttacggtacgggttaaccgggttttcccgtttttaccccgggtacccgggttcccccgttacggggtttaacgggggttttacctttacgggttcccgttcccgtttaccccggttcccgggtaccttaacccgtaaaggtttcccgtaagggtccccttaaaacccgggtcccccgggttaccccttacccccgttaccgaaaccccggttcctttacccgttaccgtttaaacccgtcccccgtacccggttaaccggggcctttaacgggaccggggtaccggtaaacgggttcccttacgttaaccgtttacgtttacggtttagacccgtaaccggttacccttacgttaacgtttaacttaacgtaacgttaacgttaccgtaaacggttacgttaccaccgttacgttccgggttacggtttacggggtaccgggtaaccggggaacgggttaaacccggttaacggttccggtacccgtttaccgggtacccgtacggtaacccggtaaccccggg

SEQ ID NO: 189903 - DNA, 828 bp, Homo sapiens
  misc_feature: GYAE6OF01B8UHB.39.39.D06.1.454.CMB.1.raw
  modified_base (354)..(354): a, c, t, g, unknown or other
  misc_feature (354)..(354): n is a, c, g, or t
tcagtcgcactagtcacgaccggtgctcgatttagtgacatctcgcagttcgtttggggggggtctcaggaggcagcgctctcaggacatctccaccatggcctgggctctgctgctcctccaccctcctcactcgagggcacgacgggtccgtcgggcccagtcgtcggcctgaccacgacgcctcgccgtccgtgtctagacgtacctccgtacggacgacgtcgactaccacctactcctccgtacgaccgacgtacggaaccacgacgacggttacggtacggtttgggtcgttaacttttaaagttaaacgtttcttccggttccttaccggttacgttaacccaaacncgtaccttacgttccggaacggaccgaccggacccccgtaaaccccgtttaaacttttaccgttttaaattttacggtcgggttacgttttcccgttttacccgggcccggttacccgtttagggttaccgggtttctcgggttcccgttccgtttcccggtcccggtacctaccggttacggttcgtaccggtaaccgaacccggtcccgtcccttaccctaacgtaaccttaccttccgtacggtaaccgccgttaccgacgggtacgtacgggaacggtacggtacggtactagtttaacctttagttacgtgaaccgtctaccgttacctagttacgtaagttacgtacgtagttacggtctaccggtacggtcggttacggttcgggtaccggggacggtaaccggttaccggtttacggtacccggtcccggttacggaccggtaccgaacccggtccggtacccggg

SEQ ID NO: 189904 - DNA, 795 bp, Homo sapiens
  misc_feature: GYAE6OF01BEOMA.39.39.D06.1.454.CMB.1.raw
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (368)..(368): a, c, t, g, unknown or other
  misc_feature (368)..(368): n is a, c, g, or t
  modified_base (627)..(627): a, c, t, g, unknown or other
  misc_feature (627)..(627): n is a, c, g, or t
tcagtcgcactagtcacgaccggtgctcgatttagtgacatctcgcagttcgtttgggggggggtctcaggaggcagcgctctcaggacatctccaccatggcctgggctctgctgcctcctccaccctcctcactcgacggcacgagggtcctcgggcccagtctcgcctgctcncncctgcctcgtgtcgtcgggtctcgtggacgacgtcgctcacctactcctcctcggaccacgtacggaaccagcgtaggtcggtacggtttggtaacgttaacacgttagtcgtaccgtccgtaacgaaccaaccgaacccgacccggaaccgaacccggaccccgtaagtcctagttcgttaacgtttanacggtaccgtaacctaacgtacgtccccggtacgttagggtacgggttaactactaccggttccgtactttcgtcgtacggaccttaccgtaaggtccgtaccggaaccgtaccggtacccggtcccttaacccgacgtaacctcgttcccgttcgggtaccggtaccgttacccggacggtacggtaaccgggaaccggtaacgggtacgttacggtttaaagtttaacggtttaccacggttacgctttaaccggtnttaaccttacggttacaacgtacgttagtacggttacggtactttacgttaacgttcgggttaaccgtacggggtaacgggttaccggaacgttaccgttcggtaacccgttcgttaaccggtaacgggtaccaaaccccggggtaccccgtaaacccggtaaccccg

SEQ ID NO: 189905 - DNA, 895 bp, Homo sapiens
  misc_feature: GYAE6OF01CYGTT.39.39.D06.1.454.CMB.1.raw
  modified_base (232)..(232): a, c, t, g, unknown or other
  misc_feature (232)..(232): n is a, c, g, or t
tcagtcgcactagtcacgaccggtgctcgatttagtgacatctcgcagttctttgggggggggtctcaggaggcagcgctctcaggacatctccaccatggtctgggctctgctgctcctcaccctcctcactcagggcacgaggtcctggcccagtctgccctgactcagcctgcctccgtgtcgtgggtctcctggacagtcgctcaccatcctcctgcacgtggaaccngcagtgtacgttggtcgttacaacgtatcgtctccgtagaacccaacaacccgtaccccggacaaaccggcccccgtaagtcacgtagtactttacgtacgtaccgtactaacgttaacgtcccggtacccgtaggtacgggggttctaccgttaaacgttccgtccgttttaccgtccggttacgggtaccctacccgttaaaggttcccgtacgggtaaacctaaaccggtacccggttaccccgttacccgtacggtaaccccgttaacgttcccgttaccgggttacggggtacccttaccggaacggggttacctacggggtaaaccgggttaccgggtaacgggttaccgtttaacggtaacgtttttaaccgtttaccggtacggtacccggttaacgttacccggttaaccgttaaacgttttaccccgttaacggaaacgttaacccgttaaaccggttaacgtttaacccggtttcccggtttacccgggttttacccgggggaacgggttaaacccggggtaacccggttaaccggttacccggttaacccggggttaaccccccggtttacggttaaccccggggttacccgtaacccgggtaacccccgggttaacggtcccgttcccccccgggggtttaaccccccgg

SEQ ID NO: 189906 - DNA, 774 bp, Homo sapiens
  misc_feature: GYAE6OF01AN5QK.39.39.D06.1.454.CMB.1.raw
  modified_base (182)..(182): a, c, t, g, unknown or other
  misc_feature (182)..(182): n is a, c, g, or t
  modified_base (336)..(336): a, c, t, g, unknown or other
  misc_feature (336)..(336): n is a, c, g, or t
tcagtcgcactagtcacgaccggtgctcgatttagtgacatctcgcagttcgtttggggggggtctcaggaggcagcgctctcaggacactctccaccatggcctgggctctgctgctcctcaccctctcactcgagggcacgaggtcctgggcccagtctcggcctgacacacgccgttcnccgttccggtgtccgtagacgtacctccgtagggaactcggtcactccacctattcctcctgcctaacgtcggaacctggtacacggttcggtacggttcggtacgtaactttacgtaacttacgttcgtccgttccgtcggttaaccaaacgngtacttagtacgcggtaccgaccgtaccggtaacccgtaactttactttaacgtttagtcggtacggtttcttccggtccgtccgtacggttacgggtttcctacgttccgtcgttcggtcccgtacttccgtaagtcgtccgtacctaacgcccggtaccctccgtaccgtacctactcctacgtacgtacccgtacgtaacgggtcgtacggaaccgggcggttaggacctttaggtaacctacggtttacgtacgtaccgaccggttattaaccgtaacgttaaccgttaagttaacgtaacggttacttacggttaacgtccgtaaaccgtcggttcggtacgggttaggggttacccgggacggtaaccgggttaaccgtaaccggttccgggtacccgttaccgaacgggtttcccggaacgttaccccggg

SEQ ID NO: 189907 - DNA, 638 bp, Homo sapiens
  misc_feature: GYAE6OF01BCCNL.39.39.D06.1.454.CMB.1.raw
  modified_base (116)..(116): a, c, t, g, unknown or other
  misc_feature (116)..(116): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
tcagtcgcactagtcacgaccggtgctcgatttagtgacatctcgcgagttcttgggggggtctcaggaggcagcgctctcaggacatctccaccatgcctggctctgctgctccncacctctcactcagggcacgagggtcctgggcccagtctggcctgacacagcctgcctcgtgtctgacgcctctggactagtcgatcactatcctctgaccacgtacggaaccagacaggtgtacggttgtagtcttaataattctntctctagtaccaancnctagtcgacgcacgccggtaccctaatcttaattcgngtacgttccttcgtccgcccgttggtacggttctacggtcgttccgttcgtcccgtactaccgtacgttcacggtaccaacgtcccggtaccctccgtacgcccgtatccgtacgtccgtaccctcgacgtacgtacggacgtacggagtaccttagtaacttagttcctagtccgagtaaccttcgtaacgtaactacgtacgtaaacttacgaaactggtaacctttccacggtttacggtcgttaaccgggtcggaaaccgggtacttaaggtaccgttaccgacccgtttccggtaacgttcccacccggtaacccgg

SEQ ID NO: 189908 - DNA, 851 bp, Homo sapiens
  misc_feature: GYAE6OF01B9WA1.39.39.D06.1.454.CMB.1.raw
tcagtcgcactagtcacgaccggtgctcgatttagtgacatctcgcagttcgtttggggggggtctcaggaggcagcgctctcaggacatctccaccatggcctgggctctgctgcctcctccaccctcctcactcgagggcacgacgggtccgtcgggcccagtcgtcggcctgaccacgacgcctcgtcccgtccggtgtacgtcgacgacctccggttacggaccgtacgtaccgactaccaacctacttcctaccgtcgaccgtacgtacggaaccacgacgtaggtcggtacggtttgggtacttaacgtttaaacttaagttacgttccgttccgtttccgttacggttaaccaaacgtagaccttaagttaccgacggaccgacggaacccccggtaacccttaaactttacttttaaagttcgttacgggttacgttttcccgttccgggttaccccggttccggttacgggttacggttttaccgacgtttcccgttaccgttcccggttacccgaccgtttaaccggtacgttccggaacgtacccgtaacccgtacccggtcccctacggtaacccactttacccgtacctaccgttaaccctcccggtagacggtgtaacggaaccgggtcgtacgtacccgttagtaccttagttcgtaccggactacgtaaccttaataacgttagttaaccgtaagttaaccgtacgttagttacggtacctaccgttacgggtcgttaaccggtttcggggaacccggggtcgtaaacccgggttaccgtttaaccgttcccgggttaactacggggtaccttaacccggtcccgggaaacccgg

SEQ ID NO: 189909 - DNA, 677 bp, Homo sapiens
  misc_feature: GYAE6OF01ANP1U.39.39.D06.1.454.CMB.1.raw
  modified_base (222)..(222): a, c, t, g, unknown or other
  misc_feature (222)..(222): n is a, c, g, or t
  modified_base (611)..(611): a, c, t, g, unknown or other
  misc_feature (611)..(611): n is a, c, g, or t
tcagtcgcactagtcacgaccggtgctcgatttagtgacatctcgcagttctttggggggggtctcaggaggcagcgctctcaggacatctccaccatggcctgggctctgctgctctcacctctcactcgagggcacgagggtcctgggcccagtcgtcggcctgacacagtccctgcctcgtgtcctagagtcctccgtggacctgtacgactcaacctnttccgtcctgcagtacggaacctggccaggtcgtcggttggtctacttataattcgtcttcgtcttacgtaccgtacaggtctacgttcgaaggccgaccggccggtaacccgtaactttacttaactttaagtcgtacggtttccgtttccgttccggccgttacggtggtttacctcggtcgtacccttccggtcggtcccgtacgtaacgtccgtaacgcgtaacccgacggtttcccaccgttacgccttaaccggtccttacgtaccgtactccgtaacggccggttacgacgggtaaacggtcgacgtttacgaaccgttttcgttatttaggaccctaggttcctaacgttactaagttccgtaaggtacgtactaacgggnttcgtacctggtcgttgtacggtcggtcgtaacgacgtagtccggacgtacgtacgctggtacccg

SEQ ID NO: 189910 - DNA, 831 bp, Homo sapiens
  misc_feature: GYAE6OF01AQHFP.39.39.D06.1.454.CMB.1.raw
tcagtcgcactagtcacgaccggtgctcgatttagtgacatctcgcagttctttgggggggggtctcaggaggcagcgctctcaggacatctccaccatggcctgggctctgctgctcctcaccctcctcactcgagggcacgacgggtcctgggcccagtctggcctgacacagcctcgccgttccgtgtcgtgacgacctccgtggaccaggtccgactaccaacctatcctccgtgacctacgtcggaaccagctaggtgtaccgttgggtacgtactttaataattagtcgttccttaccgtcggttaacccaaacgcgtaccgtagtccgaggtacaccggtcccgaaccccgttaaattacgttttaactttacggtaggttaccggtttacctttccgggaccggttcccgttacggggtttacggggttttacctacggttccggtcctttacccggtccggtacccttaaccgtaacggttcggtaaccgggtacccaacccggttcccggtacccctttacccggtaccgtaaccctacgtttacccgttaaccgtaacggtaccccttaacccggtcgggttaccgaagggtaacccgggacggtaaccggggttacttacggttaactttagtttacgtcggtaccgacgttacctacttaagttacgttaccgtaaacgttaacgtacgtaacggttccgttaaccgtaccgtaaggttcgggtaaccgttacggggttccggggaaacgggtacggtaacccgttacggttcccggtaaccgttcgggtaaccggtaccggaccgggtaaccccggg

SEQ ID NO: 189911 - DNA, 804 bp, Homo sapiens
  misc_feature: GYAE6OF01BUO6E.39.39.D06.1.454.CMB.1.raw
tcagtcgcactagtcacgaccggtgctcgatttagtgacatctcgcagtttctttgggggggggtctcaggaggcagcgctctcaggacatctccaccatggcctgggctctgctgctcctcaccctcctcactcagggcacgagggtcctgggcccagtctggcctgacacagcctgcctccgtgtctgacgtctcctgggacagtcgatccacctatcctcctgacctacgtacggaaccagcgtagttcggacggtttggtcgtactttaagttaatttacttcggtaccttccgttacggttacccaaacgtacgtacctaatttccggaacgggccgtaaccggacccccggtaacccccggttaaaacttttacgtttttaaaaacgttttacggtacgggttaacgggttttcccttttaccggggtcccgggtaaccccgtttacggggtttaacggggttttttaccgtacgtttcccgggttacccttttccgggtaccccgggtaccctttacccggtaaacggtttccggaacgggtaaccccaaccggtaccccgggttccccttacccgtacgacccgttactccgttacttaacggtccctacggacggtcgtacggacggacgtaggcttagtactttagttaacgtcgagtacgtactaactacttacgtacgttagaacgttactaaggttcgtaacctccgttaacggttgtcggttacgggtacggggaaccgggtacgtaacgtacggttccgacccgttaggacgtacgccggtaaacccgg

SEQ ID NO: 189912 - DNA, 711 bp, Homo sapiens
  misc_feature: GYAE6OF01D42N9.39.39.D06.1.454.CMB.1.raw
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (560)..(560): a, c, t, g, unknown or other
  misc_feature (560)..(560): n is a, c, g, or t
tcagtcgcactagtcacgaccggtgctcgatttagtgacatctcgcagtttcgtttggggggggtctcaggaggcagcgctctcaggacatctccaccatggcctgggctctgctgctcctcaccctcctcactcgagggcacacgggtcctcgggcccagtctcgccctgactcncgcctcgccttcgtgtcgtggtctctggacngtcnctcacntctcngcactgaaccngnagtgacgttggtagtacactatgtctcgtacgtaaccaacaaccgacccgaccaaccgaccccgtaagtctacgtatacttagtcgacgtactaactacgtccggtcctacggtagggtactacttaagtccgttaccttcgttccgtaggttcccttaccgtaaacggtttccgtaccgggtaaccccgtaaaccggtccccgtaccccggtttaccccgtaccgtaaccccgttattacccgggtcgtccggtacgtcccggaggttacgtacgggaccggtacgggtacgttcgttagtaacgtttacgttcgaccgttaanactacgttactaacgttaagtacgaagttacgtaagttaccgttcgttccggttacggttcgggaacggtacggtacgttacggccgttacccggtaccggtacgttaccggtaccgaaccgtacccggacggtccccgtccggtaccccg

SEQ ID NO: 189913 - DNA, 903 bp, Homo sapiens
  misc_feature: GYAE6OF01A5HCA.39.39.D06.1.454.CMB.1.raw
  modified_base (794)..(794): a, c, t, g, unknown or other
  misc_feature (794)..(794): n is a, c, g, or t
tcagtcgcactagtcacgaccggtgctcgatttagtgacatctcgcagttctttgggggggggtctcgaggaggcagcgctctcaggacatctccaccagtggcctgggctctgcctgctcctccacctcctcactcgaggcacagggtcctcgggacccaggttctggcccttagaccacgagtccctcgtcccgtccgttgtaccgtagacgacctccgtacggaacgtcgtccgtaacttcccgaaccctattcccgttccggtcgaacctacgggtaccggaaacccgagaccggtttaaggttaccggtcggtttaaggggtcgttaaccttttaaataaaacctttagttccggtttcctttaccggtttacggttaaccccaaagtaccggtacttaacggttaccgaacggccgtaccggtaccccggtaaacccccgtaaattttaacggttttaattaccgttaggttaccggttttaccgtttcccggtcccggtaacccgttcggggtttaccgggtttactacgtcgtttcccgtcgtaccccggtcttaaccgcgtttcggacccgtagaacccgtccggtacccttaaccgtccgtaaccttcttcccggtaacgtaccgtacccgttccggaacgggtttgaaccgggtaccgggaacggttacgggtaccttaacccggtaatttttaacccgggtttataccgggtaaccgtcttaccggttaactaaacttaaacggttaccgtagttaaaccgttggaaactttcccgggttanaaccgtcgggttcggcccgttttggaaaccggggttaccggggaacccttacggacgggtttaacccgtcccgttaaagggtcgggtaaacccgccccggttaaaccgg

SEQ ID NO: 189914 - DNA, 844 bp, Homo sapiens
  misc_feature: GYAE6OF01A4654.39.39.D06.1.454.CMB.1.raw
tcagtcgcactagtcacgaccggtgctcgatttagtgacatctcgcgagttcgtttggggggggtctcaggaggcagcgctctcaggacatctccaccatggcctgggctctgctgcctctcacctcctcactcgagggccacgagggttcctgggccctagtcgtggcctagacacgacgcctgccttccggtggtctggaacgtaccgtcgtagggacctaggtccgacttaccgacccgtattcctccgtacgacctacggtacggaaaccctggaccgtaacgggttacggtaccgggtttggtacgttaccgtttaaagttaactttacgtcgtttaccgttccgtttacgggtaacccaacggtaacgtacgttacgttacggacggaccggtaccggtaacccggtaacccgtaaactttacgtttaaacgtttaggtacgttaggttccgtttaccggtaccgtcccgttacgggtttaccgggttacgttaccgttacggtccgttcgttacccgggacttaccgtacggttacgtcgtaaccgtaaccgtccgtacccgttaccgtacgtacctacgttccgtacgtaacgtaccccgtaacggtacggttaccgtacgggaacggtccgtaacggtactaacggtacttaagtttacgtcgacgtcgaacctagtaaccttaacgttaacaacgggttaactaacgtaacgttaacggtactaccgtaccgttacgggtaccggtttacggtaccggggtacggtaaccgggttaaccgtaaccgggttacccggtacgttaccgggttaacgcccgtaaccggtaaacccgg

SEQ ID NO: 189915 - DNA, 783 bp, Homo sapiens
  misc_feature: GYAE6OF01A4E1Y.39.39.D06.1.454.CMB.1.raw
  modified_base (322)..(322): a, c, t, g, unknown or other
  misc_feature (322)..(322): n is a, c, g, or t
tcagtcgcactagtcacgaccggtgctcgatttagtgacatctcgcagttctttgggggggggtctcaggaggcagcgctctcaggacatctccaccatggcctggctctgctgctcctcaccctcctcactcacgggcacgaggggttcctcgggcccaggtctggcctgacacagcctgcctccgtgtctgacgacctcgtggacagtcgatccaccattcctccgtcgaccacgtacggaaccacgcgtaaggtcggtacggtttgggtacttactttaagtaacgtttgttcggttccttccgttggttacccaaacncgtctaacgttcgacggaccaaccgggacccggtaaccccgttaaaagtttcttttaaaagtttacgacgggtttacggtttacccgtttaccggtcccgggtccctttacggggttacggggtttttcctcgggttcccgttccgtttacggtaccccggtctacccgtagtcgtcggaacctaaccggtacccgtcccttccgtacgtaccgtacgttacgtccgttaacgtccgtccgtaagggtcccggtaggtaccggtacggaagttccgtaacgttactagtttacgtcgttacggtaaccgcttaacgtaattaccgttacggtaagtaaccgttacgtaacgttaccgggtattacccgtacggtcggtaccggttcggggtaaccgggtacgggtaacggtaccgttacggttacgaaccccggttaggtaccggtcgaacccgtaacggg

SEQ ID NO: 189916 - DNA, 679 bp, Homo sapiens
  misc_feature: GYAE6OF01EWLL2.39.39.D06.1.454.CMB.1.raw
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (557)..(557): a, c, t, g, unknown or other
  misc_feature (557)..(557): n is a, c, g, or t
tcagtcgcactagtcacgaccggtgctcgatttagtgacatctcgcagttcgtttgggggggggtctcaggaggcagcgctctcaggacatctccaccatggcctgggctctgctgctcctccaccctcctcactcgagggcacgacgggtcctgggcccagtctggcctgacacagcctcgcctcgtgtctgacgtactcctggacagtcgatcaccatctcctgccacgtggaaccagacagtcgtacgttggtntacttaataattatcgtcctccttggttacccaanacgtctagttacgaggccacggacccgaaccccgtaaaacttcttttaaactttagtcgggttaacgtttccgtttccggaccggtcccgttaggtaacgggtttctaacggtccgtctttaccggtcccgtactacccgaagtccgtacggaactaaccgtaccgtccctaccgtacgacccttaacgtccttacgtaacggtcccttaaccgagggtactacgggaacgggtaccggagttactagttaacttaatttaccgngaacgtacgttctaacgtagtttcaacgttaactcgaggttagacggttacttaggtcgttaacgttagggaacggtaggaactaacgtctacgtcgtacgtaggccacgcccgtaaacccg

SEQ ID NO: 189917 - DNA, 926 bp, Homo sapiens
  misc_feature: GYAE6OF01DW5BU.39.39.D06.1.454.CMB.1.raw
tcagtcgcactagtcacgaccggtgctcgatttagtgacatctcgcagttcgtttggggggggtctcgaggaggcagcgctctcaggacatctccaccatggcctgggctctgctgctcctcaccctcctcactcgagggcacagggtcctgggccctagtcgtggcctgacacagcctgcctccgtgtctgacgactccgtaggacagtcgatccactactcctcctcggaccacgtacggaaccaggtactaggtggtacgttgggtactactttaacttaagtttacgttcgtccgttacccgttcgggttaaccctaacgtaacgtcgttaagttaccggacgggtaccgaccggtaccccggtaaacccccggttaaacgtttacgtttttaaacgttttacggttacgggtttacgggttttccctttacccgggtcccggttacccgttacggggtttaaaccgggttttccgttaccggttccggttaccgtttacccggtacccggttacccgttaaccggttacggttaccggtaacccggtaaccgtaacccggtaccccggtttaccccgttacccgggttaacccgttacccttacctaccgtttacccgtaaacccgttaccccgtaaccgggtaacgggtaccggtaaccgggtaacgggtaccgggttaaccgtgtttaacccgttaaagttttcggttaaacgttcggttaccgacgtttacccttaacgtaacgtttacctaaaggttaacggttaacgttaacggttaaacgttccggttaactaccggttaacgggtccggttacgggttaccgggttaacggggaaacccggggtaacgttaaccggttaaacggttacccgggttaaccgttaccggaacggttaccggaacccggtaacccgg

SEQ ID NO: 189918 - DNA, 658 bp, Homo sapiens
  misc_feature: GYAE6OF01DRIHU.39.39.D06.1.454.CMB.1.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
tcagtcgcactagtcacgaccggtgctcgatttagtgacatctcgcgagttctttggggggggtctcaggaggcagcgctctcaggacatctccaccatggcctgggctctgcttgcctcctccacctcctcactcgagggccacgagggtcctgggtccagtctggcctgacacagcctgcctccgtgtctgacgactcctggacagtcgactcaccatctccgngaccactggaacctagcagtgacgttgagtacttaataattntcgtccttccgtacggttaccaacgcgtacagttacgaggtccaacggcccgtacccgtaaatttctttaaagttcgtgttacggtttacttccggccggttaccgttggttacggtttctagtccgtcttccgtaccgtcctacgaacgttcgacgaccgtaaccgtccggtccctccgtacgaccttactcctacgtacgacccttcggacgtcacgggtacggaacgacgtctaggactttagtcgtagcagtcctagtactatcgtaagtacgtacaagttacggtcctactaccggttggtcccgttacggggtacgggaacgggtaccgtaacgtaacggtttcccgggaacccttccggttacggacccgtaacccggtcccg

SEQ ID NO: 189919 - DNA, 927 bp, Homo sapiens
  misc_feature: GYAE6OF01D6FX5.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgtacctcctggacagtcgactccacctacttcctccgtgaccacgtacggaaccagcaggtcggtacggttggtgtactttaattaattactcgttccttccgttacggttacccaaacgtacgtacctactttacggaacggtaccgaccggtaccccggtaacccccgtaaaacttttaccttttaaaagttttaacggtacggttaacgggttttcccgttttaccgggtcccggttaccccggtttacggggtttaacggggttttccttaacgggttcccgttcccgtttcccggtacccggtacccttaccggtaacggttccgtaccggggtaacccaaaccggtccccgggttaccccttacccggtacgtaaccccttacgttacccgttacgttaacccggtacccgttcccggaacgggttcccggtaacggggtaacggggaaccggtaacggtaccgtttaacgttaaccgttttaacggttttacgtaccggtaacgtaaccggttaccttaacgtaaagttttaaccggttaaaccgttaaggttaaaacccgttacggttaaacggttaccggttaaacccgtcccgtaacggtttccggggttaccggtttacggggggttacccggggaccggggttaaaccgggttaacccgttaacgggtttccccggtacccgggtttaacccgtacccgggttaccgaaaccccgggttaacccgg

SEQ ID NO: 189920 - DNA, 517 bp, Homo sapiens
  misc_feature: GYAE6OF02F75R4.39.39.D06.1.454.CMB.1.raw
  modified_base (366)..(366): a, c, t, g, unknown or other
  misc_feature (366)..(366): n is a, c, g, or t
tcagtcgcactagtcacgaccggtgctcgatttagtgacatctcgcgagttctttgggggggtctcaggaggcagcgctctcaggacatctccaccaatggccctgggctctgctgctccgtcaccctcctcactcagggcacagggtcctgggcccagtctggcctgacacagcctgcctccgtgtcgtgagactcctggacagtcgagtcaccatctcctgctactggaaccagcagtgacgttggtgcttataattatgtctcctggttccaacagcattcaggcagcgcccgaatcttaattatgagtctttcgtcggcctcagggtttctagtcgcttctccggctccaagtctggcaacnccggcctccctgacccatcctctacgacctcacggctgaggacgaggcgtgactattatgcagctcatagtactgaagtcaagtgttactcgacgtggcttgttcgggcggagggtaccagttcgaccgttcgttacggtccagtaccccg

SEQ ID NO: 189921 - DNA, 487 bp, Homo sapiens
  misc_feature: GYAE6OF02IF8NG.39.39.D06.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgcccgaaactcttaatttatgagttctttcgtcggtccctcgtagggtttctagtcgcttctcggctcagtctggcacacgcctcctgaccatctctagactccagctgaggacgaggctgactattatgcagctcatatactgaagtcaatgtatccatggctgttcggcggaggactagtcgaccgtctaggtcagtcccg

SEQ ID NO: 189922 - DNA, 519 bp, Homo sapiens
  misc_feature: GYAE6OF02HVLPG.39.39.D06.1.454.CMB.1.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctggttccaacngcattcaggtcagccgcccgaaactctttaatttatgtaggttctttcgtcggccctgagggtttctagtcgtcttctccggctccagtctgcacacgcctcctgaccatctctacgactcgaggctggagacgaggtctgacttattatgcagctcattatactgaagtcaaagtggtactccacgttggcttggttccggcgggtaggaccaaggtttcgaaccgttcctaaggtccacgtacccg

SEQ ID NO: 189923 - DNA, 501 bp, Homo sapiens
  misc_feature: GYAE6OF02FUX46.39.39.D06.1.454.CMB.1.raw
  modified_base (438)..(438): a, c, t, g, unknown or other
  misc_feature (438)..(438): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcgccctcagggtttctagtcgcttctccggctccatgtctggcaacacggcctccctgaccatctctagactccaggctgaggacgaggctgactattattgcagctcatatactgaactnaatggtatccacgttggcttggtccggcggtaggacctaaggttcgaccgtcgtaggtcacgg

SEQ ID NO: 189924 - DNA, 503 bp, Homo sapiens
  misc_feature: GYAE6OF02G1V3E.39.39.D06.1.454.CMB.1.raw
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaattatgagtctttcgtcgcctcagggtttctagtcgcttctccggctccaagtctgcaacncggcctcctgaccatctctagacctccgaggctgaggacgaggctgactattatgcagctnatatactgaagtcaatgtactcctagtggtctggttcggacggtacggactaaggttcgaccgttcgtaggtccagtacccg

SEQ ID NO: 189925 - DNA, 512 bp, Homo sapiens
  misc_feature: GYAE6OF02IIVGM.39.39.D06.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
  modified_base (366)..(366): a, c, t, g, unknown or other
  misc_feature (366)..(366): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatctcctgcactggaaccngcagtgacgttggtgcttatattatgtctctggttccaacngcattcaggcagcgacccgaactcttaattatgtaggttctttcgtcggtccctcgtagggtttctagtcgctttctccggctcaagtctggcaacncggcctcctgaccatctctagactccaggctggacggacgaggctaggacttagttatgcagtctcattatacctgaaacgtcaagttgtactccatggcttgtcgggcggaggacctaggttcgaccgttcgaggtcagtacccg

SEQ ID NO: 189926 - DNA, 500 bp, Homo sapiens
  misc_feature: GYAE6OF02I8IY0.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgtaggtctttcgtcggcctcagggtttctagtcgcttctccggctcaagtctggcaacgacggcctccctgaccatctctagactcaggctgaggacgagctgacttattatgcagctcatatactgaagtcaatgtatccactggcttgttcggcggtaggaccgtagttcgaccgtcgtaggtcacgacccg

SEQ ID NO: 189927 - DNA, 491 bp, Homo sapiens
  misc_feature: GYAE6OF02GPK14.39.39.D06.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgcccgaaactcttaattatgaggtctttcgtcggccctcagggtttctagtcgcttctccggctccaagtctggcaacacggcctccctgaccatctctagactccagctgagacgaggctgactatattgcagctcatatactgaatcaatgtatccatggctgttcggcggaggaccaggttcgaccgtctaggtccagtacccg

SEQ ID NO: 189928 - DNA, 585 bp, Homo sapiens
  misc_feature: GYAE6OF02ITDFL.39.39.D06.1.454.CMB.1.raw
  modified_base (410)..(410): a, c, t, g, unknown or other
  misc_feature (410)..(410): n is a, c, g, or t
tcagtcgcactagtcacgaccggtgctcgatttagtgacatctcgcagttctttggggggggtctcaggaggcagcgctctcaggacatctccaccatggcctgggctctgctgctcctcacctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaacttcttaatttatgacgttctttcgtccgtccctcgtagggtttctagtcgtcttcgtccggctccaagttctggacaacgaccggcctccctgacccatctctagacctaccgngctgaggaccgagctgacttagttattcgcagtctcaattatactagtaaacgtctaaagttcggtaacttcccgaacgttcgggtacgttcgggtttaccggggtacgggaacggggtaacccgtaacggtttcggtacccggttacggtacggttaccgaccggtaaccccgg

SEQ ID NO: 189929 - DNA, 486 bp, Homo sapiens
  misc_feature: GYAE6OF02FM1H5.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgagtctttcgtcggcctcagggtttctagtcgcttctcgctccaagtctggcaacacggcctccctgaccatctctagactccaggctgagacgaggctgactattattgcagctcatatactgaatcaatgtatcatggctgtcggcgaggaccagttcgaccgtctaggtcagtacccg

SEQ ID NO: 189930 - DNA, 516 bp, Homo sapiens
  misc_feature: GYAE6OF02I2MYB.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaattatgagttctttcgtcggccctcgtagggtttctagtcgcttctccggctccaagtctggcaacgacgcctccctgaccatctctagactccaggctgaggacgaggctgactattattgcagtctctatttgactaatcagtgagtcttatgttcgttcggaagttcgggaacctaaggtctagttcgtaccgtaggtcacgacccgaaccgg

SEQ ID NO: 189931 - DNA, 549 bp, Homo sapiens
  misc_feature: GYAE6OF02JYY7A.39.39.D06.1.454.CMB.1.raw
  modified_base (228)..(228): a, c, t, g, unknown or other
  misc_feature (228)..(228): n is a, c, g, or t
  modified_base (373)..(373): a, c, t, g, unknown or other
  misc_feature (373)..(373): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcagcagcgcccgaaactcttaatttatgaggtctttcgtcgcctcgagggtttcagtcgcttctccggctaccagttctgcaacgacggccctcccngaccatctctacgaccttccaggctgaggacgaggctggtaccttagttacttgacgacgtcttacgtattacgtacttagaactacgaaattggtactcccgtaagtcgggcttcggtttcgggaccggtaggtacccgtagttcgaacccgttccgtaaggtccacgtacccgg

SEQ ID NO: 189932 - DNA, 710 bp, Homo sapiens
  misc_feature: GYAE6OF02I566V.39.39.D06.1.454.CMB.1.raw
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaacagcattcaggcagccgacccgtaaatcttaatttatgaaggttctttcgtcggcccttcgtagggtttctacgtcgtcttcgtccggctacctaagtcttcggacctaacgtaccgggtcccttcccgtacgtaaccctacttccttaccgtacgaaccttcccgaacgggtccttacggacgggtaacgtacggtaccgttagtaaaccgtttaactttaacgtttcggacccgtaaggtaccttaccgtaaacgttaacgttaaccgttacgttaaacggttaccgtaaaagtttacgggttaacttacccgtaaccgttacgggttaaccgttcggggttttaccggggaaccggggttaaccggggtaacccgttaaacgggttttccggtaaaccccggtttccggttaaacgggttcccgaaccgttaaccccgg

SEQ ID NO: 189933 - DNA, 512 bp, Homo sapiens
  misc_feature: GYAE6OF02IDPZG.39.39.D06.1.454.CMB.1.raw
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaacagcattcaggcagccgcccgaaactcttaatttangagtctttcgtcgcctctagggtttcagtcgcttctccggctccgagtctggcaacgccggcctccctgacctatcctctacgactccaggctagacggacgngctgacttattatgcagctnatatactgaagtcaagtgtatccacgttggcttggttacggcggaacggaccaaggttcgacccgttcgtaggtccagtacccg

SEQ ID NO: 189934 - DNA, 562 bp, Homo sapiens
  misc_feature: GYAE6OF02H1QKX.39.39.D06.1.454.CMB.1.raw
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaanagcattcagcagcgcccgaaactcttaatttangtagttcttcgtcgcctcgtagggtttctagtcgtcttctccggctccagtctggcaacncggcctcctgacctatctcagactcagctgagacgagctgactatatnacagctcatactacgtagaacgtacaagttcgtactccgtaacgttcgggtcctttgggtttaccgggacgggttaaaccgggtaacccgttaagggttacccggtaccccggtttacccggttaacgggttcccgaacggtaacccccggg

SEQ ID NO: 189935 - DNA, 499 bp, Homo sapiens
  misc_feature: GYAE6OF02F8QXD.39.39.D06.1.454.CMB.1.raw
  modified_base (443)..(443): a, c, t, g, unknown or other
  misc_feature (443)..(443): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcatgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggttctttcgtcggccctcaggggtttctagtcgctttctccggctccaagtctggcaacacggcctccctgaccatctctagacctccaggctgaggacgaggctgactattattgcagctcatatactgaaatnaatggtatccacgtggcttggttcggcggagggaccagttgaccgtctaggtcacg

SEQ ID NO: 189936 - DNA, 530 bp, Homo sapiens
  misc_feature: GYAE6OF02GJOIS.39.39.D06.1.454.CMB.1.raw
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (432)..(432): a, c, t, g, unknown or other
  misc_feature (432)..(432): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaactcttaattatgtacgttctttcgtcgccctcgtagggtttctagtcgtcttcgtccggctccaagtctgcacncggcctccnaccatctctgggcctccgaggctggacggtacgagctgattatactgcagtctntattgctaatcagtgtagtcttagtgttcgttcggaaggttcgggaaccgtaaggtctagttccggtaccgttacggtaccacgtacccgtaaaccgg

SEQ ID NO: 189937 - DNA, 514 bp, Homo sapiens
  misc_feature: GYAE6OF02HQ8VP.39.39.D06.1.454.CMB.1.raw
  modified_base (229)..(229): a, c, t, g, unknown or other
  misc_feature (229)..(229): n is a, c, g, or t
  modified_base (378)..(378): a, c, t, g, unknown or other
  misc_feature (378)..(378): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgccccgaaactcttaatttatgaggttctttcgtcggccctctagggtttctagtcgtcttctccggctccagtctggcacacggcctcccngacccatctctagactccaggctgaggacgaggctgactattattcgcagctcatatactagaagtcaaattggtatccagtggacttggttcggcggaggacctaaggttcgaccgttccgtaggtcagtacccg

SEQ ID NO: 189938 - DNA, 502 bp, Homo sapiens
  misc_feature: GYAE6OF02F8LLY.39.39.D06.1.454.CMB.1.raw
  modified_base (425)..(425): a, c, t, g, unknown or other
  misc_feature (425)..(425): n is a, c, g, or t
  modified_base (454)..(454): a, c, t, g, unknown or other
  misc_feature (454)..(454): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagcgcccgaaactcttaatttatgtaggtctttcgcgtcctcgagggtttctagtcgcttctccggtctccaagtctggcaacacggcctcctgacactctctagctcgaggctgaggacgaggctagactattactgcagctnaatatactgaactacaataggtactcacnggtctgttcggcggaggacctaggtcgaccgtcgtacggtcagacccg

SEQ ID NO: 189939 - DNA, 523 bp, Homo sapiens
  misc_feature: GYAE6OF02IJB02.39.39.D06.1.454.CMB.1.raw
  modified_base (271)..(271): a, c, t, g, unknown or other
  misc_feature (271)..(271): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacngcattcaggcaggccgaccccgaaactcttaatttatgaggttctttcgtccggtcctcgtagggtttctagtcgtcttctccggctccaagtctggcaacacggcctccctgaccatctctagctccgaggctgaggacgaggctgacttattatgcagctcatatactgaatcaattggtatccgacgtggcttggttcgggcggtacgggaacctaaggttcgaccgtccgtagggtccacggtacccg

SEQ ID NO: 189940 - DNA, 501 bp, Homo sapiens
  misc_feature: GYAE6OF02FSYQU.39.39.D06.1.454.CMB.1.raw
  modified_base (423)..(423): a, c, t, g, unknown or other
  misc_feature (423)..(423): n is a, c, g, or t
tcagtcgcactagtcacgaccggtgctcgatttagtgacatctcgcagttctttggggggggtctcaggaggcagcgctctcaggacatctccaccatggcctgggctctgctgctcatcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggccctcaggggtttctagtcgtcttctccggtctccaagtctggcaacacgctccctgaccatctctagctcagctgaggcgaggctgactattatgcagctanatatactgaagtcaatcggtatccgacgttggcttggttcggcggaggacctaggttcgaccgtcgtaggctaaccgg

SEQ ID NO: 189941 - DNA, 501 bp, Homo sapiens
  misc_feature: GYAE6OF02F1VNO.39.39.D06.1.454.CMB.1.raw
  modified_base (375)..(375): a, c, t, g, unknown or other
  misc_feature (375)..(375): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaactcttaattatgaggtctttcgtcgccctcagggtttctagtcgcttctccggctccaagtctggcacacgcctcctgacccntctctagactccaggctgaggacgaggctgactattatgcagctcattaatactagaatcaagtgtactccactggctggttcgggacggtaggacctaggttcgaccgtcgtaggtcagtacccg

SEQ ID NO: 189942 - DNA, 523 bp, Homo sapiens
  misc_feature: GYAE6OF02JZC7H.39.39.D06.1.454.CMB.1.raw
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgttggtgcttatattatgtctcctggttccaanagcattcagcagcgcccgaaatcttaattntgagttcttcgtcgccttgaggtttctagtcgcttcgtcgctcagtctggcaacgacgcctcctgaccagtctctagactccgaggtctggaggacgaggctgaccttattactgacagctacatatactagatcaagtgtactccgtatcgggtacttacggttcggaccggtaacggaccgtaacggttcgaacccggttccgtaggtaccgacgtaccccgg

SEQ ID NO: 189943 - DNA, 501 bp, Homo sapiens
  misc_feature: GYAE6OF02FV3P7.39.39.D06.1.454.CMB.1.raw
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactcttaattatgaggtctttcgtcggccctcgagggtttctagtcgcttctccggctccaagtctggcacncgcctccctgaccntctctagactccaggctgaggacgaggctgactattatgcagctcatatactgaatcaatggtatccactggcttggttcggcggtaggaccaggttcgaccgttctaggtcagtacccg

SEQ ID NO: 189944 - DNA, 504 bp, Homo sapiens
  misc_feature: GYAE6OF02GGYM1.39.39.D06.1.454.CMB.1.raw
  modified_base (370)..(370): a, c, t, g, unknown or other
  misc_feature (370)..(370): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgaggttctttcgtcgccctcgtagggtttctagtcgcttctccggctccaagtctggcaacncggcctccctgaccatctctacgactccaggctgacggacgaggctgactattatgcagctcatatactgaatcaatgtatccagtgctgttcggcggtaggacctaggttcgaccgtcgtaggtcagtacccg

SEQ ID NO: 189945 - DNA, 522 bp, Homo sapiens
  misc_feature: GYAE6OF02HDVG5.39.39.D06.1.454.CMB.1.raw
  modified_base (351)..(351): a, c, t, g, unknown or other
  misc_feature (351)..(351): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctctggttccaacagcatcaggcagcacccgaatctaattactgagttcttcgtcgcctgagggtttctagtcgcttctcggctcgatctgacacncgcctcctgacctatctctacactcaggctagacgagcggctacggacttattatcgcaacgtctacgtatttcgactaactcgaagttgacggtcttagtcgttacgtacgtaaggtcggtaaccgtaaggtcctaagttccgttccgtaggtctacggaccctaaccgg

SEQ ID NO: 189946 - DNA, 531 bp, Homo sapiens
  misc_feature: GYAE6OF02IN7CE.39.39.D06.1.454.CMB.1.raw
  modified_base (512)..(531): a, c, t, g, unknown or other
  misc_feature (512)..(531): n is a, c, g, or t
tcagtcgcactagtcacgaccggtgctcgatttagtgacatctcgcagttctttgggttttggggggaagaggaagactgacggtcctgccacaggtggtgctgggcacggggggcaccaactacaatgcgtccctcaggggtcgagtcaccatatctgcagacaagtccaaagaaccacttctccctgaggctgacctctgtgaccgccgcggactcggccatatattattgtgcgagtagtttttgcaggatcttgggggcggtatcgacgtctggggtcaagggatcacggtcatcggtctccgtcacgcctccaacccgaacgggccccaatccggttccgttccccccttggccggccccttcgccgttacccagggacggaccaccctaccgacggaagccaacgagcccgggtccctgggcctgcccgtaggtcaaacggactacttccaccttagtgaccgactggaggcgggtcgtacgggcggaaagcggaccagtaacggnnnnnnnnnnnnnnnnnnnn

SEQ ID NO: 189947 - DNA, 501 bp, Homo sapiens
  misc_feature: GYAE6OF02FXEP6.39.39.D06.1.454.CMB.1.raw
  modified_base (305)..(305): a, c, t, g, unknown or other
  misc_feature (305)..(305): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttangaggtctttcgtcgccctcgagggtttctagtcgcttctccggctccaagtctggcaacacggcctccctgacccatctctagcctccaggctggagcgaggctgactattatgcagctcatatactgaatcaagtgtatccactggcttggttcggcggacggtacaggttcgaccgtccgtaggtcagtacccg

SEQ ID NO: 189948 - DNA, 785 bp, Homo sapiens
  misc_feature: GYAE6OF02IQLF8.39.39.D06.1.454.CMB.1.raw
tcagtcgcactagtcacgaccggtgctcgatttagtgacatctcgcagttctttggggggggtcgtcaggaggcagcgctctcaggacatctccaccatggcctgggctctgctgctcctcaccctcctcactcagggcacgagggtcctgggcccagtctcgccctgactcaggctgcctcgtgtcgtgggtctcgtaggacagtcgatcaccatcctcctgcacgtacggaaccagctaggtcgtacgggttggggttatgactagttcgttctaccgtacggtaccagactaatactaccgaggaccaaccgaaccgaccccctaaaacttacctaacttacttaagttttaacgtacggtaacggttacgtaacgttaacgttccccggtaccgttacggttaacggggttttacctaacggttcccgttaccttttaccgttccgttacgggtacccttaaccggtaaacggttaccgtaccgggtaaccctaaccggtacccgggtcccctacccgttaccgtaacccttacgttcccgttcggtccgggtacccgtaccggacggtcggtacggacggacggtacggtcttaggttaactttaacgttacgtcgtacctacgttaccttagttacgttacgtacgtaagtaccgtaagggttcggtacgtttacgttttaggttaccggtttaccgggtaacgggtaacgggttacgggtaaccgttaacggtaccgttacggttacccggttacggttacgggtaccctaacccggg

SEQ ID NO: 189949 - DNA, 582 bp, Homo sapiens
  misc_feature: GYAE6OF02IOVRS.39.39.D06.1.454.CMB.1.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagtcgcactagtcacgaccggtgctcgatttagtgacatctcgcagttctttgggggggtctcaggaggcagcgctctcaggacatctccaccatggcctgggctctgctgctctcacctcctcactcaggcacagggtcctgggcccagtctggcctgacacagcctgcctcgtgtactgggtctctaggacagtcgatcaccatcctcctgcactggaaccagtcagtcgacgttggggttatggtactatgtctccgtggtaccagacaatatccaggcacgacgccccaactcatctatttangagtcagtaatccggacctgtagggttactaagtccgactttctntcggctctaagtctaggcaacgccgcctccctagacctatctacgtcgggtctccgacggtctggacgggaacgcggcttaggtatttaacttcgtcgtactacgtacttacgtatttacggctaatcgagtcgtagttaccttaagtcggttaccgttacgggtaacggtcggtaaccgtaacgggttccctagttaccgtttaccgtacggggttacctaacccgg

SEQ ID NO: 189950 - DNA, 582 bp, Homo sapiens
  misc_feature: GYAE6OF02F7FV1.39.39.D06.1.454.CMB.1.raw
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
tcagtcgcactagtcacgaccggtgctcgatttagtgacatctcgcagttctttgggggttctcaggaggcagcgctctcaggacatctccaccatggcctgggctctgctgctcctcaccctcctcactcagggcacagggtcctgggcccagtctggcctgacacagcctgcctccgtgtctgagactcctggaccagtccgatcaccatcctccctgcactggaacccagcagtgacgttggtgcttatatntgtctcctggttccaacngcattcagcagcgcccgaaactcttaattatgagtcttcgcgccctcgagggtttcagtcgcttcnccggctcagtctgcacacgcctcctgaccatctctacgacctccaggtctgacggacgagctagactattatcgactagccttacaattaactacgtaggaaacttcgaaagtttcggtaactcccgtaacgtcgggtaccgttgggtttacccgggaccgggtaaccggggtaacccttaaacgggtttccggtaacccccggtttacccgttaacggggtaccctaaccggtaacccccgg

SEQ ID NO: 189951 - DNA, 660 bp, Homo sapiens
  misc_feature: GYAE6OF02GQRU4.39.39.D06.1.454.CMB.1.raw
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcgagggcacgacgggtccgtcgggcccagtcgtcggcctgacacagcctcgcctccgtgtctgacgacctccgtaggacagtcgactccaacctactcctcctgaccacgtacggaaaccagcaggtcgtacggttggtntacttaataattagtcgttcttccgttacggttaccaacagctattcgagcacgaccgaccctaacttacttaattgngtacgttcgtttacggtccgtccttacggtacgggtttctacgtccgtctttccgtccggtctaccgtaacgtctacggaccaaccgccggtccctccgtacgacctacttcctactacgacctccgacggtcgtacgggacggtaccggacggtcttacgtacttaagttgtacgacgtagtcctactagttaacgtacgtacgtaactacgtaagtcgttactaccgtacgtcggtcgttgggttaccgggacgggtacggtaaccgtaggttccggtaccggttacgtacggtaccacggtacccg

SEQ ID NO: 189952 - DNA, 528 bp, Homo sapiens
  misc_feature: GYAE6OF02I6KH4.39.39.D06.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (433)..(433): a, c, t, g, unknown or other
  misc_feature (433)..(433): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtggttacaactatgtctcctggtaccaacaacaccccggacaaacgccccgaagtcatgatttangacgtcactaactcggcctcgagggtctctaatcgcttctcgtggctcaacgtcnggaccaacgacggccctccctanacccatctcgtcgggctccgagtctgacggcgaggtctgacttatacncgacagtctcatacttacagtcagtaacttctcgttccgtttgggacggtaggaccctagctcgaccgttcgtaggccacggccgaggcctaccg

SEQ ID NO: 189953 - DNA, 558 bp, Homo sapiens
  misc_feature: GYAE6OF02IKTA3.39.39.D06.1.454.CMB.1.raw
  modified_base (245)..(245): a, c, t, g, unknown or other
  misc_feature (245)..(245): n is a, c, g, or t
  modified_base (321)..(321): a, c, t, g, unknown or other
  misc_feature (321)..(321): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtntcttaataatttatgttcctcttggttaccaacgagtctacttcgaggtcagccgacccgtaaacttcttaaattnagtagttcttcgcgtcctgtaggtttctagtcgcttcgtccgtctacagtcgtgactaacgcgtcctccagacctatctctacgactaccaggtctgaacggacgnggctagacttatagtgacngtactacgattaatacgtagtaacgtcaagttagtactcctacgtggacttggtcggaggaacggtacctaagggtccgttaacccggtcgttaacggcgtacggtaacccg

SEQ ID NO: 189954 - DNA, 641 bp, Homo sapiens
  misc_feature: GYAE6OF02J2JVV.39.39.D06.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatccaccatctcctgcacgtgaaccagcagtgacgttggtgtcttataattntgtctctgtacctacagnattcgngcacgccgacccgtaactcttaattntgtagttcttcgtccggtccgttcgtacgggtttctacgtcgtcttccgtccggtacctcgtaacgtctcggaccaacgaccgtccctaccgtacgacctacttcctcgtacgtacctccgacggtcgtaggaacggtacggacggtcctacggtaacttagttatccggactacgtacctaccgtaagttaccgtacgttacgtaacgtacgtaaacgttcgtaacgttccctaagtttcggtcggttacggtttaccggggccgggtaacgggtaaccgttaacgggttaccggtaacccggttaccggtacggtacccgaaggtaccccgg

SEQ ID NO: 189955 - DNA, 546 bp, Homo sapiens
  misc_feature: GYAE6OF02HQ006.39.39.D06.1.454.CMB.1.raw
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgccccgaaactcttaatttatgagttcttcgtcggccctgtagggtttctagtcgtcttctccggctaccgagtctggcaacgcggccctcctgacctatctctagactccaggtctaggaggacgaggtctagacttattntcgctagctanattactactgaacgttcaagtcgtactaccgtacgtggtacctggttccgggacggtaacgggtaccgaaggtttcggacccgttaccgtaggtaccaggtaccccgg

SEQ ID NO: 189956 - DNA, 736 bp, Homo sapiens
  misc_feature: GYAE6OF02HWRXK.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctcgtgtctgagacctccgtggacagtcgatcaccatctcctgaccactcggaaccagcaggtgacggttggtgcttaataattatgttctcctggttccaacagctattcaggcaggccgaccccgtaaacttcctttaaatttactaggtacggtttccttttaccggtccggtccccgttcggtacggggttttcctaaggttccgtctttccgtcccggtcttaccgaaagtttcgtcgggacctaaaccgacccgggtcccttaccccgtagaaccccgtatttccgttaccgtacgtaccgttacccgacgggtcgttacgggaacggtaaccggacggtcctacggttaacctagtttaacgttcgacgtacgtccttactagttaactaacgtacggtaaacgttccgtaaagttacgggtaaccttcccggaacgttgggtacccgttttaccggggtaccggggtaccgggaaccgggttaacccggtaaggttttacccgggaaccccggttttaccgggttaacggttcccggaacggttacccccgg

SEQ ID NO: 189957 - DNA, 776 bp, Homo sapiens
  misc_feature: GYAE6OF02JGW2D.39.39.D06.1.454.CMB.1.raw
  modified_base (207)..(207): a, c, t, g, unknown or other
  misc_feature (207)..(207): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagctctggacagtcatcacntctctgcactgaaccagcagtgacgttgtgacttaatattatcgttctcgtacggttaccaagtacgtctacgttacgaacggtccaggtccccgtaaccccggtaaactttcgttttaaaacgtttaacgttgggtaacgttttccggttttccggtacccgggtcccttacgggttaacgggggttttccttaacggtttcccgtaccgtttccgttaccccgggttacttacccggttaaacgttccgacgggtaacctaaacccggtcccggttaccccgtccccgtaggtaccccttacgtttccccggttaccggtaccggggtcccttacccggtaggggtcccttagggaaccgggtacggttaccggtccgttaacgtaacgttttacgtacggtcgtaaccaggttaccctatttaaaccgttaacaaaccgttcgaacgttacggaacgtttcgtaggtttaccgtacggttaggtaaacgggttaccggaacggtaacgttcccgtagttcccgggttaacgtcggtaacccttacgggaacccttaacgggccccc

SEQ ID NO: 189958 - DNA, 538 bp, Homo sapiens
  misc_feature: GYAE6OF02GJY0O.39.39.D06.1.454.CMB.1.raw
  modified_base (332)..(332): a, c, t, g, unknown or other
  misc_feature (332)..(332): n is a, c, g, or t
  modified_base (502)..(502): a, c, t, g, unknown or other
  misc_feature (502)..(502): n is a, c, g, or t
  modified_base (506)..(507): a, c, t, g, unknown or other
  misc_feature (506)..(507): n is a, c, g, or t
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (520)..(521): a, c, t, g, unknown or other
  misc_feature (520)..(521): n is a, c, g, or t
  modified_base (523)..(538): a, c, t, g, unknown or other
  misc_feature (523)..(538): n is a, c, g, or t
tcagtcgcactagtcacgaccggtgctcgatttagtgacatctcgcagttctttggggggaagaggaagactgacggtcctgccacaggtggtgctgggcacggcgggcaccaactacaatgcgtccctcaggggtcgagtcaccatatctgcagacaagtccaagaaccacttctccctgaggctgacctctgtgaccgccgcggactcggccatatattattgtgcgagtagtttttgcaggatcgttggggcggtatcgacgtctggggtcaagggatcacggtcatcgtctcctcagcctccaccaagggcccatcggtcttcccccnggccgccctgctccaggcgccaccgtccgaagacgcaacacggccggcccctggggcctcggcccgtagggtaccaaaggggtacccttaacctttcccgaacttacggtagccgtaacgttggacggccggggtcgtcgggacgaaacggggtccgacgaagttacggnatgnngnannangnncgnngnnnnnnnnnnnnnnnn

SEQ ID NO: 189959 - DNA, 680 bp, Homo sapiens
  misc_feature: GYAE6OF02HDI4N.39.39.D06.1.454.CMB.1.raw
  modified_base (141)..(141): a, c, t, g, unknown or other
  misc_feature (141)..(141): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacngggtcctgggcccagtctgccctgactcaggctgcctccgtgtctgggtctcgtaggacagtcgatcacctatcctcctgccactcggaaccagcaggtcgtacggtttgggggttatgactatcgtctccgtggtaccagcaatacgtccaggacaccgaccgaccccctaaactcaacttctaagttttagcggtagttacgtaagttaacgtcccggtacccgttacggttaagggttttacctaactccgttactttccgtcgtacggtccttaccgtaacgttcgtacggacctaaccggtcccggtaccctccctacgaccctagttctcgacgggtccaccgtggctaggacggtacgacggtcttagtactttacgttacgtcgtactcgtccgtttacgtacgtttacgacttaagtcgttacgggtagtacggttcgtttacggttcggttaccggtttacggggtaacgttaccgggaacgttacggtaccgttacggttacccggttaccgtcgggtacctaaccgg

SEQ ID NO: 189960 - DNA, 635 bp, Homo sapiens
  misc_feature: GYAE6OF02GWYQT.39.39.D06.1.454.CMB.1.raw
  modified_base (322)..(322): a, c, t, g, unknown or other
  misc_feature (322)..(322): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatccaccatcctcctgcactggaaccagcagtgacgttggtgtcttataattatgtcttccgtggttaccaacagctattcgaggcacggccgaccccgtaaattctttaatttagngtagttcctttcgtccggtcccttacgtacgggtttctaggttccgtcctttcgtcccggtcttaccgtaacgtccgtacggaccaaaccgacccgggtccctccccgtagaccctattccctacgtaacgtccctaccgaggtcctaggaacggacggaggtccttagtaacctttattagtcgacacgtaccttacgtaattactacgttagtaacgtctaaagttcggttaactccgacgttcggtcgttacggttaccgggacggtacggtaacctaggttcggtaccgtcgtacggtcacggtacccg

SEQ ID NO: 189961 - DNA, 742 bp, Homo sapiens
  misc_feature: GYAE6OF02HMZH8.39.39.D06.1.454.CMB.1.raw
  modified_base (287)..(287): a, c, t, g, unknown or other
  misc_feature (287)..(287): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacgagggtcctgggcccagtctggcctgacacagcctgccctcgtgtctgagactcctggacagtcgatcaccatcctctgcacgtcggaaccagcgaagtgtacggttggtgtacttaataattatcgtccttacgtcgttaccaancgtactattcgaggcaacgcccgtaccccgtaaatttctttaaatttacgtaggtacggtttccgtttcggtcccggtacccgttggttaacgggtttctacgtccgtccgttaccgtcccggtacctaccgtaagttccgtacggaaccgaaccgtacccgggtccccttaccggtacgtaaccctacgtttccgtaaccgtaacgtacccgtacccgtaggtccgtaacggggtaacggaccgggtaacggtcgttaacggtaaactttagtttacgtcggtaacaccggttaccgttaactagttaacgttacgttaacgtaaaccgttaaacgtaagttcgttaaccttccggtaacggttcggtcgttacggggtccgggaaccgggtaacgggtacttaacggtcccgggttaccgttaccggtaacggtccggtaacccgtaacccgg

SEQ ID NO: 189962 - DNA, 717 bp, Homo sapiens
  misc_feature: GYAE6OF02GQU59.39.39.D06.1.454.CMB.1.raw
  modified_base (139)..(139): a, c, t, g, unknown or other
  misc_feature (139)..(139): n is a, c, g, or t
  modified_base (251)..(251): a, c, t, g, unknown or other
  misc_feature (251)..(251): n is a, c, g, or t
  modified_base (564)..(564): a, c, t, g, unknown or other
  misc_feature (564)..(564): n is a, c, g, or t
  modified_base (630)..(630): a, c, t, g, unknown or other
  misc_feature (630)..(630): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcncagggtcctgggcccagtctggcctgacacagcctgcctccgtgtctgagacctccgtggacagtcgatccaccatcctcctgcactacggaaccagcagtgacgttggttnacttaattaagttattcgttactccgtaggtttacccaaacgtagtctactttaccgaggtacaacggtcccggacccccgtaaaacgtttccttttaaaattttacgttacggtacggttttacccttttccggggtacccggtaccccgttcggttacggggttttaccttaaggttcccgttccgtttccggtacccggttacccgttaccgtaaacggttccgttacgggacctaacccgtcccgggtacccttcccgacggtaaccctacttcctacgtacgtacctacgacgtacgtcgacggacgnggtctacgtattacttacgtcgacgactactatagtactactacggtaatacgtaagtcgttaacnccgttacgtcggtcgttaggttacccggggaggtaaccggtagttaacgggtcgtaccgtacccggtagtaccgaccgtaaccccgg

SEQ ID NO: 189963 - DNA, 587 bp, Homo sapiens
  misc_feature: GYAE6OF02I41EK.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccagcagtgacgttggtgcttataattatgtctccgtggttccaacagcattcaggcagccgacccgtaaacttcttaattatgtaggttctttcgtcggtccctcgtagggtttctagtcgtctttccgtccggtcttaccgaacgttcgtcggaccaaccgaccgggtccctccgtacgaccctatcctctagacctcgacgtcgaggacggacgagtctagtacttattcgtcgcgatactactacttactacgtacgtaagtacctaagttcgtactccgtacgttggtcggttggtccgggacggtacggtaacgtacggttccggtaaccgtcgtacggtccgacgtaacccgg

SEQ ID NO: 189964 - DNA, 612 bp, Homo sapiens
  misc_feature: GYAE6OF02GBNSN.39.39.D06.1.454.CMB.1.raw
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
tcagtcgcactagtcacgaccggtgctcgatttagtgacatctcgcagttctttggggggggtctcgaggaggcagcgctctcaggacatctccaccatggcctgggctctgctgcctcctcaccctcctcactcagggcacagggtcctgggcccagtctggcctgacacagcctgccctaccgtgtcctaggacgacctccgtggacagtcgatccacctatcctccctagcacgtcggaaaccagcagtggtacgttggcgtcttaatattagtgtactcgtcggttccaanagtctaattcaggctacgccgacccgaaattcttaattangtacgttctttcggcgtcctgtaggttctacgtcgtcttcgtccggtctaccgagtcgtgacctaacgtaccgcctcctcgacctatccctgtaacnctccgagtccngacggacgtcgngtctaattacttcgtcggatccgtagtactattagtaaccttaggaaactgtaaagttggtacctacccgaagttcggtaccgttggtacccgggtacgggtagtacccggttacgtcgggttaacccctaggttaccgggtccacggtaaccccgg

SEQ ID NO: 189965 - DNA, 541 bp, Homo sapiens
  misc_feature: GYAE6OF02F6DP5.39.39.D06.1.454.CMB.1.raw
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataattatgtctctggttccacagcattcaggcagccgcccgaaactcttaaatttatgagttctttcgcgcctcgtagggtttctagtcgcttctcggctcaagtctgcaacncggcctcctgaccatcnctagcctcgagctcggaggacgngtcngtactattgtgacacgctacgacttaatacttagaaatcaagttcggtaactccgtaacgtggtcttcgggtttcgggacggtaagggaaccttaaggttccggtacccggttccgtacggtaccacggtaaccccg

SEQ ID NO: 189966 - DNA, 577 bp, Homo sapiens
  misc_feature: GYAE6OF02HR8RS.39.39.D06.1.454.CMB.1.raw
  modified_base (280)..(280): a, c, t, g, unknown or other
  misc_feature (280)..(280): n is a, c, g, or t
  modified_base (380)..(380): a, c, t, g, unknown or other
  misc_feature (380)..(380): n is a, c, g, or t
  modified_base (436)..(436): a, c, t, g, unknown or other
  misc_feature (436)..(436): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgtactccgtggaccagtcgaatcacctattctcctgccactcggaaccagctaggtgacgttggtgcttatattatgtctctgttccaacngcattcagcagccgcccgaaactcttaatttatgtagttcttcgtccgcctgtacgggttctagtcgcttctcgtctcaagtctggacacacgcctccgngaccatcctactacgctccgacgtctggaacggcgtacggctgtacttattacgtnactagtctcattacgtacgttagtagtacagttaggtacctccgtacgtggtccttaggttacccggggacggtaacgggtaccgtaacggttacccgggtacccgttacccggtttacggtaccgtaccggtaaccccgg

SEQ ID NO: 189967 - DNA, 630 bp, Homo sapiens
  misc_feature: GYAE6OF02HEMIG.39.39.D06.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacngtcgatcacatctcctgcactaggaccagcagtgacgttggtntcttaataattagtgtctcgtggttaccaacagctaagttcaggtcaacggccgacccgtaaatttcttaaatttgcggtaggtttcctttcggccggtcccttggtacgggttttcagtccgtcctttccgtccggcttaccgagttccgtggaccaaaccgtccgggtacccttcccgtacgaccctacttccgttactaacgtaccctccgaacgggtctacggacggaacggtcgacttcgtaattatttagtcgactacgtcctacgtatttcgatacgtcgaggttagtacgttaccttagttcgttaccggttagggacggttacgggaacttacggcgtacgttaccggttcgtacggtacaccggacctaaacccgg

SEQ ID NO: 189968 - DNA, 615 bp, Homo sapiens
  misc_feature: GYAE6OF02GDAWL.39.39.D06.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctggcccagtctggcctgacacagcctgcctcgtgtctgagacctcctggaccagtcgatcaccatctcctgcactggaaccngcagtgacgttggtncttaatattatgtctctggttccaacngctattcgaggtccagccgacccgaaacttctttaaattatggtacggttcttttacggtccgtcccgttacgtacgggttttctacggtcgtctttcgtcccggtcttaccaacggttcctggaccaacgtacccggtcccttcccgagtaccctagtcctacgtaacgaacttccgaggtcctaggacggtacgtcggtactaggtaccttatttaacgttcgacgtacgtccttactattaacgttcgtaagtaacgttaccaaagttcgtactcctaggtcgtcgtcggttaacgggcggtaggtacctaggttcgacccgttggtacgtccacggacccg

SEQ ID NO: 189969 - DNA, 733 bp, Homo sapiens
  misc_feature: GYAE6OF02JWEY9.39.39.D06.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
tcagtcgcactagtcacgaccggtgctcgatttagtgacatctcgcagttctttgggggggtctcaggaggcagcgctctcaggacatctccaccatggcctgggctctgctgctcctcacctcctcactcgaggcactaggtcctgggcccagtctggcctgacacagccctgccctcgtgtcagagactcctggacngtcatcaccatcctccngacactcggaaacngcagtgtacgttggtctacttataattatcgttctccgttcggttacccaacacgtactagttaccgacggtaccacggtacccgaaccccgtaaactttaccgtttaaagtttacgttacggtacgggttttaccgtttcccgggtacccggtcccgttacgggtacggggttttcctaccggttcgtccgttttccgttaccggtccttaaccgtaacgttcccggtacggtaaccgtaacccgtacccgggtcccttacccgtacgtaacccttacttaccgtacgttaccgacccgttaccgtaccgggtccgtacggtacggacggtaaccgggtacttagtacccttaagttacgttcgaactcgtaccgtacctacttacgtaccgttataacgttactaagttcgtacctaccgtagttaccggtcgtttcggaccgggtaccgggaacggtaccgtaacggtccgtaccgttaccgtacgtacggtacgacccg

SEQ ID NO: 189970 - DNA, 726 bp, Homo sapiens
  misc_feature: GYAE6OF02ICMJC.39.39.D06.1.454.CMB.1.raw
  modified_base (620)..(620): a, c, t, g, unknown or other
  misc_feature (620)..(620): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagacctccgtggacagtcgactcacctattcctcctgcacgtacggaaccagcagtcggacggtttggtagtactttaattaatttattcgttaccgttccgttacggttaacccaagtacggtactatttaccggacggtaccacggaccccgtaaccccgttaaatttaccgttttaaaagttttcgtacgggttaaccgggttttcccgttttacccgggtcccgtccccggttttaacgggttaacgggggttttcccttacggttcccggttccgtttcccgttcccggtccttaccgttaacgtcgttacggaacccgaaccgtaccggtcccctacccgttacgaacccttctccttaccgaacgtccttccgaggtccgtaggaacggtacggaggtctacgtacttacgttagtacgcttacncgtactatattacgtagtacgtatacgttcgtactcctaggttcgtcgttacggtcgggaggtacggtacgtagtccgtaccgttcgtaaggtcctacggtaccgg

SEQ ID NO: 189971 - DNA, 540 bp, Homo sapiens
  misc_feature: GYAE6OF02JFAFX.39.39.D06.1.454.CMB.1.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctctgtccanagcatcngcagccgcccgaatcttaattatgtagttcttcgtccgtccttcgtacgggtttctagtcgtcttcgtccggctccaagtctggccaacgccggcctcccgngacccntctctacgcctccgagctgacggacgagcttagacttattatcgcagtctanatatactagtaagtacaagttgtactcgtacgtcggtcgttcgtacgggcggtaacggtaccgttaaggttccgtaccggttccgtacggtaccgacgtacccgg

SEQ ID NO: 189972 - DNA, 723 bp, Homo sapiens
  misc_feature: GYAE6OF02HWY61.39.39.D06.1.454.CMB.1.raw
  modified_base (229)..(229): a, c, t, g, unknown or other
  misc_feature (229)..(229): n is a, c, g, or t
tcagtcgcactagtcacgaccggtgctcgatttagtgacatctcgcagttctttggggggggtctcaggaggcagcgctctcaggacatctccaccatggcctgggctctgctgctcctcacctcctcactcagggcacagggtcctgggcccagtctggcctgacacagcctgcctcgtgtctgagactcctggactgtcgatccaccatctctgcacgtcggaaccngcagtgacggttggtgtacttataattatcgttctccgtcggttccaacagctattcgacggcacggccgaccccgtaaacttacgttttaatttacgtacggtacggtttccttttcggtccggtacccttacggttacggggttttacctaggttccgtcctttccggtcccggtacctacccgtaagttccgttacggaccctaaccggtacccgggtccccttacccgtcggtaaccctaacgttcccgttaccgtaacgtaccgtaccgaacgggtccgtaagggaacgggtaaccgtcgggtactacggtaacctttaagttacgttaccgacgttacgtccttacgtaacttacgtacgttacgtaacgtacaagttgtaccttaccgaggttcgggtcgtttacgggttccggggacgggtaaaccggttacgttaacgggttcccggtaacccggttacggtaacggttccgacggtaaccccgg

SEQ ID NO: 189973 - DNA, 736 bp, Homo sapiens
  misc_feature: GYAE6OF02H2N3G.39.39.D06.1.454.CMB.1.raw
  modified_base (229)..(229): a, c, t, g, unknown or other
  misc_feature (229)..(229): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcacctcctcactcagggcacagggtcctgggcccagtctggcctgacacagcctgcctccgtgtctgacgactcctggacagtcgatcaccatctcctgcactgaaccngcagtgacgttgtgcttataattatgtctccgtggttccaacacgctagttcaggcacggcccgtaccccgtaaaacttccttttaaattttatggttaaggtttcctttccggtccggtccccttcggttacgggtttcctaggttccgtcctttccgtacccggcttacccgtaaggttccgttacggacctaaaccgacccgggtccccttcccgtacgaaccctacttcccttaccgtaacgtacccgtccgtaacgggtctacgggaacgggtaccggaacggtcttacgtaacgtttatttacgttcgacgtcggtaccttacgttaaatacgttaaccgttacggtaaacgttaccgtaaagggtttacggttaaaccctttacccggacggtttccgggtacgtttccggggttacgggaccggggtaaccgggtaaccgttaacgggtttcccggtaacccgtttaccggtaacgggtcccaccgggttaaccccggg

SEQ ID NO: 189974 - DNA, 729 bp, Homo sapiens
  misc_feature: GYAE6OF02JZKDX.39.39.D06.1.454.CMB.1.raw
  modified_base (140)..(140): a, c, t, g, unknown or other
  misc_feature (140)..(140): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
  modified_base (337)..(337): a, c, t, g, unknown or other
  misc_feature (337)..(337): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcaggcacgngggtcctgggcccagtctggcctgacactagcctgcctccgtgtactgagactccgtggaccagtcgatcaccattcctcngcacgtggaaaccngtcaggtgtacgttggtgacttataattntcgtcctaccgtggttaccaacgtcgctaattcgacggtcaacgccgaccccgtaaaattctttaaacgtttnaggtacggtttacttttcgggccggtaccttacggtacggggtttctacgtcgtccctttcgtcccggacttaccgaaggttcctcggggacctaacggtccggtccctccgttacgacctacttcgtacctaacggcctacgtaggtcgtaggtaacggcgtaaggtccgtaacgtactttaacgttacgttacgacgtacggtacgtacgtacgttaacgttacgtaccgggtaaaacctcggtaaagttaccgggttacctaccgtaacggtttccgggtccgtttaccggggttacgggccgggtaaaacccggggttctaaacggggttttcccggaaaccccgttttcccgggtaaacgggttacctaaaccccgggtaccccggg

SEQ ID NO: 189975 - DNA, 650 bp, Homo sapiens
  misc_feature: GYAE6OF02IQ3DE.39.39.D06.1.454.CMB.1.raw
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacacagcctgcctccgtgtctgagactcctaggacagtcgatccaaccatctcctgccacgtaggaacccagcaggtcgtacgttggtgtcttattaagttactgtctccgtggttccaacaggctatcgacggtcacggcccgacccgtaaacttccgtttaatttacgtgtacggtttctttcggtcccggtccttacggtaaggggttttcctaggttacgtccgtttaccgtcccggaccttaccgtaagttccgtacgggtaccaaccgtaccgggtccctaccctagtaccccgtattcccgtactacggtacctccggtacgcgttaggacggacgacggtctcggaacttattagttcgatcgtactactattacgtacgtatacgtactaagttggacctccagtgtaccgttggtacgggacggagggtaacgtacgttaccggaccgttacggtacgtagacccggtacccgg

SEQ ID NO: 189976 - DNA, 840 bp, Homo sapiens
  misc_feature: GYAE6OF02HL2P0.39.39.D06.1.454.CMB.1.raw
tcagtcgcactagtcacgaccggtgctcgatttagtgacatctcggcagttctttggggggggtctcaggaggcagcgctctcaggacatctccaccatggcctgggctctgctgctcctcaccctcctcactcagggcacgagggtcctggacccagtctcggcctgacacagcctgcctccgtgtctgacgtactcctggacagtcgatccaaccatcctcctgcctacgtacggaaccagctaagtgtacgttggtcgtactttaagtaattactgtccttaccttacggttacccaaacgacgtacctaacgtttccgaacggtacctaaccgtacccgtaacccccgttaaaaattttacgtttaaaacgttttaacgtacgggttaaccggtttccgttttacccgggtaacccgggtcccctttaccggggttaacggggtttttaccctaaccggggttttaccggtccccttttaccgggtccccgggttaccttaaccccggtaaaggtttcccgtacccggtaaccctaaacccggtacccggttcccccgttaacgtaccggtacccttaacgttcccttaaccgtaacggtaacccgttaccgacggtaccgttacggaaccggtacgggtaacgtccgtaacggttaacttaagtttaccgtacgacgtacgttactacgtaattacgtacgtacgtaacgttaacgaacgttgtacctccgttaggtaccgttcggttacggggttaccgaaccggggttaaggtacccgttacgggttaaccggtccgttaaccggtaaccggttccgaacccggttaacccgg

SEQ ID NO: 189977 - DNA, 835 bp, Homo sapiens
  misc_feature: GYAE6OF02JD85R.39.39.D06.1.454.CMB.1.raw
  modified_base (232)..(232): a, c, t, g, unknown or other
  misc_feature (232)..(232): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactacggaaccngcagtgtacggttggtgtacttaataattacgtcgttccttcccgttacggtttacccaaacgtacgtcctaacgtttaccgaacgggccgtaaccggaccccggtaaccccccggtaaaactttacctttttaaaagttttacgtacgggttaaccgggtttccgttttcccggggtcccggttaccccgttaccgggtttaacggggtttttacctaacgggtttcccggttcccgttttacccggtccccgggtacctttacccggtaaacggtttcccgttacggggaaccctaaacccggtacccgggttccccctttacccgtaccggtaaaccccttaacgtttcccttaaccgttaacgaccccgttaccggaacgggtccgtaacgggaaccgggaacgggtacgggtcccttaacggtacctttaagttttacgtcgggacctaacggtccttaacgtaacttaacgttacgtaacgtaaacgttacctaaggttcgtaacctccgtacgtcggtcgttacgggtacgggacggtaacggtaaccgttaaggttacccgtacccggtgttaacggaccgtaccggtaacccgg

SEQ ID NO: 189978 - DNA, 847 bp, Homo sapiens
  misc_feature: GYAE6OF02FWMC9.39.39.D06.1.454.CMB.1.raw
  modified_base (215)..(215): a, c, t, g, unknown or other
  misc_feature (215)..(215): n is a, c, g, or t
tcagtcgcactagtcacgaccggtgctcgatttagtgacatctcgcgagttcttgggggggtctcaggagcagcgctctcaggacatctccaccatggcctgggctctgctgctcctcaccctctcactcagggcacagggtcctggcccagtctaggcctgacacagcctgcctccgtgtcctgagactctggacagtcgatcaccatctcctncacgtggaaccagcagtgacgttggtgctttaataattagtacgtccttccgtcggtttaccaaacgtacggtctaacgtttccgaaggcctacggtcccgtacccccggtaaaacttcgtttaaactttacgtacggttacggttaccgtttttccggtacggacccctttacggtaacgggggtttttctaacgggtttccgtccgtttaccggtccgggtacttcccgaaaggtttccgtggggtaaccctaaaccggtacccggggtaccctttacccccggtacggtaaccctacgttaccctacccgttaaggtaaccccgtttacccggtaacggggttccgtaacggggtaacgggtaaccgggtaacgggtacccgttaacggtaaaccgtttaacgtttaacgttttaccgggacgttaacggtacgttaccaaagtttaactaaccgttaacgggtaaccgttactaaaccgttacggggttaacctttacccgaaccgggttgggttaaccgttacggggttaccggggacccgggttaaacgggtaaccccgttaacgggtttacccgggtaaccccggtttaccggtaaccgggtttaccgaccgggtaaacccccgg

SEQ ID NO: 189979 - DNA, 776 bp, Homo sapiens
  misc_feature: GYAE6OF02ICKLZ.39.39.D06.1.454.CMB.1.raw
  modified_base (253)..(253): a, c, t, g, unknown or other
  misc_feature (253)..(253): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgacgactccgtggacacgtcgatcaccatctcctgacacgtaggaaccagctagtagaagttggtntacttaataattactagtcttccgttgttaccaacacgactacttacgaggccacggcccgaacccgttaaactactttaagtttacgaggtacgtttccgtttcgtcccggtaccgttggtaacgggtttcctagttccgtaccgttcccgtccggtaccttaccgtaacgttcgtagggaccctaaaccggacccggttccctaccccgttaggaacccttaccgttacttaccgtaacgtacccgttaccgacgggtacgtacgggaacgggtaaccgtaggtaaccttacggtaaacctttaacgtttaacggtaccgacgttaaccgtaaccttacctaaagtttaaccttaaacgtaaagtaaaccgttaacgtaaaacgttccggtaaccttacccgtaaccgggttcggtaccggtttacgggtaaccggggaccgggttaaaccggtaacccgtaacggtttaccggaacccggttaacccggtaacgggtaccccgtaaccggtaaccccggg

SEQ ID NO: 189980 - DNA, 752 bp, Homo sapiens
  misc_feature: GYAE6OF02JGANS.39.39.D06.1.454.CMB.1.raw
  modified_base (174)..(174): a, c, t, g, unknown or other
  misc_feature (174)..(174): n is a, c, g, or t
tcagtcgcactagtcacgaccggtgctcgatttagtgacatctcgcagttctttggggggggtctcaggaggcagcgctctcaggacatctccaccatggcctgggctctgctgctcctcacctcctcactcaggcacgacgggtcctcgggcccagtcgtcggcctgaccacncgccctcgccgttccgtgtcgtgacgtacctccgtggactagtcgactcaccgtactcctctcgcctacgtacgaaccacgacgtggtacggacgttggtacgtacttaacttaagttacgttacacggttcgttacccctagggttccaactacgttaccgaaggttccaagggtcccgaaccggtaacgtacccccgttaaaaactttcctttaaagttttaacgtttcgttacgggttccgtttccgtacgggttaccgtttcgaaggggttttccttaacgttcccggtaccgtttcctccggtacgtttccgaagtcctaacggtccgtaccctccggaccctaccgtcgtacctacgtacttcctaacgtcgtccgtagggacctacgggacgtccggtacgtacgttacgttacttacgttacgttacgtacctagtaactactaacgttacgttaactacgtaaacgttacgtaacttacggtacgttccgtacgtttcgggtacggttagggtccggttaacgtagggtaccgtacggttaccggacgtacgtacggtaccgtaaccgg

SEQ ID NO: 189981 - DNA, 580 bp, Homo sapiens
  misc_feature: GYAE6OF02F5A8A.39.39.D06.1.454.CMB.1.raw
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (405)..(405): a, c, t, g, unknown or other
  misc_feature (405)..(405): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctccngcactggaaccagcagtgacgttggtgacttataattatgtctccgtgttaccaanagcattcgaggcagccgaacccgaaacttcttaatttatagtacgttctttcggcgtacctcgtagggtttctagtcgcttctccggtctaccgaagttcctgaccaaccgccggtccctccgtacaaccctntacctactaacgcctaccaggctacggacggacgtaacggctacgaacttaatttactcggactagccttacattactacgtagtaactactaagttcgtactcacgtaggtcttacggtcggacggtacggaacctacggttacgacccgtacgtacgtaccgaccgtaaccgg

SEQ ID NO: 189982 - DNA, 663 bp, Homo sapiens
  misc_feature: GYAE6OF02GVMLU.39.39.D06.1.454.CMB.1.raw
  modified_base (283)..(283): a, c, t, g, unknown or other
  misc_feature (283)..(283): n is a, c, g, or t
tcagtcgcactagtcacgaccggtgctcgatttagtgacatctcgcagttctttggggggggtctcaggaggcagcgctctcaggacatctccaccatggcctgggctctgctgctcctcacctcctcactcagggcacagggtcctgggcccagtctggcctgacacagcctcgcctccgtgtctgacgactcctggacagtcgatcaccatctcctcgcacgtcggaaccagcagtagacggttggtgtacttattaattatcgtctccgtcgttaccaancgctagttacgacgggcacgccgtaccctaaacttactttaatttatggtacggtttccgtttacgtcccggtccgttggtacgggtttactacggttcgtccttacgtcccggtactacctagtcgtcgacaaccgtccgcccttcctacgacctcttccctacacgtacctaccgagtcgtacggacgggtacgacggtcttacgtacttattacgtcacgtatacctacaaactttacgtacgtagtaacggtacttaacgtagttaccgtaccgtacgttcggttcggtagggttacccggggacgggaaaccggggttacctaagggtttcccgtaaccgggttaccgttacggggtacccaacggtaaccccgg

SEQ ID NO: 189983 - DNA, 597 bp, Homo sapiens
  misc_feature: GYAE6OF02GL91Q.39.39.D06.1.454.CMB.1.raw
  modified_base (229)..(229): a, c, t, g, unknown or other
  misc_feature (229)..(229): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatcctcctgcactggaancagtgtgacgttggtgttatactatgtctcctggtaccaacagccacccaggaccaaacgcccccaaactcaatgatttatgagtcaagtaatcggccctcgtaggggtttctaatcgcttctctggctccaagtctggacctaacgacccggtcctcccgtcgacccacttcctccgtgggcccttaccgacgggtcctagggacggacggacggcttagtactttaacgttaccgtgcctagctcaacttaagtaacaagccaacggccagtcctacttacgttggttacgggttacgttccggggaccggtaacgggacccaacggtctacccgggtacccggtcccgttagggtcccaacccgg

SEQ ID NO: 189984 - DNA, 1022 bp, Homo sapiens
  misc_feature: GYAE6OF02FPDKM.39.39.D06.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
tcagtcgcactagtcacgaccggtgctcgatttagtgacatctcgcagttctttggggggggtctcaggaggcagcgctctcaggacatctccaccatggcctgggctctgctgctcctccaccctcctcactcaggcacagggtcctgggcccagtctggcctgacacagcctcgcctccgtgtctgagactccgtggacncgtcgactcacctatcctcctgacactacggaaccagctaggtgtacggttggtntactttaataattacttcgttaccttccgtacggtttacccaaacgtacgtactaacgttaccgaacgggtaccgacggacccccgtaaacccccggtaaaaattttaccgttttaaaacgttttaacggttaccgggtttaaacgggttttccccggttttttacccgggtacccggttcccccggttttaaccggggtttaacgggggttttttaccctaacggggttttaccccggttcccgtttttaaccccggtaccccgggttaccctttaaaccgtaaaccggtttccgttaaccgggtaaccccgtaaaaccccggttacccccgggtttccccgtttaccccccggtaacgtaaaccccgttaaccggtttcccgttaaccccgtaacgttaccccgttaccgggaaccgggttaccggttaaccgggaaacggggtacccggtaacgggtacccttttacggggtaaaacctttttaacggtttaaccggtttggaaccccgttaaagggacccctttaccgtaaagtttaaaccccgtttaaggttaaacgaaccgttttaccggaaaaacgtttttccggggtaaccctttaccggtaaacccgggttccgggtttaacgggtttaccccgggtttaacccggggggaacccggggttaaaccgggggttaacccgtttaacgggggtttacccggtaacccccgggtttaccggtaacgggggtttaccccctaaaccgggtaccccccggg

SEQ ID NO: 189985 - DNA, 870 bp, Homo sapiens
  misc_feature: GYAE6OF02IVTUZ.39.39.D06.1.454.CMB.1.raw
tcagtcgcactagtcacgaccggtgctcgatttagtgacatctcgcagttctttgggggggggtctcaggaggcagcgctctcaggacatctccaccatggcctggggctctgctgctcctcaccctcctcactcagggcacagggtccgtgggcccagtctggcctgacacagcctgcctccggtgttcgtgagactccgtcggacagtcgataccacctatccgttcctacgaccgtaaccgtacgggaaccacgacgtacggtggtacggttgggtgtaaccttaattaatttagttccgttaccgttcccgttcgggttacccaaacgacgtaccttaacttcgacggtccgtacggaccccggaaccccgttaaacttaccttttaaagtttagtacggtacggtttccgtttccggtacccggtcccgtacggttacggggttttacgtacgttccggttccttccggtcccgtacgttaccgaacgtttccggtaccgtaacccggtaacccgtacccggtccccgtttaccccgtacggtaaccctaacgtttcccgttacgttaaccgtaaccccgttaccggaacgggttaccggttaacgggaaccggggtaacgggtaaccggttacttaaccgggttaaacttacgttttaacgtaccggaccgttaacgtacccttagtaaaccgtttcgttaaaccgttagggtaaaccttagggttaaccgttaaggttaaccccgttacgtacggtttcgggtaaccggttacggggttaccggggccgggtaaaccggtacgtaacgggtttcccggtaacccggttccgggttaaggtacccggaccggttaacccccggg

SEQ ID NO: 189986 - DNA, 693 bp, Homo sapiens
  misc_feature: GYAE6OF02J1P38.39.39.D06.1.454.CMB.1.raw
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
  modified_base (484)..(484): a, c, t, g, unknown or other
  misc_feature (484)..(484): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctctgccactcggaaccagcagtcgacgttgngtcttaataattactcgtactcctggtaccaangctatcgagcagccgccctaaattcttaattacgngtacgttcttacgccgtccgtgtacgggtttctacggtcgtcttaccgtcgtctacgagtccgtcggtaacaaccgtccggtcccttccgtacaacctgttacctaccgtacgaccttaccggacggtctacgggacggaacggcggtacgttacgtacttaagtttacncggtaactacgttcctattaacttaacgttaccgttaggtaaaaccgtttacgtaaaggtttacccggttaacgttcccgttaaccggtttcgggttcccggtttcgggggtaacccggggaaccgggttaaccggggtaacctttaaccggggttaccgtaaccccgggtttacgttaccggggtacccgtaacccggtaaccccggg

SEQ ID NO: 189987 - DNA, 595 bp, Homo sapiens
  misc_feature: GYAE6OF02I09GW.39.39.D06.1.454.CMB.1.raw
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (471)..(471): a, c, t, g, unknown or other
  misc_feature (471)..(471): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctgccctgactcaggctgcctccgtgtcgtggtctcgtaggacagtcgatcacatctccgtgccagtgaccagcagtgacggttgggttatgactntntcgtcgtgtaccagcaatactaccgaggacacgaccgacccctaactacactactatttactgtaggtactaagtaacgtcgcccgttcgtacgggttactaacgtcgtcttctcgtcgtacctacgacgtctaggacctaacgaccgtctccctacacctatctacgtcggtctcgacggccagggacgagtacgtcgtagtacttagttacgtntacgtcgtacgtactagttacgactaactagacggttagacgttacgttacgttcgttaccgttacggaaacgttcggtaaacgtaacgttacgtaccgttacgtccgtacggtacctaaccgg

SEQ ID NO: 189988 - DNA, 693 bp, Homo sapiens
  misc_feature: GYAE6OF02JUNAG.39.39.D06.1.454.CMB.1.raw
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (570)..(570): a, c, t, g, unknown or other
  misc_feature (570)..(570): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcgagggcacagggtcctgggcccagtctggcctgacacagccctgcctccgttgtctaggacgaacttcccgtgggaccaggtccgatccacccattccgtctgacacgtacggaaccagcctaggtcgtacgttggtgacttaatattatgtcctcgtgtaccaangctagtcagcacgccgacccgtaattcttaagttatggtagtcctttcggcgccttaggtacggtttacnggttcctacgtttccgtaccggccttaactacggttcctcggtacaaccggtcccgccttcctacgacccttactaccttacgtctaacccgttcgaccggttcgtggaacggtaccggtacggtaccttaggtactttaacgtttagttccggaacgtcggtaacttccgtaagttaaccttacggttacggtaaaactnttaaacggtcgttaacgcccggttaattccggtacgttttccgggtacgggtaccggggttacggtaacggttaccgtccgggttaaaccgttacccggtacgggttacgaaccgtacccggg

SEQ ID NO: 189989 - DNA, 578 bp, Homo sapiens
  misc_feature: GYAE6OF02HSC7H.39.39.D06.1.454.CMB.1.raw
  modified_base (144)..(144): a, c, t, g, unknown or other
  misc_feature (144)..(144): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
  modified_base (478)..(478): a, c, t, g, unknown or other
  misc_feature (478)..(478): n is a, c, g, or t
  modified_base (494)..(494): a, c, t, g, unknown or other
  misc_feature (494)..(494): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
tcagtcgcactagtcacgaccggtgctcgatttagtgacatctcgcagttctttgggggggggtctcaggaggcagcgctctcaggacatctccaccatggcctgggctctgctgctcctcaccctcctcactcgagggcacgngggtcctcgggccagtctgccctgactcacgcctcgcctccgtgtcgtggtctccgtggacagtcactcacctatcctcgtncacgtggacncagtcgtagtgtacggttggttagttaactacttagtcgtcctccgtagaaccacgacnccaaccgagaccaaccgacccaatcagtcgtatttagaggngtactaacggttacnccggtctcggttacggttactacgttctacttcgtcgtacgtactacgtagtcgacgaccaccgtccgtacctacnctaacgtctcggtcgtaccggtcctcgaacggtcgtagggacggtcgagtnttacgttattactcgngcctacgtacactatacgatcngaanccntactnttcgtggtcgtaggtacgggcgtaagacctggtcacgtacgcggtcacgg

SEQ ID NO: 189990 - DNA, 698 bp, Homo sapiens
  misc_feature: GYAE6OF02FVAQW.39.39.D06.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacagggtcctgggcccagtctggcctgacacagcctgccctccgtgtctganacctccnggacagtcgatcaccatctactgcactggaaccngctagtgacgttggtnacttaataattatgtcctcttcggtaccaacagactatcaggcacgccgaccctaaatctttaattagtagtacgttccgtttccggtaccgtcccgttacggtacgggttttactacgttccgtcctttccgtcccggtaccttaccgaaacgtttccgtacggacctaaaccggtcccgtcccgtttccctaggtacccctaagtccttaccgttacgtaaccctcccgtaacgggtactaggggaacgtaccgggaaacggttccgtaacgtaacgttaagtttactacggcgtacgtacctacctaagttaacttaaccgttgaaaccgttaccttaggttacgtacccttaccgaacggttggttaacccgttacggggttacgaaccggggtaccgtaagtacggttacgtaaccggttccggtacggtcggaactaaccccggg

SEQ ID NO: 189991 - DNA, 848 bp, Homo sapiens
  misc_feature: GYAE6OF02ISPX7.39.39.D06.1.454.CMB.1.raw
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacgagggtccgtggccctagtcgtggcctgacacgacgcctcggccttcgtgtctagacgtacctccgtggacgtagtccgaactccaacctacttcccgtcctgcctaacgtacggaaccacgctaagtcggtacgttggtacgttaactttaataagttttctacgttcctacccggttacggttaacccaacgacgttccgttaagttaccggacggggtaccacgggtacccccgtaaaccccgtaaacttttacgtttaaaacgtttacgtacggggtttaacgttttcccggttttaaccggtccccgggttacccttacggggtttaacgggggtttttacctaccggggtttacccgtttacccggttttcccgttacccggggtaacccctttaccggtaaaacgggtttccgtaaccgggtaacccgtaaacccggtcccgggtcccctaccgtaccgtaaccgtaccttccgttaacgtaccggtaccctacggtacggtcgttacgggaaacgggacggtacggtcttaaccggtacgttaagtttcgccgtatacgtactacgtattaacgtacgttaacgttaacggtacttaaggtaccgtactacctaggtcgtaccggttacggggacgtaccgggtaagttaaccgttacgtaccggttaccggtacggtaccggttagacccgtaccggg

SEQ ID NO: 189992 - DNA, 755 bp, Homo sapiens
  misc_feature: GYAE6OF02JHQVJ.39.39.D06.1.454.CMB.1.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
tcagtcgcactagtcacgaccggtgctcgatttagtgacatctcgcagttctttggggggggtctcaggaggcagcgctctcaggacatctccaccatggtctgggctctgctgctcctcaccctcctcactcagggcacgagggtcctgggcccagtctcggcctgacacgagcctgccctcgtgtctgacgtacctccgtggacagtcgatccacatcctctgctacgtggaaccngcaggtcgtacgttggtntcttaatattagtcgttcctccgttaggtaccaaacgtgtactagttacgacggtaccaccggacccggtaacccgtaaacttacgtttaaagtttacgtaggttacggtttacctttccgggtcccggtacccgttagggttacgggttttactacggtttcgtcccgtttaccgccggtaccttacgtaacgttcgtaacggtacccaaccggtacccgtccctaccgtacgtaaccctacgttcgtacccgtacgtacccgtaccgaacggtcgtaacggacggtaccgtcggtccttaaggtaacctttagttacgcgtacgacggttactaacgtacttaagtaccgtaagtttaacccgtactaaggtttacggtacccttacgtcggttaccgggtaccggtttaccgggttaacggggccggtaaacggtaacccgtttaccgggaccgttaccccgggttacgtaacggttcccggaacccggtacccgg

SEQ ID NO: 189993 - DNA, 979 bp, Homo sapiens
  misc_feature: GYAE6OF02HBUKY.39.39.D06.1.454.CMB.1.raw
  modified_base (161)..(161): a, c, t, g, unknown or other
  misc_feature (161)..(161): n is a, c, g, or t
  modified_base (236)..(236): a, c, t, g, unknown or other
  misc_feature (236)..(236): n is a, c, g, or t
tcagtcgcactagtcacgaccggtgctcgatttagtgacatctcgcagttctttgggggggggtctcaggaggcagcgctctcaggacatctccaccatcggccgtgggctctgctgctcctccacctcctcactcgacggcacgacggtccgtcggaccngtctcggctagacacgcgcctcgtccctccgtagtcgtgacgacctccgtaggacgtacgtcgtactcgtaaccncttcctaccgtcgtaccgtaccgtaccggacctacggaccgtaggttcgtaaccgtttggtagttacctttaaattacggttacttcgttaccgtccgttaccggttaaccacacgtacgttactcggaccgggacctacgggaaccccgttaacccgtaactttaccgttttaaaacgttggttcgttaccggtttaaccgttttccggaccggttcccggtttaaggtttccgggtttaaacgttccggtttacccggttacgttcccggtttaccggtacccacggtttaaaacgtttccgtacccggtaaccgtaaacccgtcccggttacccgttaaccggccttaaccgttcgttaccgttaacccgtaacggtaccccgttaacgcgggtaaccggtaacggtaccgggttaaccgggtacggtttacccggttaaacggttacgttttaaacgggttaaccgtccgtaaccggtttaacccggttactttaaaccgttttaacccgttaacgggttaacgttaccggggttttaaaactaaaccgggtttaaccggttacccgtttaaccggtttacccggccggggtttttaacggtacccgggggtttttaacccgggacgggggggtacccgggttaaaaacgggggtccccggtttttacgggtacccccggttttaagggggtaccccggtttaacccgggacccggggttaaaccccgttacccggggg

SEQ ID NO: 189994 - DNA, 689 bp, Homo sapiens
  misc_feature: GYAE6OF02G9COO.39.39.D06.1.454.CMB.1.raw
  modified_base (646)..(646): a, c, t, g, unknown or other
  misc_feature (646)..(646): n is a, c, g, or t
tcagtcgcactagtcacgaccggtgctcgatttagtgacatctcgcagttctttggggggggtctcaggaggcagcgctctcaggacatctccaccatggcctgggctctgctgctctcacctcctcactcagggcacagggtcctgggcccagtctggcctgacacagcctgcctccgtgtctggagacctccgtggacgacgtcgatccaccatcctcctcgcaccgtaggaaccaagctaagtcgtacggttggtcgtcttaaacgttaattagttcgttccttccgttacggtttaccaaactacggacctaattccgaggtccgaccggcccgaccccgttaaacgtttcctttaaaacgttttacgtcggtaacggtttccgttttaccggtcccgtccgttacggtacgggtttttacacggttccgttcgtttcccgtccggtcctaccgtaagttccgtcggaccgaacgacccgggtccctccctacggaccctacgttcctaccgttacgaccctaccgacggcgtacggtacgggacggtcggtactacggtacttaagtttctcgacgtagtcctactattactaacgttgaaagtctaagttggtacctcgtaggtcgtcgttggtaccggnggtacggtacgtacggtcgccggttcgtacgtcgacgtaccgg

SEQ ID NO: 189995 - DNA, 724 bp, Homo sapiens
  misc_feature: GYAE6OF02IMT1V.39.39.D06.1.454.CMB.1.raw
tcagtcgcactagtcacgaccggtgctcgatttagtgacatctcgcagttctttgggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgaatcaccatctcctgcactggaccagcagtcgtacgttggtgactttaataatttatgtccttcctggttaccaaacagctattacgaggtacgagaccgccccaaaacttctttaaatttagtaggtaggttactttccggtaccggtacccttacggtacgggtttttccaacgttacggtccttttccgtacccggtcttacccgtaaagtccgttacggactaaacccgaccgggtccccttaccctacgtaccctacttaccgttacctaaaggtcctaccgtagggacttggaacgggtacgaacgggtactacgttaaacgttaatttaacgttgacgttacgacttacctaaagttaagttaaccgttaacggaaacgttaactaaaggttcggtaaaccttaccgaaccggtttgggtccggtttaacgggtccggggtaacggtaaccgggtaacctaacggggtttacgaaccccgttacgtaacgggtaccaacggtaacccccgg

SEQ ID NO: 189996 - DNA, 750 bp, Homo sapiens
  misc_feature: GYAE6OF02F9QMI.39.39.D06.1.454.CMB.1.raw
tcagtcgcactagtcacgaccggtgctcgatttagtgacatctcgcagttctttgggggggggtctcaggaggcagcgctctcaggacatctccaccatggcctgggctctgctgctcctcacctcctcactcgagggcacgacgggtcctcgggcccagtctcggcctgacacagcctcgcctccgtgtctgacgacttccgtggactaggtcgactccacctatcctcctcgactaccgtacgggaaccagacgtaggtacggtacggttggtctacgtttaataagttcttcgtaccttccgttcgttaccaacgagtctagttccgaggcaccggacccgtaacccgtaacttactttaacttgtacgtacggtttccgttaccggtccggtcccgttacggttacgggtttactacggttccgttaccgttcccggtcccggtacgttacccgtaacggtttccgtaccggtacccgtaaaccgtccccggttacccttcccgtacgtaaccttacgttccgtcctaaccggtacctccggtaggtccgtaggaacggtacggttacgtcgttaaggtactttacgttagtcgacgttcgtactacgtacttaacgtcgtaagttaacgtagtacgttacgtaccgttacgtacggttcggttcggtaccggttcggggaaccggttaaggttaccgtacggttcccgttaccggtcgttaacccgggtccaaccgggttacccg

SEQ ID NO: 189997 - DNA, 654 bp, Homo sapiens
  misc_feature: GYAE6OF02JL5L6.39.39.D06.1.454.CMB.1.raw
  modified_base (83)..(83): a, c, t, g, unknown or other
  misc_feature (83)..(83): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
tcagtcgcactagtcacgaccggtgctcgatttagtgacatctcgcagttctttggggggggtctcaggaggcagcgctcctnaggacatctccaccatggcctgggctctgctgctcctcaccctctcactcagggcacagggtcctgggcccagtctggcctgacacagcctgccctcgtgtctgancctcctggacagtnatcacntctcctncactgaccngcagtgacgttggtgctatattatcttctctcgtccaacngctatacacggcacgtacccgacccgtaaacttcgttaattttagngtacggttacgtttccggtaccggttccctcggttagggtttccgttacgtttcgtcccgtttacggtccggtacctaccgtaacgtcgtacgggtacctaacggacccggtccctaccttccggaaccctcgttaccttaaccggtacctaaccgttccgtaacggtccgtacggtaccggtaacggacggttcgtaacggttacgttacttaagtttcgactacgttctaccgtattaccgtacgttagtaactacgtattacgtactccgtagtcgtcttcggttacggcgggtaacgtaccgaacgttcgaccgttaccgtacggtccgacgtacccgg

SEQ ID NO: 189998 - DNA, 834 bp, Homo sapiens
  misc_feature: GYAE6OF02JV5S4.39.39.D06.1.454.CMB.1.raw
  modified_base (120)..(120): a, c, t, g, unknown or other
  misc_feature (120)..(120): n is a, c, g, or t
  modified_base (135)..(135): a, c, t, g, unknown or other
  misc_feature (135)..(135): n is a, c, g, or t
  modified_base (143)..(143): a, c, t, g, unknown or other
  misc_feature (143)..(143): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
tcagtcgcactagtcacgaccggtgctcgatttagtgacatctcgcagttcgtttggggggggtctcaggaggcagcgctctcaggacatctccaccatggcctgggctctgctgctccncaccctctcactcgngggcacgngggtccctgggcccagtctggccctagacacacgtccgtgcccgtccgtgtctggaacgtacctccgtaggacacgtcgagtccaacctactcctctgaccngtaccgaacngtacnggttccgacggttcggtgtccgttaattaattacgttccgtcgttcccgtcggttaccccgaactaggtctacgtttaccggaaggaccgcggacccggaaccccgttaaaacctttaccgtttaaagtttaaccgttgggtaaccggttttcgtttaccggttccgtaccgtttccggtaaccggggtttacttccggtaccgttccgtttccgtacccgggtacttaccgttaacgttagtcccgtaaaccctaacccggaacccgggtccccgttaaccgtccgaaacctccttaccgttacgtaacgtccgttacccgttacgggtacttacggggaacggaaccggttacggacgtttcggtaaacctttgtttacgtacggtcgtacgttacctactaaccttgtaaccgttaagtttaaccggaacttaaggttaccgtaaccgttacccgtagttaccggttacggccgggtttaccggggggaaccgttaacgggttaacccggttaaccgggtttactaacccggggttacgaacccggtttaccccggtaaggaacccccggg

SEQ ID NO: 189999 - DNA, 729 bp, Homo sapiens
  misc_feature: GYAE6OF02JMO0T.39.39.D06.1.454.CMB.1.raw
  modified_base (241)..(241): a, c, t, g, unknown or other
  misc_feature (241)..(241): n is a, c, g, or t
tcagtcgcactagtcacgaccggtgctcgatttagtgacatctcgcagttctttgggggggtctcaggaggcagcgctctcaggacatctccaccatggcctgggctctgctgctcctcaccctcctcactcagggcacagggtcctgggcccagtcctggcctgacactacgcctgccctccgtgtcagagtacctcgtaggacaggtcatccaaccatcctcgtgcacgtacgaaacgncgtagtgtacggttggtcgtacttaacgtaattagtcgtcttccgttcgtacaacgcgtactacttcgcgtacgaccgcccgacccggttaaacttaccttttaaagtttacgtaacgggttcgttttaccggtttccggtacccgttcccgttaaccggggtttcggtttaacgttcggtaccgtttccgttccggttcccgtccgtaaaccggtaccgtttcggaccgtaacgtaaccgaccgttcccctccgtacgtaccgtcttacctacgtacccgtacgtaaccgtcggttcgaagggtcggtaacgtcggttaccgacgttattacgttacgtaacggcttaaggtccttagtacttaagtacttacggtaactacggtaacgtgttacctactacgggtcgttggttaccggtacggtaccgggaaccgtaggtttaaccggtacgacccggttaccgtaacggtcccgtaaaggcccgg

SEQ ID NO: 190000 - DNA, 783 bp, Homo sapiens
  misc_feature: GYAE6OF02JQQ2P.39.39.D06.1.454.CMB.1.raw
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (330)..(330): a, c, t, g, unknown or other
  misc_feature (330)..(330): n is a, c, g, or t
tcagtcgcactagtcacgaccggtgctcgatttagtgacatctcgcagttctttggggggggtctcaggaggcagcgctctcaggacatctccaccatggccgtgggctctgctgctcctcacctcctcactcgagggcacgagggtcctcgggccagtcgtcggtacctgacacngccgtcgcctcgtntacngacncctcgaggcacgtcgactccactactcctcacgccacgtacgaacncgtacgtacgtacggtcggttcggtactaactttataacgtttcgtacgttccgtacgttacgtaacccgagaactccgtagtacncggtacaccggtacccgtacccgttaaattcgtttaagtacggtcggtaggtttcctttaccgcggttccgttaggttacggttacttcgtccgttaccggttcgtacccgtcggtttaacctacgggttccggtaacgaacccgtacgggttaccctcccttacccgttaaccggacccttccgttaccgttaccgtaaccgttcccgaccgtcgggttaccggaccggtaacggttacccggaacgttctaacggttacgtttacgtaacgtccaccggttacttaccgtaacgtaccgttacgtaagttaccgttaacggttacgtaccggtagttcccttacggtccggttacggtaacggttccggggttacgggtaacggggtaccggtaaaccggttcgggttaaccgtacccgggtacgttaccgggtacgtaccccggtaccgg

SEQ ID NO: 190001 - DNA, 765 bp, Homo sapiens
  misc_feature: GYAE6OF02FUSXH.39.39.D06.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcgagggcacgagggtcctgggccccagtctcggcctgaccacacgcctgccgtccgtgtctgacgactccgtggaccagtccgatccacctatcctccctncctacgtaggaaccngcagtgtacgttggtctacgttatagttatcgtcttccgtacggttaccaacagtcctacgttcgacggacgtccggacccgaaccccggttaaccttacgtttaacttaggtagttaccgggttaccttttccggtcccggtaccccgtaggtttaccggggtttactaaacggtttccgttcctttcgttcccgttacggtacccgttcgtaaaccgttcttaacgggacccaaaccgttcccggtacccgttacccgtcgtaacccgtacgttccggttccgttaccgggtccctaccggtacgggtaccgttcggggaacggtaacccggtggtccgttaagttaccgttttaacgttccggtaccgtacggaacgttcccgttaagtttcgttacgaccgtaagtcgtaaaggttccgtcgtttacgttagtcggtttacgttaacgggtacggtaccggtaacgttacggaccgtccgttacgggttacacggttaccgaccggtaacccg

SEQ ID NO: 190002 - DNA, 708 bp, Homo sapiens
  misc_feature: GYAE6OF02GFJZY.39.39.D06.1.454.CMB.1.raw
  modified_base (170)..(170): a, c, t, g, unknown or other
  misc_feature (170)..(170): n is a, c, g, or t
  modified_base (189)..(189): a, c, t, g, unknown or other
  misc_feature (189)..(189): n is a, c, g, or t
  modified_base (233)..(233): a, c, t, g, unknown or other
  misc_feature (233)..(233): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcagggcacgagggtcctgggcccagtctggcctgacanagcctgcctcgtgtctganctcctggacagtcgatcactatctcctgctacgtacggaaaccngacgaggtcgtacgttaggtgtactttaattaattattacggttccttaccgttaggtttacccaacgtacggtactaacgttcgaacggtccgaacggacccggtaaccccgtaaactttaccgtttaaatttacgtacgttaaccgggtttcctttccggggtaccgtcccgttacggtttacgggtttactacggttccgttaccttccgtccggtacctaccgtagtcgtacgaccgaaccgtacccggtcctaccgtactacctacgtccgttaccgtacgtaccgtaccgtagtcggtacggtacggaccgtagggtcctacggttaacttagtttacgacgtaccgtagaccttcgaaatttacgttaacgtaagtacgttacgttaagtacgtactcgtacgtcggtactgggtaccggaggtaccgacgttagtacccggtacgtacgttacgccgacgtacccgg

SEQ ID NO: 190003 - DNA, 890 bp, Homo sapiens
  misc_feature: GYAE6OF02GFG6J.39.39.D06.1.454.CMB.1.raw
  modified_base (208)..(208): a, c, t, g, unknown or other
  misc_feature (208)..(208): n is a, c, g, or t
tcagtcgcactagtcacgaccggtgctcgatttagtgacatctcgcagttctttggggggggtctcaggaggcagcgctctcaggacatctccacatggcctgggctctgctgctcctcaccctcctcactcgagggcacagggtcctgggcccagtcgtcggcctgacacgagcctgcctccgtgtctagacgtacctccgtggacngtacgactccaccgtattccgtcctcgacctacgtcggaaaccctgactacggttacggtaccggttggtctacgtttaataagttacgttcgtacttaccgttcggttaaccaacgtcgctaagttacgacggtcaccgggtaccgtaaccccgtaaattacttttaaagttacgtaagggtacgtttccggttcggtacccggtccttcgggttacggggttttcctacggttccgttccgttttccgtacccgggtcctttaaacccggtaacggtttaccgaccggggtaaacccaaccgggtaccccgggtttacccctaccgttaacccggtaacccgtacggtttaaccttaccccggttaaccggaaacccgttccggtaacggttacccgttaacggggtaaccggggttaacggtacgggtccgtttaaacgggtaaccttttaacgggtttcgtaaccgtacgttaaccgggttacctaacggttaaaccttacggttaacgttacgtaaaccggtttacgtaaacggttacgttaaccgttccgtaacggtttacgggtacgggttttaaccgggtccggggaacgggttaaccgggtaaccggtttcggtttaacccgggtacccggttaccggttaaccgggttaccgtaaaccccggtaaccccggg

SEQ ID NO: 190004 - DNA, 555 bp, Homo sapiens
  misc_feature: GYAE6OF02GOW8Q.39.39.D06.1.454.CMB.1.raw
  modified_base (374)..(374): a, c, t, g, unknown or other
  misc_feature (374)..(374): n is a, c, g, or t
  modified_base (520)..(520): a, c, t, g, unknown or other
  misc_feature (520)..(520): n is a, c, g, or t
  modified_base (524)..(530): a, c, t, g, unknown or other
  misc_feature (524)..(530): n is a, c, g, or t
  modified_base (532)..(540): a, c, t, g, unknown or other
  misc_feature (532)..(540): n is a, c, g, or t
  modified_base (542)..(555): a, c, t, g, unknown or other
  misc_feature (542)..(555): n is a, c, g, or t
tcagtcgcactagtcacgaccggtgctcgatttagtgacatctcgcagttctttggggggaagaggaagactgacggtcctgccacaggtggtgctgggcacggcgggcaccaactacaatgcgtccctcagggtcgagtcaccatatctgcagacaagtccaagaaccacttctccctgaggctgacctctgtgaccgccgcggactcggccatatattattgtgcgagtagtttttgcaggatcgttggggcggtaccgacggtcgtggggtacgaagggtatcacggtcagtcgtctcctcgacgtccctccaccgaacgggcccagtccggtccttcccccgtcggccgtcccgtcgcctccgaggtacnccaccgtccgagacgtccaacgcgacccggtccgtgggcctcggcccgttggtaccgaaaggtaccttacgttaccctacgttaagtcggccgaacgttcgggaacggtccgggacgttcgggaccgtaagggccgcgtaaagtgngacnnnnnnngnnnnnnnnngnnnnnnnnnnnnnn

SEQ ID NO: 190005 - DNA, 645 bp, Homo sapiens
  misc_feature: GYAE6OF02GDJJS.39.39.D06.1.454.CMB.1.raw
  modified_base (171)..(171): a, c, t, g, unknown or other
  misc_feature (171)..(171): n is a, c, g, or t
  modified_base (184)..(184): a, c, t, g, unknown or other
  misc_feature (184)..(184): n is a, c, g, or t
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (435)..(435): a, c, t, g, unknown or other
  misc_feature (435)..(435): n is a, c, g, or t
  modified_base (576)..(576): a, c, t, g, unknown or other
  misc_feature (576)..(576): n is a, c, g, or t
tcagtcgcactagtcacgaccggtgctcgatttagtgacatctcgcagttctttggggggggtctcaggaggcagcgctctcaggacatctccaccatggcctgggctctgctgctcctcaccctcctcactcgagggcacgagggtcctgggcccagtctggcctgacanagcctgcctcgtntctgacactcctggacagtcgatcacatctcctnacagtcgaaccagcgagtgtacgttggtntacttataaattntgtcctcgtaggtaccaacagtccatccgagcacgacccgtacccgtaattactttaagtttatcggttagttcctttcggaccgtccgtggttacggtttactcgtccgtcttaccgtccgtctaccgtaacgtcgtaggacctaacgtaccggtccctaccgtgtaaaccctnttaccgtacgtacgacctcgacggtacgtacgacggacgtacggtccctaagttaaccttagttagtacggacctagtcccttaagtacttacgtaactagggtaaacctcgtaagtaccgttaccacgttacgtcgggtnttaccgggtacgggacggtacgtaaccgtagttacccggtacgttaccggagttccgaacggtacccgg

SEQ ID NO: 190006 - DNA, 765 bp, Homo sapiens
  misc_feature: GYAE6OF02IUIZ7.39.39.D06.1.454.CMB.1.raw
  modified_base (363)..(363): a, c, t, g, unknown or other
  misc_feature (363)..(363): n is a, c, g, or t
  modified_base (478)..(478): a, c, t, g, unknown or other
  misc_feature (478)..(478): n is a, c, g, or t
tcagtcgcactagtcacgaccggtgctcgatttagtgacatctcgcagttcgtttgggggggggtctcaggaggcgagcgctctcaggacatctccaccatcggcctgggctctggctgcctcctccaccctcctcactcgagggcacggtcggtccgtcgggccctagttcgcggcctacgacacgtacgcctcgccgtccgtgttcgtacgacgtaccgtccgtgggactacgtcgtaactccgacctacttcctccgtcgctaccgtaacggaccacggtccgtagtcggtaccgtttggtacttacgttaaattaaggtttctcgttccgttaccgttacggaacctaagacgtcttancgagccggtaccgacccgtacccgtaaatttcgttttaaagtcgttcggtacggtttacccggtcgtccgaccggtaaggtttcggtactacgtccggtcctttcggccgttacncgtaccgttgtaccgaaccgtacgcccggtaccctacgtacgtacctactaccgtacgtaaccgtcgtaccggtacgcgggtaacggacggtaaaccggtcggtacgttacgtaaccgtttaacttaacgtccggtaacgtaccgtaccttaacgtaacgttaacgtacgttaacgtaacgtaccgtaggttacgtactaccgtaacgtcggtcggttacggtcgggtaacggtaccggtaacggtacgtaccggtacgtacccggacgttaccggaccgtacccgg

SEQ ID NO: 190007 - DNA, 373 bp, Homo sapiens
  misc_feature: GYAE6OF01BXF2O.2.61.F06.1.454.CMB.1.raw
  modified_base (367)..(373): a, c, t, g, unknown or other
  misc_feature (367)..(373): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggactactcctgtcgagcgtctgagcgggctggcaggcgcatagnnnnnnn

SEQ ID NO: 190008 - DNA, 375 bp, Homo sapiens
  misc_feature: GYAE6OF01A5TLR.2.61.F06.1.454.CMB.1.raw
  modified_base (368)..(375): a, c, t, g, unknown or other
  misc_feature (368)..(375): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatccggtcttcccctggccaccctcctccaagagcacctctgggggcacagcggccctgggctgcctggtcaaggctacttctgtcgagcgtctgagcgggctggcaaggcgcatagnnnnnnnn

SEQ ID NO: 190009 - DNA, 376 bp, Homo sapiens
  misc_feature: GYAE6OF01BBGIA.2.61.F06.1.454.CMB.1.raw
  modified_base (369)..(376): a, c, t, g, unknown or other
  misc_feature (369)..(376): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagagcacctctgggggcacagcggccctgggctgcctggtcaaggactacttcctgtcgagcgtctgagcggctggcaaggcgcatagnnnnnnnn

SEQ ID NO: 190010 - DNA, 373 bp, Homo sapiens
  misc_feature: GYAE6OF01DDGGJ.2.61.F06.1.454.CMB.1.raw
  modified_base (368)..(373): a, c, t, g, unknown or other
  misc_feature (368)..(373): n is a, c, g, or t
tcagacgctcgacacacgaccggtgctcgatttagctacgctctaagggaaagggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtccttcccctggcaccctcctccaagagcacctctgggggcacagcggccctgggctgcctggtcaaggactacttcctgtcgagcgtctgagcgggctggcaaggcgcatagnnnnnn

SEQ ID NO: 190011 - DNA, 386 bp, Homo sapiens
  misc_feature: GYAE6OF01EAVDJ.2.61.F06.1.454.CMB.1.raw
  modified_base (374)..(386): a, c, t, g, unknown or other
  misc_feature (374)..(386): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggactacttcctgtcgagcgtctgaggcggcgtcggacgaaggcgcagtagnnnnnnnnnnnnn

SEQ ID NO: 190012 - DNA, 378 bp, Homo sapiens
  misc_feature: GYAE6OF01ADBQA.2.61.F06.1.454.CMB.1.raw
  modified_base (369)..(378): a, c, t, g, unknown or other
  misc_feature (369)..(378): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagagcacctctgggggcacagcggccctgggctgcctggtcaaggactacttcctgtcgagcgtctgagcggctggcaaggcgcatagnnnnnnnnnn

SEQ ID NO: 190013 - DNA, 386 bp, Homo sapiens
  misc_feature: GYAE6OF01CATDI.2.61.F06.1.454.CMB.1.raw
  modified_base (375)..(386): a, c, t, g, unknown or other
  misc_feature (375)..(386): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggccatccggtcttcccctggccaccctcctccaacgagcacctcgtcgggggcacgagcggccctgggctgccgtggtcaaggctacttcctgtcgagcgtctgagcgggctggcgaaggcgcgatagnnnnnnnnnnnn

SEQ ID NO: 190014 - DNA, 377 bp, Homo sapiens
  misc_feature: GYAE6OF01AQQV1.2.61.F06.1.454.CMB.1.raw
  modified_base (369)..(377): a, c, t, g, unknown or other
  misc_feature (369)..(377): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagagcacctctgggggcacagcggccctgggctgcctggtcaaggactacttcctgtgagcgtctgagcgggctggcaaggcgcatagnnnnnnnnn

SEQ ID NO: 190015 - DNA, 392 bp, Homo sapiens
  misc_feature: GYAE6OF01EBN5D.2.61.F06.1.454.CMB.1.raw
  modified_base (331)..(331): a, c, t, g, unknown or other
  misc_feature (331)..(331): n is a, c, g, or t
  modified_base (370)..(392): a, c, t, g, unknown or other
  misc_feature (370)..(392): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggcctgggctgcctggtcaaggctactccngtcgagcgtctgagcggctggcaagggcgacagtacggnnnnnnnnnnnnnnnnnnnnnnn

SEQ ID NO: 190016 - DNA, 376 bp, Homo sapiens
  misc_feature: GYAE6OF01DUIQF.2.61.F06.1.454.CMB.1.raw
  modified_base (367)..(376): a, c, t, g, unknown or other
  misc_feature (367)..(376): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggactacttctgtcgagcgtctgagcggctggcaaggcgcatagnnnnnnnnnn

SEQ ID NO: 190017 - DNA, 401 bp, Homo sapiens
  misc_feature: GYAE6OF01D24D7.2.61.F06.1.454.CMB.1.raw
  modified_base (391)..(401): a, c, t, g, unknown or other
  misc_feature (391)..(401): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtcgtggggccaagggaccacggtcaccgtctcttcagcctccaccaagggcccatccggtcttccccctggccaccctcctaccaagacgccacctcgtgggggcacgagccggcccgtgggctcgccgtggtacaacggactaccttccgtgtcgagtcgtctgagcgggctcggcgaaggcgacacgtagnnnnnnnnnnn

SEQ ID NO: 190018 - DNA, 378 bp, Homo sapiens
  misc_feature: GYAE6OF01BA1R1.2.61.F06.1.454.CMB.1.raw
  modified_base (369)..(378): a, c, t, g, unknown or other
  misc_feature (369)..(378): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnn

SEQ ID NO: 190019 - DNA, 392 bp, Homo sapiens
  misc_feature: GYAE6OF01CWNW3.2.61.F06.1.454.CMB.1.raw
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (379)..(392): a, c, t, g, unknown or other
  misc_feature (379)..(392): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggcccaagggaccacggtcaccgtctcttcagcctccaccaagggcccatcggtccttccccgtggccaccctcctccaaggacgcacctcgtgggggacacagcggccctgggctgcctggcaaggctacttccagtcagcgtctgacgcgggcctaggcgaaaggccgnanagnnnnnnnnnnnnnn

SEQ ID NO: 190020 - DNA, 377 bp, Homo sapiens
  misc_feature: GYAE6OF01D5FD1.2.61.F06.1.454.CMB.1.raw
  modified_base (368)..(377): a, c, t, g, unknown or other
  misc_feature (368)..(377): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnnnnnnn

SEQ ID NO: 190021 - DNA, 375 bp, Homo sapiens
  misc_feature: GYAE6OF01CNP6S.2.61.F06.1.454.CMB.1.raw
  modified_base (367)..(375): a, c, t, g, unknown or other
  misc_feature (367)..(375): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccacaagggcccatcggtctcccctggcaccctcctccaagagcacctctgggggcacagccggccctgggctgcctggtcaaggctacttcctgtcgagcgtctgagcgggctggcgaaggcgcatagnnnnnnnnn

SEQ ID NO: 190022 - DNA, 380 bp, Homo sapiens
  misc_feature: GYAE6OF01D6JV3.2.61.F06.1.454.CMB.1.raw
  modified_base (365)..(365): a, c, t, g, unknown or other
  misc_feature (365)..(365): n is a, c, g, or t
  modified_base (371)..(380): a, c, t, g, unknown or other
  misc_feature (371)..(380): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagacgcacctctgggggcacagcggccctgggctgcctggtcaaggactacttcctgtcgagcgtctgagcgggctggcaaggcncatagnnnnnnnnnn

SEQ ID NO: 190023 - DNA, 440 bp, Homo sapiens
  misc_feature: GYAE6OF01AISXS.2.61.F06.1.454.CMB.1.raw
  modified_base (425)..(440): a, c, t, g, unknown or other
  misc_feature (425)..(440): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtcgtggggccaagggaccacggtcaccgtctcttcagcctccaccaacgggcccatccggtcttccccctggccacccctccctcccaacgacgccaccctcgtcggggggccacgacgccggcccctggggcctcgcccgtgggtccgaagggtaccttaccgttccgtcgtcggagtccgtcgtcggacggccgggtcgtcggccgaacgggcgcgacgtagcgnnnnnnnnnnnnnnnn

SEQ ID NO: 190024 - DNA, 413 bp, Homo sapiens
  misc_feature: GYAE6OF01C79J7.2.61.F06.1.454.CMB.1.raw
  modified_base (310)..(310): a, c, t, g, unknown or other
  misc_feature (310)..(310): n is a, c, g, or t
  modified_base (392)..(413): a, c, t, g, unknown or other
  misc_feature (392)..(413): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatgggttcgggaacactacagtctggacgtcgtggggccaagggaccacggtcaccgtctcttcagcctccaccgaagggcccagttcggtccttccccgtggccaccctcctaccaagacgccacctcgtcgggggcacnggccggccctggctcgccgtggtcaaggctaccttcctgtcgagcgtctggacggcgggctggacgaacggcgacagtaggnnnnnnnnnnnnnnnnnnnnnn

SEQ ID NO: 190025 - DNA, 420 bp, Homo sapiens
  misc_feature: GYAE6OF01CV4OJ.2.61.F06.1.454.CMB.1.raw
  modified_base (407)..(420): a, c, t, g, unknown or other
  misc_feature (407)..(420): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtcgtggggccaaggggaccacggtcaccgtctcttcacgcctccaccaagggcccatcggtccttcccccgtggccaccctcctccaacgacgccacctccgtggggggccacgaggccggccccgtgggctcgccgtggtccaacgggtactacctttcctcggtcgacgtcggtctggacggcgggctcggcgaagggcgacatagnnnnnnnnnnnnnn

SEQ ID NO: 190026 - DNA, 409 bp, Homo sapiens
  misc_feature: GYAE6OF01ARLO0.2.61.F06.1.454.CMB.1.raw
  modified_base (385)..(385): a, c, t, g, unknown or other
  misc_feature (385)..(385): n is a, c, g, or t
  modified_base (389)..(409): a, c, t, g, unknown or other
  misc_feature (389)..(409): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggccacggtcaccgtctcttcagcctccaccaacgggcccatcggtccttccccctggccaccctcctccaacgacgcacctcgtcgggggcacacgccggccctggggctcgccgtggtacaacggtctacttcctggtcgagcgtctgacggcggctggcgaaggcgcatagnagcnnnnnnnnnnnnnnnnnnnnn

SEQ ID NO: 190027 - DNA, 493 bp, Homo sapiens
  misc_feature: GYAE6OF01EUNDY.2.61.F06.1.454.CMB.1.raw
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (456)..(493): a, c, t, g, unknown or other
  misc_feature (456)..(493): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgagtgggtccatactagtgggttacggggaacactacagtctggacgtcgtggggaccaagggaccacggtcaccgtctcttcacgccctccaccgaacgggcccagtccggtccttccccccgtggcccaccctccctaccaaacgcgccaccgtcggtcgggggccacgacggccggcccgtggggcctcggcccgttgggtaccgaaacgggtacccttaccgtttccgtcggtacgacgtcgttcgtggacgggtccgggcgtcggaccgtaagggcgaccgaggtacgncgancgnnnnnnnnnnnnnnnnnnnnnnnnnnnnnnnnnnnnnn

SEQ ID NO: 190028 - DNA, 420 bp, Homo sapiens
  misc_feature: GYAE6OF01CEH6X.2.61.F06.1.454.CMB.1.raw
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (395)..(420): a, c, t, g, unknown or other
  misc_feature (395)..(420): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatacgtatgggttcggggaacactacagtctggacgtcgtggggccaaggggaccacggtcaccgtctctcagcctccaacaacgggcccagtccggtcttcccccgtggccacccgtcctccaagacgccaccgtcgngggggccaacgcggtccggccgtggggctacgccgtggtacaaggcctactctgtcgagcgttcgngacgcggctggcgaaggcgcgaatgnnnnnnnnnnnnnnnnnnnnnnnnnn

SEQ ID NO: 190029 - DNA, 514 bp, Homo sapiens
  misc_feature: GYAE6OF01BSODL.2.61.F06.1.454.CMB.1.raw
  modified_base (278)..(278): a, c, t, g, unknown or other
  misc_feature (278)..(278): n is a, c, g, or t
  modified_base (461)..(461): a, c, t, g, unknown or other
  misc_feature (461)..(461): n is a, c, g, or t
  modified_base (465)..(514): a, c, t, g, unknown or other
  misc_feature (465)..(514): n is a, c, g, or t
tcagacgctcgacacacgaccggtgctcgatttagctacgctctaagggaaagggggcgactcaccatctccagagacaattctaagaacacggtgtttctgcaaatgaacagcctgagaggtgaagacacggctgtttatttctgtgcgagagatgatgggtccatactatgggtcggggaacactacaggtctggacgtcgtggggccaaggggcccacggtccaccgtctccttcgagccctccaccgaacgggccccagtccggtccttccccnggtcccacccctcctccaagagccactccgtgggggccaccgaggcccggtcccgtggggacctcggtaccgttgggtaccgaaacgggttaccttaccgtttaccggtgttccggaacggttcgttacgtacggacgggcccggggttcacggggtcgaaaccggggccgaccaaggtgccnggcnnnnnnnnnnnnnnnnnnnnnnnnnnnnnnnnnnnnnnnnnnnnnnnnnn

SEQ ID NO: 190030 - DNA, 372 bp, Homo sapiens
  misc_feature: GYAE6OF02HAQ4V.2.61.F06.1.454.CMB.1.raw
  modified_base (368)..(372): a, c, t, g, unknown or other
  misc_feature (368)..(372): n is a, c, g, or t
tcagacgctcgacacacgaccggtgctcgatttagctacgctctaagggaaagggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnn

SEQ ID NO: 190031 - DNA, 373 bp, Homo sapiens
  misc_feature: GYAE6OF02GPEUN.2.61.F06.1.454.CMB.1.raw
  modified_base (368)..(373): a, c, t, g, unknown or other
  misc_feature (368)..(373): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggactacttcctgtcgaggtctgagcgggctggcaaggcgcatagnnnnnn

SEQ ID NO: 190032 - DNA, 374 bp, Homo sapiens
  misc_feature: GYAE6OF02F01LD.2.61.F06.1.454.CMB.1.raw
  modified_base (369)..(374): a, c, t, g, unknown or other
  misc_feature (369)..(374): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcacccctcctccaagagcacctctgggggcacagcggccctgggctgcctggtcaaggactacttcctgtgagcgtctgagcgggctggcaaggcgcatagnnnnnn

SEQ ID NO: 190033 - DNA, 371 bp, Homo sapiens
  misc_feature: GYAE6OF02HTS8Q.2.61.F06.1.454.CMB.1.raw
  modified_base (367)..(371): a, c, t, g, unknown or other
  misc_feature (367)..(371): n is a, c, g, or t
tcagacgctcgacacacgaccggtgctcgatttagctacgctctaagggaaagggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnn

SEQ ID NO: 190034 - DNA, 371 bp, Homo sapiens
  misc_feature: GYAE6OF02H5NON.2.61.F06.1.454.CMB.1.raw
  modified_base (369)..(371): a, c, t, g, unknown or other
  misc_feature (369)..(371): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagagcacctctgggggcacagcggccctgggctgcctggttcaaggcacttcctgtcgagcgtctgagcgggctggcaaggcgcatagnnn

SEQ ID NO: 190035 - DNA, 384 bp, Homo sapiens
  misc_feature: GYAE6OF02G7MI0.2.61.F06.1.454.CMB.1.raw
  modified_base (281)..(281): a, c, t, g, unknown or other
  misc_feature (281)..(281): n is a, c, g, or t
  modified_base (374)..(384): a, c, t, g, unknown or other
  misc_feature (374)..(384): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaaggcccatcggtcttccccctggcaccctcctccaagngcacctctgggggcacagccggccctgggctgcctggtcaaggactactcctgtcgacgtcgtcgtggagcgggctggcgaaggcgcataggnnnnnnnnnnn

SEQ ID NO: 190036 - DNA, 379 bp, Homo sapiens
  misc_feature: GYAE6OF02HWB8J.2.61.F06.1.454.CMB.1.raw
  modified_base (371)..(379): a, c, t, g, unknown or other
  misc_feature (371)..(379): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatccggtcttccccctggccaccctcctccaagacgcacctctgggggcacagcggccctgggctgcctggtcaaggactactcctgtcgagcgtctgagcgggctggcaaggcgcatagnnnnnnnnn

SEQ ID NO: 190037 - DNA, 381 bp, Homo sapiens
  misc_feature: GYAE6OF02I05Y6.2.61.F06.1.454.CMB.1.raw
  modified_base (370)..(381): a, c, t, g, unknown or other
  misc_feature (370)..(381): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagagcacctctcgggggcacagcggccctgggctgcctggtcaaggactacttcctgtcgagcgtctgagcggctggcaaggcgcatagnnnnnnnnnnnn

SEQ ID NO: 190038 - DNA, 378 bp, Homo sapiens
  misc_feature: GYAE6OF02GKBFQ.2.61.F06.1.454.CMB.1.raw
  modified_base (366)..(378): a, c, t, g, unknown or other
  misc_feature (366)..(378): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacatggctgtttatttctgtgcgagagatgatgggtccatactatggttcggggaacactacagtctggacgtctggggccaagggaccacggtcaccgtctcttcagcctccaccaagggcccatcggtcttccccctggcaccctcctccaagagcacctctgggggcacagcgccctgggctgcctggtcaaggactactcctgtcgagcgtctgagcggctggcaaggcgcatagnnnnnnnnnnnnn

SEQ ID NO: 190039 - DNA, 385 bp, Homo sapiens
  misc_feature: GYAE6OF02G9NTF.2.61.F06.1.454.CMB.1.raw
  modified_base (366)..(366): a, c, t, g, unknown or other
  misc_feature (366)..(366): n is a, c, g, or t
  modified_base (372)..(385): a, c, t, g, unknown or other
  misc_feature (372)..(385): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtcttccccctggccaccctcctccaagacgcacctcgtgggggcacagcggccctgggctgcctggtcaaggactacttcctgtcgagcgtctgagcgggctggcaaggcncatagnnnnnnnnnnnnnn

SEQ ID NO: 190040 - DNA, 449 bp, Homo sapiens
  misc_feature: GYAE6OF02JZ942.2.61.F06.1.454.CMB.1.raw
  modified_base (129)..(129): a, c, t, g, unknown or other
  misc_feature (129)..(129): n is a, c, g, or t
  modified_base (419)..(419): a, c, t, g, unknown or other
  misc_feature (419)..(419): n is a, c, g, or t
  modified_base (422)..(449): a, c, t, g, unknown or other
  misc_feature (422)..(449): n is a, c, g, or t
tcagacgctcgacacacgaccggtgctcgatttagctacgctctaagggaaaggggcggactcaccatctccagagacaattctaagaacacggtgtttctgcaaatgaacagcctgagaggtgaaganacggctggtttatttctgtgcgagagatgatgggtccatactatggttcggggaacactacagtctggacgtctggggcaagggaccacggtcaccgtcgtctttcaggcctccaccaacgggcccagtccggtcttcccccctggccacccctcctccaagtacgcacctcgtcgggggacctcgaggccggcccctggggcctggcccgttggacgaacgggactaccttccgtcggtccggagccggtctggagccgggtgtcggcgtaacgggcgcgacgtagtcngannnnnnnnnnnnnnnnnnnnnnnnnnnn

SEQ ID NO: 190041 - DNA, 377 bp, Homo sapiens
  misc_feature: GYAE6OF02GI135.2.61.F06.1.454.CMB.1.raw
  modified_base (345)..(345): a, c, t, g, unknown or other
  misc_feature (345)..(345): n is a, c, g, or t
  modified_base (369)..(377): a, c, t, g, unknown or other
  misc_feature (369)..(377): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcgggaacactacagtctggacgtctggggccaaagggaccacggtcaccgtctcttcagcctccaccaagggcccatcggtcttccccctggccaccctcctcccaagagcacctctgggggcacagcggccctgggctgcctggtcaaggctactcctgtcgagcgtcngagcgggctggcaaggcgcatagnnnnnnnnn

SEQ ID NO: 190042 - DNA, 409 bp, Homo sapiens
  misc_feature: GYAE6OF02G1EAK.2.61.F06.1.454.CMB.1.raw
  modified_base (393)..(409): a, c, t, g, unknown or other
  misc_feature (393)..(409): n is a, c, g, or t
tcagacgctcgacacacgaccggtgctcgatttagctacgctctaagggaaaggggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaaggcccatcggtcttccccctggccaccctcctccaagacgccacctcgtcgggggcacgacgccggcccgtgggcctcggccgtgggtccaagggtacctacttcctgtccgacgtcgtcgtgacgcgggcgtggcgaaggcgcatagnnnnnnnnnnnnnnnnn

SEQ ID NO: 190043 - DNA, 475 bp, Homo sapiens
  misc_feature: GYAE6OF02JOU2C.2.61.F06.1.454.CMB.1.raw
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (433)..(436): a, c, t, g, unknown or other
  misc_feature (433)..(436): n is a, c, g, or t
  modified_base (438)..(438): a, c, t, g, unknown or other
  misc_feature (438)..(438): n is a, c, g, or t
  modified_base (440)..(475): a, c, t, g, unknown or other
  misc_feature (440)..(475): n is a, c, g, or t
tcagacgctcgacacacgaccggtgctcgatttagctacgctctaagggaaagggggcggactcaccatctccagagacaattctaagaacacggtgtttctgcaaatgaacagcctgagaggtgaagacacggctgtttatttctgtgcgagagatgatggggtccagtactatgggttcgggggaacactacagtctgggacgtctggggccaagggaccacggtcaccgtcncttcacgcctccaccgagggcccagtcggtcctccccgnggccaccctcctaccagacgccacctcgtgggggaccaccgaggtcccgggcccttcggggaccgttgccccgttgggtaccaaggtacctaccttccgttggtccggacgccgtacgtcggacggcggcgtcggcgaacgggcgcgaagtgncgcngnnnngnannnnnnnnnnnnnnnnnnnnnnnnnnnnnnnnnnnn

SEQ ID NO: 190044 - DNA, 386 bp, Homo sapiens
  misc_feature: GYAE6OF02IM9F6.2.61.F06.1.454.CMB.1.raw
  modified_base (370)..(386): a, c, t, g, unknown or other
  misc_feature (370)..(386): n is a, c, g, or t
tcagacgctcgacacacgaccggtgctcgatttagctacgctctaagggaaaggggcgactcaccgatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatcggtctccccctggcaccctcctccaagagcacctctgggggcacagcggccctgggctgcctggtcaggactacttcctgtcgagcgtctgagcgggctggcaaggcgcagtacgnnnnnnnnnnnnnnnnn

SEQ ID NO: 190045 - DNA, 380 bp, Homo sapiens
  misc_feature: GYAE6OF02HS0XP.2.61.F06.1.454.CMB.1.raw
  modified_base (364)..(364): a, c, t, g, unknown or other
  misc_feature (364)..(364): n is a, c, g, or t
  modified_base (369)..(380): a, c, t, g, unknown or other
  misc_feature (369)..(380): n is a, c, g, or t
tcagacgctcgacacacgaccggtgctcgatttagctacgctctaagggaaagggcgactcaccatctccagagacaattctaagaacacggtgtttctgcaaatgaacagcctgagaggtgaagacacggctgtttatttctgtgcgagagatgatgggtccatactatggttcggggaacactacagtctggacgtctggggccaagggaccacggtcaccgtctcttcagcctccaccaagggcccatccgtcttccccctggcaccctcctccaagagcactctgggggcacagcggccctgggctgcctggtcaaggcctacttccgtgtcgagcgtctggagcgggctggcaaggcanatagnnnnnnnnnnnn

SEQ ID NO: 190046 - DNA, 306 bp, Homo sapiens
  misc_feature: GYAE6OF02I7BKR.8.2.A02.1.454.CMB.1.raw
  modified_base (299)..(306): a, c, t, g, unknown or other
  misc_feature (299)..(306): n is a, c, g, or t
tcagctcgcgtgtccacgaccggtgctcgatttagactcatctacagggcgtctacccgggcgtccgggtccctgagcgattcagtggcagcggatttgggacagatttcactctcaccatcagcagcctgcaggctgaagatgcggcaatttattattgtcaacaatattggaacactccgtggacgttcggccaagggaccaaggtggagatcaagcgaactgtggctgcaccatctgtcttcatcttcccgccatctgagacacgcgagctgagcgggctgggcaaggcgcatagnnnnnnnn

SEQ ID NO: 190047 - DNA, 679 bp, Homo sapiens
  misc_feature: GYAE6OF02GI3WW.8.2.A02.1.454.CMB.1.raw
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
tcagctcgcgtgtccacgaccggtgctcgatttagactcatctactagggtcgggtctacccgggcgtccggggtccctgagcgattcagtggcagcggatttgggacaggatttcactctcaccatccacgcagcctggcaggcgtgaaggactgcggcaatttattattgtacaaccaactagttggaacctactcccgtggacgttcggccaagggaccaaggtggacgactcaaaggcgaaacgtcgtaggacctggacctaaccgtaagttaccttaggttccttttccaactttcccttttacccccggacccgtaaacttacccttaacggaaccggaaaccgaaccggacccggaaacggccccctttaagggaacggtacccgggggggtacttaggggttaccgaaaaagggggtcccgaaccgtaaagtaacgggcctagcggtcngactgctntctcgctcacgtacacgacacgacgactacctacgtctcgtcgtcncncgcgagagtagngagagtatatagtactanacatntacatagtacgacgacgacgacgtacgtacgttacgttacgttacgtacgacgtacgtacgtacgtacgtacgtacgtacgtacgaccgacgacgtaccgtccgtaccgtacctaccgtccgtccgtcccg

SEQ ID NO: 190048 - DNA, 533 bp, Homo sapiens
  misc_feature: GYAE6OF01B3YQY.26.12.B01.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaanagtcaccctntcctgcagggccagtcagagtgttagtaacaacttagcctggtaccagcagaaacctggccaggctcccaggctcctcatctctggtgcatccaccagggccactggtactcccggccagattcagtgcaggggtctgggacagaattcacgtctcaccatcaccagcctgcagtctgaagatttgcagtctattactgtacagctaatataattactggctcgttcgtttcgggcgggggacctaagcgtaggacgtagtacgaaccgtaacgtggtcggctggccacctagttcgtcgtcttcacttccttcccggtaccc

SEQ ID NO: 190049 - DNA, 519 bp, Homo sapiens
  misc_feature: GYAE6OF01C4X9X.26.12.B01.1.454.CMB.1.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
  modified_base (509)..(509): a, c, t, g, unknown or other
  misc_feature (509)..(509): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattactggaaaaataatgatgactcagtctccaggcaccctgtctgtgtctccaggggaaanagtcaccctctcctgcagggccagtcagagtgttagtaacacttagcctggtaccagcagaaacctggccaggctcccaggctcctcatctctggtncatccaccagggccactggtactcccgggccagattcagtggcagggggtctggggacagaattcactctcaccatcaccagcctgcagtctgaagtattttgctagtcttattactgtcagtcaatataattactggcttcttcgtttcgggcgggggtaccaaggctggagtatcgaaccgtacgtgtaggctcgcacatctagttcttcnttccttcccg

SEQ ID NO: 190050 - DNA, 531 bp, Homo sapiens
  misc_feature: GYAE6OF01BKJ9U.26.12.B01.1.454.CMB.1.raw
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacacttagcctggtaccagcagaaacctggccaggctccaggctcctcatctctggtgcactccaccagggccacgtggtactcccggcagattcgaggtcggcgaggggtctggggacagaattcgactctcaccatcaccagcctgcagtctagtaagtatttgctagtctattactgtcagactaattataattactgtcttcttcgttcgggcgggggtaccaaggctaggatagtacaaccggtactggtcggctcggcacatctgttcttcacttccgttcccgtac

SEQ ID NO: 190051 - DNA, 153 bp, Homo sapiens
  misc_feature: GYAE6OF01D8X7L.26.12.B01.1.454.CMB.1.raw
  modified_base (153)..(153): a, c, t, g, unknown or other
  misc_feature (153)..(153): n is a, c, g, or t
tcagagactatactcacgaccggtgctcgatttagtagtgtagattccgcgggggaccaagctggagatcaaccgaactgtggctgcaccatctgtcttcatcttcccgccatctgaagtatagtctctgagcgggctggcaaggcgcatagn

SEQ ID NO: 190052 - DNA, 128 bp, Homo sapiens
  misc_feature: GYAE6OF01AIC6P.26.12.B01.1.454.CMB.1.raw
  modified_base (116)..(128): a, c, t, g, unknown or other
  misc_feature (116)..(128): n is a, c, g, or t
tcagagactatactcacgaccggtgctcgatttagtagtgtagatccgcggaatctacacgcctggtcaaggactacttccagtatagtctctgagcggctggcaaggcgcatagnnnnnnnnnnnnn

SEQ ID NO: 190053 - DNA, 509 bp, Homo sapiens
  misc_feature: GYAE6OF01DTMHS.26.12.B01.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaangtcaccctctcctgcagggccagtcagagtgttagtaacaacttagcctggtaccagcagaaacctggccaggctcctcatttangctgcatccaccgagggcccactggtactcccagccaggttcagtggcagtgggtctgggacagagttcactctcaccatcagcagcctgcagtctagaagtattgtgtctaattttatactgtcagcaatataatacctggcctccgctctacgtttcgggcggagggacctaggtgagtatacaaacgacgtggtgctgccacntctgtcttcnttctcccg

SEQ ID NO: 190054 - DNA, 521 bp, Homo sapiens
  misc_feature: GYAE6OF01DM7Z1.26.12.B01.1.454.CMB.1.raw
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagagactatactcacgaccggtgctcgatttagtagtgtagattccgcggggagctctgggagaggagccccagccctgagactcccaggtgcttccattcagtgatcagcactgaacacagaggactcaccatggagttgggactgaactggattttccttttgacctattttaaaaggtgtccagtgtgaagggcagctggtggagtctgggggagacttgggtccagcctggcaagtccctaagactctcctgtgtcgcttctggattcacctttgatgaatatgccatgcactgggtcctnaggcaccgagggaggggcctgggagtgggtctcgaggtatcagttacaatagtggtaaatntactctatgcggactgtgtgaagggccattcacatctcagagacaacgccagaacctccctatatctaagaatggacagtctgacatgagacacggtctttattctgtgactaaagggtcgaaaccgtctaattacttacaacaagtctggac

SEQ ID NO: 190055 - DNA, 579 bp, Homo sapiens
  misc_feature: GYAE6OF01BI5GV.26.12.B01.1.454.CMB.1.raw
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaatatgatgactcagtctcaggcaccctgtctgtgtctccgaaggggaaagagtccaccctctcctgcagggccagtcagagtgttagtaacaacttagcctggtaccagcaagaaacctggccaggctcccaggcctcctcatctctggtgcactccaccgaggcccacgtcggtactcccggcagacttcgaggtggcgaggggtctaggggacaggacttcgactctcactatcgacgcagtacgtggacgtactagtaagtagtttgacgtagtgttaattactgtcacgtntagtatcgtactaccttntacgtttcccgtacgttaccgttttcggaccgtacgggtaccaggtcgtaggattaacgtacgtaaacgtacgtacggtcggacgtcgactacctacttacgtcttccgttctacccg

SEQ ID NO: 190056 - DNA, 508 bp, Homo sapiens
  misc_feature: GYAE6OF01C1QR9.26.12.B01.1.454.CMB.1.raw
  modified_base (201)..(201): a, c, t, g, unknown or other
  misc_feature (201)..(201): n is a, c, g, or t
  modified_base (496)..(496): a, c, t, g, unknown or other
  misc_feature (496)..(496): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccagggggaaanagtcacccctctcctgcagggccagtcagagtgttagaacaacttagcctggtaccagcagaaacctggccaggctcccaggctcctcatctctggtgcatccaccagggccactggtatccccggccagattcagtggcaggggtctgggacagaattcactctcaccatcaccagcctgcagtctgaagattttgctagttctattactgtcagcaattataattactggtctcttcgtttcgggcgggggaccaggctggagatcaaccgatggtgctgcacatctgtcttnctcttcccgtcc

SEQ ID NO: 190057 - DNA, 586 bp, Homo sapiens
  misc_feature: GYAE6OF01CPEME.26.12.B01.1.454.CMB.1.raw
  modified_base (203)..(203): a, c, t, g, unknown or other
  misc_feature (203)..(203): n is a, c, g, or t
  modified_base (426)..(426): a, c, t, g, unknown or other
  misc_feature (426)..(426): n is a, c, g, or t
  modified_base (566)..(566): a, c, t, g, unknown or other
  misc_feature (566)..(566): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaaccggaaaaatatgatgactcagtctccaggcaccctgtctgtgtctccgaagggggaaagngtccaccctctcctgcagggccagtcagagttgttaagaacacttagcctaggtaccagcaacgaaacctggccaggctcccgaggcctcctcatctcgtggtcgcactcccaccgacgggcctacgtggtaccgtcccggacagtacttcgaggtggcgtaggggtctgggacaggtaattcgaactctacaccatccaccagcctgcagtcgtagaagttntttgctaagttcttagttactgtacagactaataattaattactggtacttcgttcgttcggggacggggacaagtcgtaggacgacgtacgaaaccgtagtggtcggtcttcgacctacctacttcgttcgttaccttntaccttcccgttcccgtacc

SEQ ID NO: 190058 - DNA, 564 bp, Homo sapiens
  misc_feature: GYAE6OF01CA0UZ.26.12.B01.1.454.CMB.1.raw
  modified_base (201)..(201): a, c, t, g, unknown or other
  misc_feature (201)..(201): n is a, c, g, or t
  modified_base (345)..(345): a, c, t, g, unknown or other
  misc_feature (345)..(345): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccgaggggaaangtcaccctctcctgcagggccagtcagagtgttagtcgcggcttagcctggtaccagcagacacctgggcagactccaggctcctcattatgctgcatccaccagggccactggtactccagccaggttcagtgcagtgggtcngggacagagttcactctcaccatcagcagcctgcagtctagtaatagtttgctagtttattactgtactagactaagtaacttaaaacgtcggtacccgttccggttaggtaccggttcgggaccgtaacgggaaccgtaagggtacggaaaacgtacgaaacgtaacgtaggtacggtctacggaccaccgtactacgttagttcttcctacttcccg

SEQ ID NO: 190059 - DNA, 701 bp, Homo sapiens
  misc_feature: GYAE6OF01C14H6.26.12.B01.1.454.CMB.1.raw
  modified_base (195)..(195): a, c, t, g, unknown or other
  misc_feature (195)..(195): n is a, c, g, or t
  modified_base (622)..(622): a, c, t, g, unknown or other
  misc_feature (622)..(622): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattacggaaaatatgatgaatcagtctccaggcacctgtctgtgtctcgaggggaaangtcacctctcctgcagggccagtcagagtgttagtaacaacttgctaggtaccagacaagaaccgtggccgaggcctcccgaggcctaccctcacgttctcgtggtcgactacgtcccgaacgacgggtaccctacggttacggtaccgtccccggacaaggtacttacggaggttcggggacggtacggggggtcgtagggggtaaccaaggtaacttccaccttctaccaacctactaccaccgacgtcctgacctacgtcgtaagtaacgttattttcggacttagttactttaattacgtcgttaacacgtactaaatttagttaactttcggtcgtccgtttacggttaccgggtttaccggggggacgggggtaacctagggtaccgttacggggacgttacgttaacaaacccgggttanacggggttacgacggttacgaccgttaccttacgttaccgttcgttaccttacgttacccgtttcccgtacccggtacc

SEQ ID NO: 190060 - DNA, 527 bp, Homo sapiens
  misc_feature: GYAE6OF01EID6U.26.12.B01.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctccgaggggaaanagtcaccctntcctgcagggccagtcagagtgttagtaacaacttagcctggtaccagcagaaacctggccaggctcccaggctcctcatctctggtgcatccaccgagggccactggtactccccggccagattcagtggcgaggggtctggggacagaattcactctcaccatcaccagcctgcagtctgaagtattttgctagtcttaattactgtcagtcaattattaattactggctacttcgttcgggccgggggacaggcgtggagtagtacaaccgactggtcggntcgcaccntctcgtcttcacttccttcccgtcc

SEQ ID NO: 190061 - DNA, 573 bp, Homo sapiens
  misc_feature: GYAE6OF01CPAG7.26.12.B01.1.454.CMB.1.raw
  modified_base (204)..(204): a, c, t, g, unknown or other
  misc_feature (204)..(204): n is a, c, g, or t
tcagagactatactcacgaccggtgctcgatttagtagtgtagattccgcgggggaggaactgatcagtcaggacccagacggaaccatggaagccccagcgcagcttctcttcctcctgctactctggctcccagatattaaccggaaaaataatgatgactcagtctccaggcaccctgtctgtgtctccgaagggggaaanagtccaccctctcctgcagggccagtcagagtgttaagtaacaacttagcctggtaccagcagaaacctggcaggctccgagctcctcatctctggtgcactccaccgacgggccaacgtcggtacctcccggacctagtacttcgaggtggcgaggggtctaggggacagtaattcgactctcacatccacagcctgctagtctagaagtatttgactagttactattacgtgtcagtactaacttaattaattacgtggtctcgttcgttacggggccggggtaaccaaggtacgtaggagtactaccgaaaccgtagtcggtcggtctcggctaccgtatctcgttcttactcttccttcccgtac

SEQ ID NO: 190062 - DNA, 544 bp, Homo sapiens
  misc_feature: GYAE6OF01C6J4V.26.12.B01.1.454.CMB.1.raw
  modified_base (200)..(200): a, c, t, g, unknown or other
  misc_feature (200)..(200): n is a, c, g, or t
  modified_base (529)..(529): a, c, t, g, unknown or other
  misc_feature (529)..(529): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctccagggggaaangtcaccctctcctgcagggccagtcagagtgttagaacacttagcctggtaccagcagaacctgccaggctcccagctcctcatctctggtgcatccaccgagggccacgtggtactccccggccagattcgaggtggcgaggggtctggggacaggtaattcactctacacctatccaccagcctgactagtctagtaagtatttgctagttcttattactgtacagtactaattataattactggtccttcgttcggtttcgggcggggacctaaggcgtaggagtagtacgaaccgtactggtcgctgcacctatcgttcgtcttnacttccgttcccgtc

SEQ ID NO: 190063 - DNA, 501 bp, Homo sapiens
  misc_feature: GYAE6OF01E1S61.26.12.B01.1.454.CMB.1.raw
  modified_base (201)..(201): a, c, t, g, unknown or other
  misc_feature (201)..(201): n is a, c, g, or t
  modified_base (434)..(434): a, c, t, g, unknown or other
  misc_feature (434)..(434): n is a, c, g, or t
  modified_base (497)..(497): a, c, t, g, unknown or other
  misc_feature (497)..(497): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagngtcaccctctcctgcagggccagtcagagtgttagtaacaacttagcctggtaccagcagaaacctggccaggctcccaggctcctcatctctggtgcatccaccagggcccactggtatcccggccagattcagtggcaggggtctgggacagaattcactctcaccatcaacagcctgcagtctgaagtattttgctagtttattactgtcagcagtatcatgactggccnctcaccttcggccaagggacacgactggagattaaacgactgtggctgcaccatctgtcttcnttcc

SEQ ID NO: 190064 - DNA, 584 bp, Homo sapiens
  misc_feature: GYAE6OF01B563C.26.12.B01.1.454.CMB.1.raw
  modified_base (200)..(200): a, c, t, g, unknown or other
  misc_feature (200)..(200): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaataatgatgactcagtctccaggcaccctgtctgtgtctccgaggggaaangtcaccctctcctgcagggccagtcagagtgttaagtaacacttagccttggtaccagcagaaacctggccaggcctccaggctcctcatctctggtgcatccaccagggcccacgtggtactcccggccagattcaggtggcgagggggtctgggacagaatttcacgtcctcaccatcaccagcctgcagtctgaagtatttgctagtcttattactgtcagtacaattaattaacttactggtccttcgttccgtttcggggacggggggtaaccaggtccgtagggaacgtagttaccgaaaccggtaacgttcggttcggtactcggtaccaccgtacttcgttacgttcctttacacgtttccccgttcccggtaccc

SEQ ID NO: 190065 - DNA, 626 bp, Homo sapiens
  misc_feature: GYAE6OF01D9XA6.26.12.B01.1.454.CMB.1.raw
  modified_base (201)..(201): a, c, t, g, unknown or other
  misc_feature (201)..(201): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaaccggaaaaatatgatgactcagtctccaggcaccctgtctgtgtctccgaaggggaaangtccaccctctcctgcagggccagtcagtagtgttaagtaacaacttagcctaggtaccagcagaaacctggccaggctccgaggctcctcatctcgtggtcgcactcccaccgagggcccacgtcggtactccccggacagtacttcgaggtcggcggaggggtctggggacagtaactttccaactctacacctataccaccgagcctgctagtctagtagttagtttgctagttacttattactgtactacgtactaattaattaatttacgtcggtaccttcggttccggtttaccggggtaccgggggtaacctaaggtaccgtagggtaacgtacgtaccgtaaaccggtacgtacggtcggtacgtcgacctacctacgttccgttacgttaccttacgtacttccccgtcccgtacc

SEQ ID NO: 190066 - DNA, 678 bp, Homo sapiens
  misc_feature: GYAE6OF01DCQMV.26.12.B01.1.454.CMB.1.raw
tcagagactatactcacgaccggtgctcgatttagtagtgtagattccgcgggggagggaactgctcagtcaggacccagacggaaccatggaagccccagcgcagcttctcttcctcctgctactctggctcccagatattaccggaaaaataatgatgactcagtctccaggcaccctgtctgtgtctccgaggggaaagagtccaccctctcctgcagggcctagtcagagtgttaagaacaattagcctggtaccagcaagaaaccgtggccaggctccacggctcctctactctctggtgcatccaaccgagggcccacgtcggtaacgtccccggaccaggtaacttcgaggtgggccgtaacggggggttcctaggggacaacggtaaactttccaacctcttaccaacctaactacgaacccaacgtccgtagccaagtctacgtaagttagtttgtcgtagtacgttaacttacgtagtacacgtactaacttaagttaattaacgttaggtaccttacgttcggttttacggggaccgggggtaaccggaacggtcgtagggtaacgtaacgtaccgtaaaccgtaaacgttcgggtacggtaccttacggaccctaccgtaacttaccgttcgttacgtttactacccgttcgttcccccgttaccc

SEQ ID NO: 190067 - DNA, 559 bp, Homo sapiens
  misc_feature: GYAE6OF01B71R8.26.12.B01.1.454.CMB.1.raw
  modified_base (200)..(200): a, c, t, g, unknown or other
  misc_feature (200)..(200): n is a, c, g, or t
  modified_base (350)..(350): a, c, t, g, unknown or other
  misc_feature (350)..(350): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaangtcaccctctcctgcagggccagtcagagtgttagtaacaacttagcctggtaccagcagaaacctggccaggctcccaggctcctcatctctggtgcactccaccagggccacgtggtactcccggcagattcgagtggcgaggggtcngggacagtaatcactctacaccatccaccacgcctgcagtctagtaagtatttgactagttcttattactgtacagtacaattaattaattactcgtcttcgttcgtttcggggccgggggtacctaaggcgtaggacgtagtaccgaaaccgtacgttggtggtcgtcgccacctattcttcgttcttactactcccgttcccgtacc

SEQ ID NO: 190068 - DNA, 520 bp, Homo sapiens
  misc_feature: GYAE6OF01DL6TT.26.12.B01.1.454.CMB.1.raw
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaaatatgatgactcagtctccaggcaccctgtctgtgtctccagcggaaagagtcaccctctcctgcagggccagtcagagtgttagtaacaacttagcctggcacagcagaacctggcaggctccaggctcctcatctttgatgcgtccaccgagggccactcggtttcccagtccaggttcagtggcagtgcgtctgcgacagngttcactcncaccatacacagcctgctagtctagaagtattttgcttagtttattacgtgtcagtcagtatcatgactggcctctcgtaccgttcggaccaacgggactacggacgtaggaacgtaagttaaacgacgtggtggtactcgacacctatcgtgttacc

SEQ ID NO: 190069 - DNA, 589 bp, Homo sapiens
  misc_feature: GYAE6OF01AYKTW.26.12.B01.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagagactatactcacgaccggtgctcgatttagtagtgtagattccgcgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagtcgcggcttagcctggtaccagcagacaccgtgggcagacctcccaggcctcctcattttangctgctactcccaccgagggccacgtggtactcccgagccgtaggttcaggtcggcgtaggttcgggtactggggactaggtacgtttcactctacacctatccagcagcctgcagtcgtagtaagtattggtatacttaatttatacgtgtacagactaagttaactaacgttaccgtcggtacccttccgacttccgtaccgtttacgggacgggtaacgggaccgtaagggttcgaagtaactacgaaaccgtagtcggtacggtactacggacctacgtcgttaccg

SEQ ID NO: 190070 - DNA, 762 bp, Homo sapiens
  misc_feature: GYAE6OF01DA2MY.26.12.B01.1.454.CMB.1.raw
  modified_base (739)..(739): a, c, t, g, unknown or other
  misc_feature (739)..(739): n is a, c, g, or t
  modified_base (747)..(747): a, c, t, g, unknown or other
  misc_feature (747)..(747): n is a, c, g, or t
tcagagactatactcacgaccggtgctcgatttagtagtgtagattccgcgggggggagaggagccccagccctgagactcccaggtgcttccattcagtgatcagcactgaacacagaggactcaccagtggagttgggactgaactggtattttcctttgacctatttaaaaggtgtccagtgtgaagggcagcgtggtggagtcgtgggggagtacgttcgggtccaggcctgggactaacgtccctaagacttcctccgtgtcgtcgtcttctggtacttcgtacctttgattgaatatcgcctagtcgccgtacgtcgggtcccgtagacggccgaacccggagggggacggggcccgtaggggtacggttcggggtacctttacggaagggtttactacggtaacggtttaacgtaaagtttaacggtttaggtaaaactttaactaccgttacgttaaggttacgggcggttaaccttcgttgggtaacggtaacgggcccgttaattcccgtaaacccgtactttcccgaaccgtaaggaaccaaacccggtaaccgaccgaaccgggttaacctacccccgttataacgttaccgtaaacgtaaacgtcggaactacggtacttaagaaccaacgttacggaacgtaccgtacggtttacttttacgttcttaggtagtaaccgtaaagggtacccgtaacgaattacgttactttacgaacgttaacgngtacgtanacgttcgtacttcgg

SEQ ID NO: 190071 - DNA, 700 bp, Homo sapiens
  misc_feature: GYAE6OF01DNY6N.26.12.B01.1.454.CMB.1.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagataccactggacaaaatgtgctgacgcagtctccagcccacctgtctgcctctccgaaggggaaancgtcaccatcctccgtggtccgggcagtcagtagtgttagcgcggtcttagcctggtaccagcagacacgtgggacacgacctccgaggcctcgtctatttangctcgcactccaaccggaggcctacgtggtaactaccgacgccgtaggttacaggtcggcgtagggtcgggtacgtaggggacaggttacgttcacgttctacgacctagtcacgacacgtcctaggtcgtaacggttacgtaaggtaaacgttagtttacggttaacgtaaccttttaaagtttttaacgttacgttacgttaaccgaacgttaacctaaaaagtttaacctttaaaccgttaccccggttaccggttaccccgttccggtaccgttacccggttaccggtttaccggggaaccggggtaacggttaacccggtagggttaacgaacgtaacgtaacccgtaaaagggtacgttcgggacgtacgtaccgtaaccgtacgttacg

SEQ ID NO: 190072 - DNA, 552 bp, Homo sapiens
  misc_feature: GYAE6OF01AN713.26.12.B01.1.454.CMB.1.raw
  modified_base (213)..(213): a, c, t, g, unknown or other
  misc_feature (213)..(213): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
tcagagactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctggggganacttggtccagcctggcaagtccctaagactctcctgtgtcgcttctggattcacctttgatgaatatgccatgcacgtgggtccgtcgaggcaccgaggggacgggcctgggagtgggtctcgaggtatcgtagttacagtagtggtaatatactnatgcgactctgtgaggctatcacntctcagacacacgcacgactccctatactctaagaagtcgacagtctgaacacgtagagactacggttccttttattcgtgtacgacgtaaagggtcggtaaccgtataacgttactttacgactaaggtcctagggacctacgttggttacttacgg

SEQ ID NO: 190073 - DNA, 682 bp, Homo sapiens
  misc_feature: GYAE6OF01EB7Q4.26.12.B01.1.454.CMB.1.raw
  modified_base (198)..(198): a, c, t, g, unknown or other
  misc_feature (198)..(198): n is a, c, g, or t
  modified_base (340)..(340): a, c, t, g, unknown or other
  misc_feature (340)..(340): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaatatgatgactcagtctccaggccacctgtctgtgtctcgaggggaaanacgtccacccctctccgtgccgagggccagtcaggtagttagttaacgtaaacctaacgttacgcccgtagggtaacccaggaccaaggaaaccctggaccgaggccttacccgaggtcctacctcacttccgtcgtggtcnctaccgtcccaccggacgggacctacgttcggtaccgtccccgactagtcttcgaggtggcgtaggggtctagggacagtactcactcacacntcacngctgctactctagtagttntttagactacgtcttacgtttactcgtactagtactaattaagttaacttacgtcggtactttccgttacgggtttacccgggggaccggggtaaccgtacggtcggtaggtaacgtacgtaacccggtaaaccgtaacggttcggttacggtccgttacggcccctaacgttaccgttcgtttacccgttacttaccgttacctttccccgtccccgttacccg

SEQ ID NO: 190074 - DNA, 619 bp, Homo sapiens
  misc_feature: GYAE6OF01EYD8H.26.12.B01.1.454.CMB.1.raw
  modified_base (459)..(459): a, c, t, g, unknown or other
  misc_feature (459)..(459): n is a, c, g, or t
tcagagactatactcacgaccggtgctcgatttagtagtgtagattccgcgggggggagaggagccccagccctgagactcccaggtgcttccattcagtgatcagcactgaacacagaggactcaccatggagttgggactgaactggatttttccttttgaccattttaaaaggtgtccagtgtgaagggcagctggtggagtcgtgggggagacttggtccagcctggcaagtccctaagactctcctgtgtcgcttctggattcaccttttgatgaatatgccatgcactgggtcccgtcgacgcacgagggacgggcgtgggaggtgggtcgtcgagtatcgtagtaacaagtagtagtaatatactctatgacgtactcgtgtaggaacgggacgtacgttaccaactactcctacgacgacgaaccgaacgaccgaacgtaccctccctacntacttacgtaacgtaacgtacggaacgtacgtacgtacgaacctaacgtaggaacggaaccgaccggttaccgttttacgtttcgttgtcgaacgtaacgggtaacggaaccggtacgtaacttaacttactaacaacgtacgtacggacgtacggtacg

SEQ ID NO: 190075 - DNA, 562 bp, Homo sapiens
  misc_feature: GYAE6OF01B2F9I.26.12.B01.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaatatgatgactcagtctccaggcaccctgtctgtgtctccaggggaaanagtcaccctctcctgcagggccagtcagagtgttagtaacaacttagcctggtaccagcagaaacctggccaggctcccaggctcctcatctctggtncactccaccgagggccacgtcggtactccccggccagtacttcaggtggcgaggggtctggggacagattcactctcaccatcaccagcctgctagtctgaagtattttgctagtcttattactgtcagtactaattattaattacgtggtcttcgttcgtttacgggtcgggggacctaacggtcgtaggacgtactacgaaccgtaacgtggtcggcgtcggccacctattccgtcgttcttactcttcccgttcccgtacccg

SEQ ID NO: 190076 - DNA, 579 bp, Homo sapiens
  misc_feature: GYAE6OF01BCNTK.26.12.B01.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (517)..(517): a, c, t, g, unknown or other
  misc_feature (517)..(517): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccgagggggaaanagtccaccctctcctgcagggccagtcagagtgttaagtaaacacttagcctaggtaccagacaagaaaccgtggaccaggcctcccgaggctccncatctctggtncactccaccagggccagtggtactccggcagattcgagtggcgaggggtcagggacagatcactcncacatcaccngcctgnagtctagtagtatttgntatacttattacgtntcagacaaattataagttctggtcttacgttcggttacggggacggggtaacaggtcgtaggaagacgtaaccgacgtaacgttggtacgggtntacggacctaacccgtagttccgtttagtccctttacgtacttccccggttcccgtaacccg

SEQ ID NO: 190077 - DNA, 535 bp, Homo sapiens
  misc_feature: GYAE6OF01A4NED.26.12.B01.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (517)..(517): a, c, t, g, unknown or other
  misc_feature (517)..(517): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctccaggggaaangtcacccctntcctgcagggccagtcagngtgtagtaacaacttgcctggtaccagcagaaacctggccaggctcccaggctcctcactctctggtgcatccaccagggccacgtggtactccccggccagacttcgagtggcgagggggtctggggacagtaatcactctcaccatcaccagcctgcagtctgaagtatttgctagtctattactgtcagcaatataattactgtctctcgttcgggcgggggtacctaggcgtaggacgtactacgaaccgtacgtgtcggtctacgccacattcttcgtcttacncttcccgttcccgtaccg

SEQ ID NO: 190078 - DNA, 692 bp, Homo sapiens
  misc_feature: GYAE6OF01ELYID.26.12.B01.1.454.CMB.1.raw
  modified_base (223)..(223): a, c, t, g, unknown or other
  misc_feature (223)..(223): n is a, c, g, or t
tcagagactatactcacgaccggtgctcgatttagtagtgtagattccgcggggagctctgggagaggagccccagccctgagactcccaggtgcttccattcagtgatcagcactgaacacagaggactcaccatggagttgggactgaactggtattttccttttgacctaattttaaaaggtgtccagtgtgaagggcagctggtggagtcgtggggganacgttggtccagcctggcaagtccctaagctctcctgtcgtcgtcttctggtacttcctacctttgatagaatatcgacctatgcctacgtcgggtcccgtcgacggccaaccggagggggacgggccgtggggaggttcgggtactcgaaggtactacgtaagtttaacaaagttaggttaggtaaattacgttacctatagtcggacggtaccttcgtaggtaggaacgggtccctattccaacctatcccgtaccaaggacgaacccaacgacccgaacggtacccttaccccgttactaacgtacctaaaggtaaactcgggaactaggtacctaagaaccgtaacgtaggaacggtaccgttaccggtttacctttttacgttacgttacggtacgtaaacggtaaacggtacggaaacccgtactaacgtttaacgtttaccaagtacggtcgtcgggtaacc

SEQ ID NO: 190079 - DNA, 538 bp, Homo sapiens
  misc_feature: GYAE6OF01ERIE6.26.12.B01.1.454.CMB.1.raw
  modified_base (202)..(202): a, c, t, g, unknown or other
  misc_feature (202)..(202): n is a, c, g, or t
  modified_base (387)..(387): a, c, t, g, unknown or other
  misc_feature (387)..(387): n is a, c, g, or t
  modified_base (442)..(442): a, c, t, g, unknown or other
  misc_feature (442)..(442): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccgaggggaaagngtcaccctctcctgcagggccagtcagagtgttagtaacacttagcctggtaccagcagaaacctggccaggctcccaggctcctcatctctggtgcactcccaccgagggcccacgtcggtactccccggccagattcgagtcggcgaggggtctggggacagaattcactctcaccatcaccngcctgctagtctagaagtatttgctagttcttattactgtcagctaatataattntagtctactcgttcgggtacgggggaccagtcgtggagactacgaaccgtacgtgtcggactgcaccgtatccgtgtcttcacttccttcccgtcc

SEQ ID NO: 190080 - DNA, 534 bp, Homo sapiens
  misc_feature: GYAE6OF01AL4HH.26.12.B01.1.454.CMB.1.raw
  modified_base (201)..(201): a, c, t, g, unknown or other
  misc_feature (201)..(201): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccagggggaaanagtcaccctctcctgaagggccagtcagagtgttagtaacaacttagcctggtaccagcagaaacctggccaggctcccaggctcctcatctctggtgcatccaccagggccactggtactccccggccagattcaggtggcgagggggtctggggacagaattcactcctcacccatccaccagcctgcagtctagaagtattttcgctagttctattactgtcagactaatattaattactggtcttcgttcgtttcgggccggggtactaagcgtggagactcgaaccgtactggtggctgcnccntctgtcttcatccttcccgctacg

SEQ ID NO: 190081 - DNA, 595 bp, Homo sapiens
  misc_feature: GYAE6OF01CR7Z3.26.12.B01.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagataccactggagaaatagtgatgacgcagtctccagccaccctgtctgtgtcnccaggggaaangtcaccctctcctgcagggccagtcagagtgttagtcgcggcttgcctggtaccagcagcaccgtgggcacgacctccaggcctcctcattttancgctgcactcccgacgacgggcctacgtggtactccccgagcctaggttcaggtcggcgtagggtggtcgtagggaactggtacgtttcacgttctaccactatcagcgacgcctgctagttacagaagtnttcgtacgtactaattttctaagtctanacgtaactaattacgtaacttccgtcggacccttccggtactcgtaccggttacgggacgggtaacggtaaccgtaagggttgaacggttaacctaacgtaaaaccgtcgtagggtcctagtaacgaccgttaccgtaacg

SEQ ID NO: 190082 - DNA, 592 bp, Homo sapiens
  misc_feature: GYAE6OF01A4WAE.26.12.B01.1.454.CMB.1.raw
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
tcagagactatactcacgaccggtgctcgatttagtagtgtagattccgcgggggggagaggagccccagccctgagactcccaggtgcttccattcagtgatcagcactgaacacagaggactcaccatggagttgggactgaactggtattttccttttgacctattttaaaaggtgtccagtgtgaagggcagctggtggagtcgtgggggagacttggtccagcctggcaagtccctaagactctcctgtgtcgcttctggattcactttgatgaatatgccatgcactgggtcctnaggcaccgaggggcgggcctgggagtgggtctcgaggtatcagttacaatagtgtaatagtactcgtatggcgactgtgtgaacggcattcacctatccncagacgacaacgccaacggtaacctccctatactaccgttaagaaacgtacggactaaggtcctaggaacctaacgtacggaaggtaaccgtaccggttacctttttagttacgttcggttacgacgtaaagggtcggaaaccgtatagttactttacaagaacgtacgtacgactacgtggttaccgtcg

SEQ ID NO: 190083 - DNA, 716 bp, Homo sapiens
  misc_feature: GYAE6OF01CL444.26.12.B01.1.454.CMB.1.raw
tcagagactatactcacgaccggtgctcgatttagtagtgtagattccgcggggagctctgggagaggagccccagccctgagactcccaggtgcttccattcagtgatcagcactgaacacagaggactcaccatggagttgggactgaactggtattttcctttgacctattttaaaaggtgtccagtgtgaaggcagctgggtggagtcgtgggggagtacttggtccagccgtggcaacgttccctaagtactcctccgtgtcgtcgtctttcgtggtactttcctaactttgatgtaatatcgaccatcgctacgtcgggtccgtagacggccgaacggaggggcgggacgtgggacggttcgggtcctacgtaggtacttaacgtaagtttaacgaaagttaggttaagttaaattacgtacttacgtaagtcggtacggtaacttcggtaggtacggaacgggtcctaacgttaccgacctactccgtaccgaaggaacgaccgaaacccgaccgaacgtaacccttccctagtaactacgtaaagaacgttcgaacgtagtaccgtagtaaccgaacgtacggaacgaccgttaccggttacctttttacgttacgttacggttacgaaccggttaaaacgggtccggtaaacccgtaacgttaaactttaccgtttaaaccaacgtaacggtccgtacggtaacccg

SEQ ID NO: 190084 - DNA, 564 bp, Homo sapiens
  misc_feature: GYAE6OF01DDHWS.26.12.B01.1.454.CMB.1.raw
  modified_base (202)..(202): a, c, t, g, unknown or other
  misc_feature (202)..(202): n is a, c, g, or t
  modified_base (534)..(534): a, c, t, g, unknown or other
  misc_feature (534)..(534): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaaatatgatgactcagtctccaggccaccctgtctgtgtctccgaagggggaaangtcaccctctcctgcagggccagtcagagtgttaagaacaacttagcctggtaccagcaagaacctggccaggcctcccaggcctcctcatctctggtgcactccacgagggccacgtggtactcccggcagacttcgaggtggcgagggggtctagggacagtaacttcactctcactatcaccagcctgactagtctagtaagtatttgctagttctattactgtacagtactaagttataacttacgtcgtccttcgttccggtttcggggacggggtaccaggtcgtaggacgtacgtaccgaaccgtagtggtcggactcgcacctntcgttcgttacttctactcccttccgtacc

SEQ ID NO: 190085 - DNA, 871 bp, Homo sapiens
  misc_feature: GYAE6OF01EH88Z.26.12.B01.1.454.CMB.1.raw
  modified_base (193)..(193): a, c, t, g, unknown or other
  misc_feature (193)..(193): n is a, c, g, or t
tcagagactatactcacgaccggtgctcgatttagtagtgtagattccgcgggggagaactgctcagtcaggacccagacggaaccatggaacgccccagcgcagcttctcttcctcctgctactctggctccagatattacggaaaatatgatgactcagtctcagcacctgtctgtgctacgaagggaaancgtccacccgttctccgtagccgagggcctagcgaaggtgttagttaacgaaacaacgtttcgccgtaggtaaccagacaacgtaaaccgtcggaccaggtcctacccgaggtcctcctactaccgttcgtcggtcgggtacacgtaaccttacccggaacccggtacgggtacccctaacggttccgggtaacccgtccccggtacggtagttaaaccgtttcggaccggggtaggggtcccgggtaaaggggggttccgtaacggggaactaacgggtttaacctttacccggaccctttaaccgtaccccgtaaaccgtaacccgttacccggaacccgtaacggttccccggtacgtaccgtaacggtttaccgtaacggttaaacggttttacgtttccggtaacgttaacgtttacgttaaccgtttaccgtcgttaacgaacgtaacgtttaaacttaaactttaaccggttccgtaacgggttccctttaccgggttacggtttacccggggggaccggttaaaccggtaggtacccggttagggaaccgttaaacgtaacccggtttaaccgtaacgggttcggtacccgggtactacggtaacccgttacgttacgttacggttactttacccgttaacttaccccgttcccggttacccctaaccgg

SEQ ID NO: 190086 - DNA, 790 bp, Homo sapiens
  misc_feature: GYAE6OF01B0KLU.26.12.B01.1.454.CMB.1.raw
  modified_base (199)..(199): a, c, t, g, unknown or other
  misc_feature (199)..(199): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaaataatgatgactcagtctccaggcaccctgtctgtgtctccgaggggaangtccaccctctcctgcagggccagtcagagtgttaagtaactaacttagccgtggtaccagcaagaaacctggaccaggcctcccaggcctcctcatctctggtcgcactccgaccgacgggccctacgtcgggtacctccccgggacagtactttcgaggttgggccggtagggggtccgtaggggaacaacgtaacgtttccaacttcctacccgaccctactacccgaacccgtacgtccccgttagaccgtacggttacgtacggtaaagttacgtttttacgacgttaacggtttactttaacgtttaccgtttgttaaccgtaggtaaccttaaattaatttaaacgtttaccgtacgggttacctttcccgggttttaccggtttacccggggggtacccggggggtaacccgttaaacgggttacccgggtagggtaaccgggttaaccgttaacccggtaaaaccccggtaacggttccgggttacggggtacttaccgggacccctaacccggttacgttaccccgttccggtttacccgtttacccttaccccgttttccccgttaccccccggtacccc

SEQ ID NO: 190087 - DNA, 862 bp, Homo sapiens
  misc_feature: GYAE6OF01CT7GA.26.12.B01.1.454.CMB.1.raw
  modified_base (346)..(346): a, c, t, g, unknown or other
  misc_feature (346)..(346): n is a, c, g, or t
tcagagactatactcacgaccggtgctcgatttagtagtgtagattccgcgggggaggaactgctcagtcaggacccagacggaaccatggaacgccccagcgcagcttctcttcctcctgctactctggcctccagatattaaaccggaaaaataatgatgactcagtctccgaggccaccctgtctgtgtctaccggaaggggaaagcgtccaccctctccgtgcgacgggccagtcaggtagttagttaacgtaaactaacttagcctaggaccaagacaacgaaaccgtcggaccgacggcctacccgaggtcctcctactacgttccgtacgttggtaccncctaaccgtaccccgaaccggaaccggggccctaaccgggtttaccgggtaacccgttcccccgggaccgttaagtaccgtttacggacgggttacggggaccggggtaacgggggggtttaccggaaacggggtaaacgtaacgggtttaaaaccgttccctaaccgtttccgaaacccgtaaaccctaacgtaccccgaaacccgtacggtacccgtacggtaaccgttacgggttaaccttaaggggttaaacggtttactttttaccggaccgtttaaggttaacccgtttaatttaaccgttacggtaactaacgtaacttaaaacgtttaattaacgtttacggtcggtttacctttcgggttccggggtttaaccgggggaccgggggtaactaacgggtaccgtaggaaccgttaacggtaacccgtaaacggtacgtcggtacgggtactacgcccgaacttacgtttccgtaagttccctttacgacccgttcccgttccgtaacc

SEQ ID NO: 190088 - DNA, 743 bp, Homo sapiens
  misc_feature: GYAE6OF01DHVHF.26.12.B01.1.454.CMB.1.raw
  modified_base (202)..(202): a, c, t, g, unknown or other
  misc_feature (202)..(202): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaaatatgatgactcagtctccaggcctacctgtctgtgtctaccgaaggggaaancgtccaccctctccgtgacgagggccagtcaggtagtgttaaagtaacctaacgttacgccgtaggtaaccaggacaaacggtaaacccgtcggaccgacggtaccctacccgaggtccttccctactacttcgtaccgttgggtacgtacctacgtaccccgaacggacggggtccctacggttcgggtaccctcccccgggacctaaggttaccttacggagggttcgggacgggttacgggggtactacggggaaacctaggttaacttccgaaccttcctaacctaccgtactaccaaccgtcgtccgtagacgtacgttacgtaagtaacgttcgtttagacttaacgttacttattacgtgtacacgtaactaattaataacgttagtcgtctttacgttccggttacgggtaccggtacggggacctaacggtcggtaggtaaccgtacgtacccgtaacggtacgttacggcgggttactacggacttaacctacgttcgttacgtttccttacgtcccgtttcccgtacccg

SEQ ID NO: 190089 - DNA, 592 bp, Homo sapiens
  misc_feature: GYAE6OF01BOZ5N.26.12.B01.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
  modified_base (538)..(538): a, c, t, g, unknown or other
  misc_feature (538)..(538): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaatatgatgactcagtctccaggcaccctgtctgtgtctcgagggggaaangtccaccctctcctgcagggccagtcagagtgttaagtaacacttagcctaggtaccagacaagaacctggccaggcctcccgaggcctcctcatctctggtncactcccaccgacgggcccagtcggtacctcccggcagtattcaggtggcggtaggggtctgggacagtatccactcncaccatccaccgacgctagctgtctagtaagttatttcgactagttaccttatttactgtacatactaattaattaacttacgtgtcttaccgttcggttccggggaccgggggacctaaggcgtaggagtactaccgaaccggtaagtgtacggtcncgaccctactaccgttccgttcgttctttacctaccgttcccttccccgtaccg

SEQ ID NO: 190090 - DNA, 661 bp, Homo sapiens
  misc_feature: GYAE6OF01BNJ84.26.12.B01.1.454.CMB.1.raw
  modified_base (203)..(203): a, c, t, g, unknown or other
  misc_feature (203)..(203): n is a, c, g, or t
tcagagactatactcacgaccggtgctcgatttagtagtgtagattccgcgggggaggaactgctcagtcaggacccagacggaaccatggaagccccagctcagcttctcttcctcctgctactctggctcccagattccaccggagactattgttttgacacagtctccagccaccctgttctttgtctccgaggggaaancgcccacctctcctgcgagggccagtcagagtgttgcagctactagcctaggtaaccaacgaacgtaaaccgtggtaccgacggcctacccgaggtcctccgtacacttctagtgatcgactactaccgaacgcggccagtcgcactccagcctaggtcaggtgctagtcgtacgtcgtacggactacgtacttacgacctctacgaacctagtaccgacgtacaccgtaccgtaaggacgtacctaaggtaacgtttagtttaccgtaactttaacgttttacgttaacgttcgtaaccgtacggtacgtacggtacgttaacgaccgttaaccgtcggttacccttcgttacccgttaccgggttaccgggacgggtaacggaccggtagggacggtacgtacggtacgaacggtacggtaccgtggtacggtacgacgaccacttgtccgttacg

SEQ ID NO: 190091 - DNA, 755 bp, Homo sapiens
  misc_feature: GYAE6OF01EHS2E.26.12.B01.1.454.CMB.1.raw
  modified_base (176)..(176): a, c, t, g, unknown or other
  misc_feature (176)..(176): n is a, c, g, or t
  modified_base (202)..(202): a, c, t, g, unknown or other
  misc_feature (202)..(202): n is a, c, g, or t
tcagagactatactcacgaccggtgctcgattttagtagtgtagattccgcgggggaggaactgctcagtcaggacccagacggaaccatggacgccccagcgcagcttctcttcatcctgctactctggctccagatattaaccggaaaaataatgatgactcagtctccaggcnccctgtctgtgtctacgaggggaaanacgtcaccctctcctgcacgggccagtcagagtagtcgtaaactaacgttagcctaggtaaccagccaagaaacctcggccaggcctcccaggctcctcatctctggtcgactctccaaccgtacgggcccacgttaggtacccgtccccggaccgtaagtccaaaggtttcggactaaggggggtcctaggggggtaccctaggggaaactttaccggaacttacgtacctaacccgtactacccgaacctacgaccctacgtccaacggtccttacggaacgtaggttttaacgtacgtttacggttcaaacgttttactacgtttacgtaagtaccgtaagttactaaatttaacttaacggttaccgttacgggttccttttaccgggttccggggttaaccgggttaacgggggacccgtaacgggtacggtaacggttaccggaaaccggtaaacccgttaacgggtacgtacggttacgggccgttaccggaaccttcccgtaacgttacccgtttacgttccgtttaccgttccccgttaccccg

SEQ ID NO: 190092 - DNA, 764 bp, Homo sapiens
  misc_feature: GYAE6OF01CFOK7.26.12.B01.1.454.CMB.1.raw
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctcgaggggaaagagtcaccctctcctgcagggccagtcagagggggtnttaagtaactaacttagccgtggtaccagacaagaaacctggccaggcctcccaggctcctnatctctggtcgcactccaaccgacgggccaacgttcggtacttccccgggccaagtactttccgaggtcgggcgtagggggtccgtagggggaactaggtaatttccgaaccttcctaccgaacccaacttaccgaacccaacggtcccctaggcctaacggtttaccttaaggggtaaacgtttacgtttttacggaccgttacggtttaaccgtttaaacttttaccgttacggtacgtaaccggtcgaacgggttaccggttacggaacccgtaacgttccgggtacccgtttacccgttaccgttaacccgggttttaccgggggacccgggggtaacgggaacccgggtaacgggggtaggggaacgtaccgtacggaaacggtaaccggtaacggttcgggtcgggaccgttcggaccctaaccgtacgttccgttacgtttccgttaccgttaaccccg

SEQ ID NO: 190093 - DNA, 733 bp, Homo sapiens
  misc_feature: GYAE6OF01CCTTM.26.12.B01.1.454.CMB.1.raw
  modified_base (200)..(200): a, c, t, g, unknown or other
  misc_feature (200)..(200): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaaccggaaaataatgatgactcagtctccaggcaccctgtctgtgtctccgaggggaaanacgtcaccctctcctgcgagggccagtcagtagtagttaagtaacaacttagccgtaggtaaccaggacaacggaaacctgggcccaagggcctacccgacggtcctccctctactcgtcgtgggtgccacgtccaccgacggcctaacgtcggtaacctccccgggaccacgtacttacgaggtcgggtaccggaaggggggttctacggggaactacggtacttcctacgtactcaactactacgaacgcgaaggtacgtacgggacgtccgttaggaacggttagttttagacgttacggttagtttagtttacgtaggttacgaacgtacgtagttaacgtacggtacccttacccttacgtttaccgtttacccggttacggtttaccgtttttcgggaacccggttaacgggggtacctaacggtacggtacggtaacgttaacgtaaaccgtaaacggttaacgtcggtacggtaccgtacggtacccgtaccgttacgttccgttacgttccgtttccttacccg

SEQ ID NO: 190094 - DNA, 702 bp, Homo sapiens
  misc_feature: GYAE6OF01CUSLW.26.12.B01.1.454.CMB.1.raw
  modified_base (309)..(309): a, c, t, g, unknown or other
  misc_feature (309)..(309): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctaccgagggggaaagagtcaccctctcctgcagggccagtcagtagtgttaagtaaacacttagcctggtaccagcgaagaaaccgtgccgaggcctcccgaggctcctcatctcgtgggtnccatccgacgtacggcctacgtggtacctcccgggacaagtattcgaggtcggacggtagggggttcaggggacaagtaatttcgaactctaccactactaccacccacgtcctgacgtacgttacctaggtaacgttagtttacgacttaacggttacctttaatttaccgtagttaccgtaacgtaacttaaaatttaactaaacgtttaaccttcgggtaaccttccggttttacccgggttttaccgggggaaccggggggttaaccctaacgggtacggtagggaacgttaaaccgtacggtaaaaccccgtaggttacgtcgggtaccgttggacctaccggtacttacgtcggtttaccttccgttaacttcccgttccccgtacg

SEQ ID NO: 190095 - DNA, 713 bp, Homo sapiens
  misc_feature: GYAE6OF01BK6LA.26.12.B01.1.454.CMB.1.raw
  modified_base (202)..(202): a, c, t, g, unknown or other
  misc_feature (202)..(202): n is a, c, g, or t
tcagagactatactcacgaccggtgctcgatttagtagtgtagattccggcgggggaggaactgctcagtcaggacccagacggaaccatggaagccccagcgcagcttctcttcctcctgctactctggctcccagatattaaccggaaaaatatgatgactcagtctccaggcaccctgtctgtgtctccgaggggaaangtccaccctctcctgcagggccagtcagagtgttaagtaacaacttagcctggtaccagacaacgaaaccgtggaccaggcctcccgaggtcctcctacacttctcgtggtcgcactacccgaccgtacgggcctacgtcggtaccgcccggacagtacttcgaggtggcggtaggggtcagggacagtaacgtcactctacacgtactccgacacgtcctgactacggttctaggtaacgttacgttttcggacttaacgttacttaagtttaccgttacggtaaccgtaacgttaactaaagtttaacgtttaaacgtttaccggttcgggttaccctttaccgggtttacccggggtttaaccgggggggaccgggggtaaaccctagggtacggtagggtaaccgtaacgtaacccggtaaaccggttacggtacgggttacggtaccgtcgtaaccgtaccgttccttacgttcgttaccttacgtcccttccccgttccgtaccg

SEQ ID NO: 190096 - DNA, 780 bp, Homo sapiens
  misc_feature: GYAE6OF01C9NPV.26.12.B01.1.454.CMB.1.raw
  modified_base (205)..(205): a, c, t, g, unknown or other
  misc_feature (205)..(205): n is a, c, g, or t
tcagagactatactcacgaccggtgctcgatttagtagtgtagattccggcgggggggagaggagccccagccctgagactcccaggtgcttccattcagtgatcagcactgaacacagaggactcaccagtggagttgggactgaactggtatttttcctttgaacctaagttttaaaaggtgtacctagtggtgaagggcagngtgggtggagtcggtgggggagtacgttggtccagcctgggacaacgttccctaaagctcctccgtgtgtccgtcttctggtacttcctaccttgattagaatatcgccatcgcgtacgtcgggtcccgtcacggccgaaccggagggggaccggggcctagggggtacggtcggggtcctaggagggtaacttaccgtaagtaacaaagttaaggtacggttaaatacgtaaccttgtaaacgtcggacggtacctggtaggtaacggaacgggcctacgttccaactacgtctaccgaagacgaaccgaaaccgccgaacggtaacccttaccctattaacgtaaccgtaaagtaaacgtacggaacgtacgtacgtacgtaaaccgaacgtaacgggtaacgtacccggttaaccgtttacccgtttttacgttacgttacggtaacgtaaaccgggttaaacgggaaccggttaaacccgtaacgttaactttaaaccgttttacgaaacccgttaacggtaaccggttaccggtacccgtttaacggttaccggttaaccgtttacccgg

SEQ ID NO: 190097 - DNA, 868 bp, Homo sapiens
  misc_feature: GYAE6OF01DTS1H.26.12.B01.1.454.CMB.1.raw
tcagagactatactcacgaccggtgctcgatttagtagtgtagattccgcggggagctctgggagaggagccccagccctgagactcccaggtgcttccattcagtgatcagcactgaacacagaggactcaccatggagttgggactgaacttggtattttcctttgactaattttaaaggtgtccagtgtggaagggcagcgtggtggagtcggtgggggactacgttcgggtccgacggtcccgtagggacctaaaccggttacccccgttaaaaggtacccttccgttccccgttggttcggttcccgtccgttttccgtagggtaccttttaccctaaccgttttggtaattaaggtaaattacgttcggtacccctaagtcggtccgtaaccggttcgggggtaccccgtacggacggggacccgaaacccggggaggggggtaccggggtcccgggttaggggacggggtttcggggtaccgttacggtaacggttacttaacgtaaacggttttaaaccgaaaggtttacggttaaggttaaatttaacttacgttacttagtcggtaccggttacttcgttacgggttagggaaccggggtccctaaggtttcccaaaccgtacttacccgtaccgaaggtaaaccgaacccgaaccggtacccgtaaacggtaccccttacccgttaactacctaacgttaacgtaagtaacgtaacggtacttacgacgtaaccgtaaggtacggaacggttaccgttacccgtttaacttttacgtttaagtccggttaagtaacggtaaagggtaaccgtaacggtacttaacgttaactaaccgtaggaactaggtggtaaccg

SEQ ID NO: 190098 - DNA, 724 bp, Homo sapiens
  misc_feature: GYAE6OF01A1GWT.26.12.B01.1.454.CMB.1.raw
  modified_base (203)..(203): a, c, t, g, unknown or other
  misc_feature (203)..(203): n is a, c, g, or t
tcagagactatactcacgaccggtgctcgatttagtagtgtagattccggcgggggaggaactgctcagtcaggacccagacggaaccatggaagccccagcgcagcttctcttcctcctgctactctggctccagatattaaccggaaaaataatgatgactcagtctccaggccaccctgtctgtgtctccgaggggaaancgtccacccttctccgtgccgagggccagtcagtagtgttagtaacaacttacgcctaggtaccagacaacggaaacccgtggaccacggccgtacccgaggtccctacctactacttcctcgttggtcgacctaactcccgaaccggacgggtccctaacggttccgggtaaccgtacccccgggactaacggtacgtttaccgagggttcgggaccggtagggggtcctaggggactaacggtaattcccgtacttctacccgaaccgtacctcgaacccgtacgtccctagaccgtacgtccgttagtaacgtttagttttacgacgttacgttacttacgtttacgtcgtacaacgtacttaagttacttaactttacgtcgttaaccgtttcggttccgggttaccgggggtaccgggtaaccgtaagtcggtaggaacgtacgtaccgaacgtaggtcggtcgtactcgcctaacgtctaccgttcgttacctctttacctcccgttcccgtacg

SEQ ID NO: 190099 - DNA, 765 bp, Homo sapiens
  misc_feature: GYAE6OF01B1ORH.26.12.B01.1.454.CMB.1.raw
tcagagactatactcacgaccggtgctcgatttagtagtgtagattccggcgggggggagaggagccccagccctgagactcccaggtgcttccattcagtgatcagcactgaacacagaggactcaccatggagttgggactgaactggtattttcctttgacctaagttttaaaaggtgtccagtgtggaagggcagctggtggagtcgtggggagacttggccagcctggcaacgtccctaagacctcctcctgtcgtcgtctttcgtggactttccacttttgatgaatatcgccatcgcacgtgggtccctgacggcaaccggaggggacgggtcctggggagttgggtcctacgaggttactcgaagtttaacaagttaggtagtaaatattacctgttaagtcggtaccggtacttcgtagggtacggaaacgggccgttaatttccaaccgtacttcctaccgaagaacgaaacccgaaccgacccgtaaacggtaacccttccccgttataattacccgtaaagtaacgttacgggaacttaacggtaccgttagaaacctacggttacggtaaaccggaccgtttaacccggtttcctttttttaacggttcgttagggttaacccgttaaagggtaaaacccggggtttaccgggaaaaccccttaactaacgtttttaacctttacccgaaaaccggttaagttcccggttacgggtaccttaacccggttttaagggtccccctttaaaggg

SEQ ID NO: 190100 - DNA, 814 bp, Homo sapiens
  misc_feature: GYAE6OF01C6DZS.26.12.B01.1.454.CMB.1.raw
  modified_base (334)..(334): a, c, t, g, unknown or other
  misc_feature (334)..(334): n is a, c, g, or t
  modified_base (740)..(740): a, c, t, g, unknown or other
  misc_feature (740)..(740): n is a, c, g, or t
tcagagactatactcacgaccggtgctcgatttagtagtgtagattccggcgggggggagaggagccccagccctgagactcccaggtgcttccattcagtgatcagcactgaacacagaggactcacagtggagttgggactagaacttggtactttttccttttagaccttaagttttaaaaggtcgtaccgaggttggtaggaagggcagtcgtgggtggtacgtcggtagggggataccgttcggccagccgtggacctaacggtaccctaagccttctccgttgtgtccgtactttcgtggactttccgtacctttggaactgtaaatntcgacctatcgactacgtcgggtcctacgaggccgtaccgggagggggacgggtccgtaggggtacggttcgggtacctacggaaggttactaccgtaaggttaacaaagtttagggtaacggttaaattaccgttccgttaacgttagtcgggaacccgttatcggtaagggtaacggaaccgggttctaactttaccgaccgtacgtaccgtaaccgaaggtaccgaaaccccggaccgtaccgtaaacgggttacccctccgtaacttaacgtaccgaaagggttaactcgggaacgttacttacgaacgacttaaacgggcgtaaccggtaacgtttcccgggttttaactttttacgtcgggttaccaaggtaacccggttaaagggtccgtaaaaccgtntttaaacgttacgttaacccgaagtaacggttcccgttaaggccctttaacgggtaccgtttacgtaacccggg

SEQ ID NO: 190101 - DNA, 673 bp, Homo sapiens
  misc_feature: GYAE6OF01CPS8M.26.12.B01.1.454.CMB.1.raw
  modified_base (216)..(216): a, c, t, g, unknown or other
  misc_feature (216)..(216): n is a, c, g, or t
tcagagactatactcacgaccggtgctcgatttagtagtgtagattccgcgggggggagaggagccccagccctgagactcccaggtgcttccattcagtgatcagcactgaacacagaggactcaccatggagttgggactgaactggatttttccttttgacctattttaaaaggtgtccagtgtgaagggcagctggtggagtcgtggggganacttggtccagccctggcaagtccctaaagacctctcctggtgtccgcttcgtggatttcaccttttgatgaatatcgccatcgcacgtcgggtccgtcgacggccaccgaggggacgggcctgggacggtgggtctcgaggtatcgaagttacaagttgtagtaatagtactctatggacgtactcgtggtacggaacgggtccatttaccacctatcctaccgaagacgaacccgaaccgaccaacggtaaccctcccgtattaactcgtaaagaacgtcggaactagtacctagaaaccgtacgtacgggacggtaaccgttacccgggtttcttttttagttccgtagtaccggaacgttaaaaggggttccggaaacccgtagtaaacgtttacctttaccgaaacgtacggtccgttacgggtacttaaccggttggttacccgtttacgg

SEQ ID NO: 190102 - DNA, 680 bp, Homo sapiens
  misc_feature: GYAE6OF01EQRCT.26.12.B01.1.454.CMB.1.raw
  modified_base (213)..(213): a, c, t, g, unknown or other
  misc_feature (213)..(213): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaaatatgatgactcagtctccaggcaccctgtctgtgtctccgaaggggaaagacgtccacccctntcctgcgagggccagtcaagagttgttaagtaacacttagcctggtaccagcaagaaacctggccaggcctcccaggctcctcatcctctgtgcaactccgaccacgggcctactcgggtactcccggacctagaacttccagtagggctagggggtctgggactagaagttcactctcaccactcaccacgccagctagtacgtagtaagttactttcgtacgtacgtacttacttctaggttcataccgtaagttacgttactagttacggtacctaacgggtcccgtacccgttacgtaccccggttaaccggtacccggaaacgggtaaccgaccggtaaacgtaccgggttaaaacggtaaacgtttaaacccgggaaacgtttcgggtaacgggtcgttaaccgtacccgggtaaccccttaggttaccccgtttacgtttcccgttaacgtttaaccccg

SEQ ID NO: 190103 - DNA, 791 bp, Homo sapiens
  misc_feature: GYAE6OF01B9M3E.26.12.B01.1.454.CMB.1.raw
  modified_base (204)..(204): a, c, t, g, unknown or other
  misc_feature (204)..(204): n is a, c, g, or t
tcagagactatactcacgaccggtgctcgatttagtagtgtagattccgcgggggaggaactgctcagtcaggacccagacggaaccatggaacgccccagcgcagcttctcttcctcctgctactctggctcccagataattaccggaaaaatatgatgactcagtctccaggcaccctgtctgtgtctccgaaggggaaacncgtccaccctcgtcctgcagggccagtcgagtagttagttaacgtaactaacgttacgaccgttaggtaccagacgtaacgaaaccgtcggaccgacggtcctacccgacggtccttccgtactacttccgtcgttacgggtcgacctaccgttacccgaccggtacgggaccctaccggttacggtaccgtccccggtacgtaacggtacgttccgacggttcgggacggtacgggggttacgacggggtaacgtaaggtaacgttccgtaaccttccgtacgtaccctacgtacctaacccgtacgtccgtacgtccgtacgtacgtacgtaacgttacgtttacggacttacgttacttacgtttacgtacgttacgaacgtacttaaacttaacgtttaacttacgttcggttacctttacggtttaccgggtttaccgggggtaccgggtaaccgttaacgggttacggtacggtacgtaaccgtaaccggtaaccgtaccgttacgggtacgtaccggtcgtaccgaccgttaacggttccgttacgttacccttaccgtaccgtttcccgtccgttaccg

SEQ ID NO: 190104 - DNA, 680 bp, Homo sapiens
  misc_feature: GYAE6OF01ED79E.26.12.B01.1.454.CMB.1.raw
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
tcagagactatactcacgaccggtgctcgatttagtagtgtagattccggcggggggaggaactgctcagtcaggacccagacggaaccagtggaacgcccagcgcagtcttcctccttcctcctagctactcgtcggcctccgagtattaacgttaaaccggaaaaatagtgatagactcacgtctcgacggcacccgtgtcgtggtcgtcgtacggaaagggaacgtacgtcctaccgtctccgtggcgacgggcctagtcgagtagttagtaactaactacttacgcgtacggtacagacgaacgaaccgtcggaccgacgtcctcccgagtcctaccatctcgtacgttggctactacgtaccgcgacggtcctacggtcggtacctccgacagtcgtaggcggtggcggtaggtcgngacgtaatcgtactcgtaccntacgacncacgcgtcacgtacgngttacgtagtagttcgttacgagtacttagttacgtacgtcgtaacgtagtaactaacgttaacttaagttcgtcgttacgtttaccggtacgggtaaccgggtaccggtacgtaacggcggtacggtaacgtacgtaccgtacgtagggtcgtacgtacgtacgtccgaacgttctaccggttctacgttaccgtaccgtccgtacccgtacg

SEQ ID NO: 190105 - DNA, 662 bp, Homo sapiens
  misc_feature: GYAE6OF01DPX1C.26.12.B01.1.454.CMB.1.raw
  modified_base (217)..(217): a, c, t, g, unknown or other
  misc_feature (217)..(217): n is a, c, g, or t
tcagagactatactcacgaccggtgctcgatttagtagtgtagattccgcggggagctctgggagaggagccccagccctgagactcccaggtgcttccattcagtgatcagcactgaacacagaggactcaccatggaggttgggactgaactggtatttttccttttgacctattttaaaaggtgtccagtgtgaagggcagctggtggagtcgngggggagacgttggtccagccgtggcaacgtccctaagctctcctgtcgtcgtcttcgtggtattccactttgatagtaatatcgccatgcctacgtgggtcccgtcgacgggccaacggacggggacggggtccgtaggggacggttgggtacctcggtaaggtactacgaaggtttaacaagttaggttagtaaacttatacttactagtcgacggtactcgtaggtaggaacggtacctatccgactacgtcctacgagaacacaccgacacgtacctcctatactactaagaagacgtacactcgagaacacgtagacggtaccgtacgttacctttttagttcgttacgtacggtaacggttaaacggtaaccggtaaacccgttaaacgtaacgttttaacgtttaacccgaaagttaaccggtcgttcggtaaacccg

SEQ ID NO: 190106 - DNA, 787 bp, Homo sapiens
  misc_feature: GYAE6OF01B6D4Y.26.12.B01.1.454.CMB.1.raw
  modified_base (658)..(658): a, c, t, g, unknown or other
  misc_feature (658)..(658): n is a, c, g, or t
tcagagactatactcacgaccggtgctcgatttagtagtgtagattccgcgggggggagaggagccccagccctgagactcccaggtgcttccattcagtgatcagcactgaacacagaggactcaccatggagttgggactggaactggtattttccttttgacctattttaaaaggtgtccagtgtgaagggcagctggtggagtcgtggggagtacgttggtaccagccgtggcaacgtccctaagtacctctccgtgtcgtcgtcttacgtgtattctacctttgagtagaattacagtcctagtcgacgtcgttcgggtacccgtcgacggaccgaccggtacggggacggggggtccgttaggggtacgggttcggggtccgttacggagggtttacgtaccgttaacggtttaaccgtaaggtttaggtaaggtttaacttaataccgtttacttaacgtcggtaccggtacttacccggttagggtaacggtaaccgggtccgtaactttaccgaacccgttaagtacgtaccgtaggtaaaccgaccgtaaacccggacccgtaacggtaaaccccctttccgtaacctttagtaacccgttaaaagtaacgtacggttacccaaagttcgtaacggtaactaaccggnggttaaccggtaccgttaaccgtttcgtttttaacgtacgttggtaacgacgtaaaggggttaccaccgttaaactgtttaaacttcccgaaagttacgtccgtagttacccgtgttacggtcgttacg

SEQ ID NO: 190107 - DNA, 930 bp, Homo sapiens
  misc_feature: GYAE6OF01ACRDK.26.12.B01.1.454.CMB.1.raw
  modified_base (238)..(238): a, c, t, g, unknown or other
  misc_feature (238)..(238): n is a, c, g, or t
tcagagactatactcacgaccggtgctcgatttagtagtgtagattccgcgggggaggaactgctcagtcaggacccagacggaaccagtggaacgccccagcgcagcttctcttcctcctgctactctggcctcccagtatacttaaccggaaaaatatgatcgactcagtcctccgaggccaccctgtctgtcgtccgtaccggaaagggggaaactcgtcccacccttcgtccgnggccgacgggcctagtcgaggtagtttactaacgtaacctaacgttacgccgttacggtaccagtacccgaaacggtaacccgtcggacccgaccgggtacccttacccggaacggtcccgttccctaccgtaaccgttccggttacggtttccgggaccgtacccgtaaccgttcccccggaaaaccggtcccggggtacccttaaccggtaccgggtttacccgtaccccccgggagtacgttaccgttccggtaagggtccgggtcgggacgggggttactacgggaaccgtaaggtacctttcgacccgtacctaccgaacctctaccgtacccgacgtcgtaccgtcgtaacggttaccgtaaggttcccggtttaagttcccgggtaccgttacttaacgtttacggtacggtactaaacggttaacctttaaacgtttaacgtttacggttaccggtaccgggtttacctttaccgggggttttacccgggggtaaccggggggacccgtaagttcccgggtaacgttaggggtaaccctaacgggttaacccggttaccggtaaggtttcccgggacgtacccggttacccgtaaccgttacccggttacccgtttaccggtttaccggtttacccggtaccctttaacccgggttaccccccttacgggtcctttaaaccggg

SEQ ID NO: 190108 - DNA, 768 bp, Homo sapiens
  misc_feature: GYAE6OF01CQBKD.26.12.B01.1.454.CMB.1.raw
  modified_base (195)..(195): a, c, t, g, unknown or other
  misc_feature (195)..(195): n is a, c, g, or t
tcagagactatactcacgaccggtgctcgatttagtagtgtagattccggcggggggggagaggagccccagccctgagacctcccaggtgcttccattcagtgatcagcactgaacacagaggactcaccagtggagttgggactgaactggtattttccttttgactaagttttaaaggtgtcagtgtgaggnaggcgtgggtggagtcggtgggggacgtacgttcggtccaggtccgtacgggactaacggttaccctaagactcctccgtgtcgtcgtcttgtagtactttccgttacgtttgatagtaaatcgtacgacctagtacgtccgacggttccggggtaccgtacggaaccgggccgaacgggtagggggccggggtccgtaggggtaggttccgggttactacggtaggttactacgttaacgttaacgtaaggtttagttaggtaaacttacttacgtacttagtcggtacggtacttgtacggtaaggacgggtacctagttcccactactacctacgacgaccacaacgacgaacgtaccctccgtaactactacgtaaagtaacggcgtaactacgttacgtagaaaccgtacggtaccgggacgtaaccgtttacggttttacgtttttacgttagttcggtaacggtaaaccggtaaacgggtaaccggtaaacgtaacgtttaacgttcgtttaaccgaacgtaaccggttacgtacggttaacgttacggttcgggttaactttccg

SEQ ID NO: 190109 - DNA, 728 bp, Homo sapiens
  misc_feature: GYAE6OF01ADQZS.26.12.B01.1.454.CMB.1.raw
  modified_base (200)..(200): a, c, t, g, unknown or other
  misc_feature (200)..(200): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaaccggaaaatatgatgactcagtctccacggccaccctgtctgtgtctcgaggggaangtccaccatctccgtgcgacgggccagtcagtagttagttaacgtaactacgttacgccgtaggtaccagacaacgtaaccgtcggaccgacggtccctacccgaggtcccttacccgtactacttccgttcgtgggtcactacctacccgaccggaccgggaccctaccggttacggtaccgtccccggacgtagtaccgttacggagggtcgggtacgggtacggggggttcgtacggggaacgtacgttaccgttcgtaccttccgtaacccgtaactacgtccgtacgccgaaccgtccgtacgacgttacgtacgtaacggtaagtttacgttacgtacgtttaactttaacgttttacgttacgtacgtaacgtacgtaaacttaaactttaacgtaccgtttcccggtaccgtccttcccggtacttaccggtacgggttccgggacgggtacggtaacgtaggtaacgacgtacgtaacgaacgttcgtgtccgctacgtacctatcgtcttcgtctccg

SEQ ID NO: 190110 - DNA, 713 bp, Homo sapiens
  misc_feature: GYAE6OF01EQDQ7.26.12.B01.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
tcagagactatactcacgaccggtgctcgatttagtagtgtagattccggcgggggaggaactgctcagtcaggacccagacggaaccatggaagccccagcgcagcttctcttcctcctgctactctggctccagatattaaccggaaaaatatgatgactcagtctccaggccaccctgtctgtcgtcgtacgaaggggaancgtccaccctctccgtgcgagggcctagtcgaagnggttattaagtaacctaattacgccgttaggtaccagaccaagaaaccctggacctaggcctacccgagtccttcctacgacgtctacggtcggtcgcctactccgaccgcgggtaccacggttggtaacctcccggactagtcttacgaggtcggcgtaaggggtcagggacagtatctacgtctcaaccgtactccaacgcgtaccgtcgacgtaacgttcgttaaggtaacgttacgttttacgagtacgttacttactttacgtatacgtagtaactaagtttaacttaacgtcgttacggtccgtttacgttcggggttaaccggggtaccgggggtaactacgggtaacggtacgggtaaacttaccgtaaaccgtaacccgggtaactttacgggggtacctaccgttacgtacccgtaaccttcgttaacgtcgtttacctaccgttccgtttccctacccgaccg

SEQ ID NO: 190111 - DNA, 711 bp, Homo sapiens
  misc_feature: GYAE6OF01AVIBA.26.12.B01.1.454.CMB.1.raw
  modified_base (163)..(163): a, c, t, g, unknown or other
  misc_feature (163)..(163): n is a, c, g, or t
  modified_base (223)..(223): a, c, t, g, unknown or other
  misc_feature (223)..(223): n is a, c, g, or t
  modified_base (451)..(451): a, c, t, g, unknown or other
  misc_feature (451)..(451): n is a, c, g, or t
tcagagactatactcacgaccggtgctcgatttagtagtgtagattccgcgggggaggaactgctcagtcaggacccagacggaaccagtggaagccccagcgcagcttctcttcctcctgctactctggctcccagactattaccggaaaatatgatgactnagtcctacaggcctacctgtctgtcgtcctacgaagggggaaatcgtccaaccctctccngacgaggccagtcagacgttagttactaaacattacgcctggtaccagtcaagaaccgtgaccgaggtcctccccgaggtcctccgtacactcgtacgttggctacacgttcccacggtacggcctaacgtcggacctccggcctaaagtcttccgaggtcgggacgtacggggtctacgggaactaggtaaacttcgaccgtactccgaaacctatacgaaacccgnggtcccaagtccgacgttaccgtaagtacggttatttagacgttaacggttactattacgtcgtacgtaacgacgttaaactacgttaaacgttacttacgggtacctttacggtttacggttacccgggggtaccgggggtaaaccaacgggtttaccggacgggtaacgtacggtaaccgaaacccggtactaccgggtacgacgtaccgacccgtactaacgtcgttacttacttacacgttcccgtaccgtacccg

SEQ ID NO: 190112 - DNA, 997 bp, Homo sapiens
  misc_feature: GYAE6OF01CCM60.26.12.B01.1.454.CMB.1.raw
  modified_base (975)..(975): a, c, t, g, unknown or other
  misc_feature (975)..(975): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaatatgatgactcaggtctccgaggccacctgtcttgtgtcctccgaaggggaaagtcgtcctacccgtctccgtagcgacggggccaagtccgtaagtacggttagttaacggtaaccaacgtttacgcccggttagggttaaccccaggaccgtaaacggtaaacccgttacgggacccgaacggggtcccctacccccggtaacgggtcccgttccccttacgtaaccgtttcccgttaaccgtcggggttaaccggcccgttaaacccgttacccgaaccccgggtacgggggtaacccctaccggttaacgggtttaccccggtccccccgggtaaccgtaagggtaacttttccccggaagggggttacccgggaccggggggttaacgggggggtaccggttaaacgggggtaacccgttaaacggggttaaaccctttttcccgtaaacccgtttaccggtaccccttaaaaaccccgaccggtttaacccaaccccggtaaaccgggtttcccgtaaccggggtacctttaacggggtaccccggttaaggttaaaaccggtttacggttttaccgaaccggtttaactaacggtttttaacctttaccggttacgtttaaccgaacggttaacttaaagtttaacgtttaaaacgtttccgttcgtaccggtttaccgttaccggggttacggggggtaaccccgggtaaacggtacgggtacggtaggtactaaccggttaacccgtaacggtaacccggttgtaacggggcccttaccgcctaacccgttacgtagttacccttacggtttacccnccgtttacccggtcctacccgg

SEQ ID NO: 190113 - DNA, 682 bp, Homo sapiens
  misc_feature: GYAE6OF01DJBJD.26.12.B01.1.454.CMB.1.raw
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaaccggaaaaatatgatgactcagtctccaggccaccctgtctgtgtctaccgaaggggaaacacgtccaccctctccgtgcgacggccagtcagtagttagtaagtaactaattacgcctggtacagnaacgaacgtggccagctccgacggtctccancgtctcggncacnccgacnggcacgtggacctccgacagtcttcgaggtcggcggtaggggtcaggaacgacgtaacttaccgacttccacgtaccactaccgaacctacggtcctaggtactacgttacgtacggtaaagttacgtttaacggctaacggttactttaactttacggtagaaccctaagtaacctaaagtttaacgttaaactttaccgtcgggttacccgtttaccgggtttaccgggttacccggggggaaacggggttaccccaaaggtcggttaacggactaacgttacccgaaacgtagttcggcgtaccgtacgacttcgaacttccgttagtaccttacgacccgtttcccgtactccgttaag

SEQ ID NO: 190114 - DNA, 781 bp, Homo sapiens
  misc_feature: GYAE6OF01BZNLX.26.12.B01.1.454.CMB.1.raw
  modified_base (117)..(117): a, c, t, g, unknown or other
  misc_feature (117)..(117): n is a, c, g, or t
tcagagactatactcacgaccggtgctcgatttagtagtgtagattccggcgggggaggaactgctcagtcaggacccagacggaaccatggaacgcccagcgcagcttctcttccnctgctactctggcctccagtatagttaaccgaaaaatatgatgactcagtctcgacgtctaccctgtctgtcgtcgtacgggaagggaaagtccgtcctacctctccgtgcgaagggtcctaggtacgaggtagttacgttaacgaaactacgttacgccgtacggtacagacgaacgaacccgtgacccgagtccgaccgtaggcctactactacgtcgttcggtgaccgttcaaccgtacccgacggtaaccggtccgtaacggttacggtacccggtaccccggaattaaccggttactccggggttaacgggtcggggtaccggggtaagggggtcttaacgggaacgttaacggttaacctccggaccttccgtaacggaaccttacgtaccggaaccgtcggttacccgtaggtaccgttagtaacggtacgttaaacgttcttacggtccgttacgtacttaacgttcgtaacgttgtaacgacgtttacgtaacgcgttacgtacgttaccgacggttcctacccgttcgtaacccgggtacgtaacggtaaaccgtccgaacggttacgtaacggtaaacggttaaaccggaccgttacggaggttccggaacgaccgttacgaaacttctaacgttccttaccgtcttaacccg

SEQ ID NO: 190115 - DNA, 850 bp, Homo sapiens
  misc_feature: GYAE6OF01EA0OX.26.12.B01.1.454.CMB.1.raw
  modified_base (201)..(201): a, c, t, g, unknown or other
  misc_feature (201)..(201): n is a, c, g, or t
tcagagactatactcacgaccggtgctcgatttagtagtgtagattccggcggggggaggaactgctcagtcaggacccagacggaaccatggaacgccccagcgcagcttctcttcctctgctactctggctccagatattaaccggaaaatatgatgactcagtctcaggcacctgtctgtgtcctacggaaggggaanacgtcctaccctcgtcctgcgacggcctagtcgagtagttagttaacgtaactaacgttacgccgtaggaccagacaacgtaaccgtcggaccgacggtcctaccgacgtacctccgtactaccttcgtccggtggtacgtacctaccgtaccccggaaccggaccgggtacccttaacggttaccgggttaccccggaccccgggtaactaaacggttaccgtttaaccggagggtccggggtaacgggggtaacggggttccggttaacggggaaactaacggttaacttacccgtaaccttacctaaccgtaaaccctacgtacccgtaaacccgtaccggtacccgttacgggaaccgttacggtacccgtaagggtttaactttacggtttacggacttaacgtttaacttaaccgttacgttcgaaacgtaagttaaaccttaaacgtttacgtttaacggttaccgtacgttccgtttaacccgggtttcggggtaccggggggaaccggttaacgaacgggtccggtaagggaccttaaccggtaaccggtaccggtaacggttgggtccgtaccggtaccgtaactaccgttacgtttacgtccgtttacccttagtttacccgttcctaaccccgtacg

SEQ ID NO: 190116 - DNA, 777 bp, Homo sapiens
  misc_feature: GYAE6OF01CWK63.26.12.B01.1.454.CMB.1.raw
  modified_base (136)..(136): a, c, t, g, unknown or other
  misc_feature (136)..(136): n is a, c, g, or t
  modified_base (182)..(182): a, c, t, g, unknown or other
  misc_feature (182)..(182): n is a, c, g, or t
tcagagactatactcacgaccggtgctcgatttagtagtgtagattccgcggggggggagaggagccccagccctgagactcccaggtgcttccattcagtgatcagcactgaacacgagaggactcaccatgggngttgggactgaactggtacttttctttagacctaagtttaaaggtntcctagtgtggaaggtcagcgtggtggaggtcggtgggggagtacgttcgggtcagcgtaggctaacgtccctaagcctcgtcgtgtcgtcgtccttgtggtacttactaccgtttgactagtaatagtcgcgtagtcgacggtcgtgggtacccgtagacggaccgaccgggtacgggggaccgggtaccggttaggggacggttcgggtactacgggtagtacgtacgtaagtaataacggtggttaagtaattacgtactagtcgtacggtccgtaacgtttcgtaacgggacgggttaacgggcctttacgaacccgtacctaccgtaccgtaaccgtaacggaaacgaacccggtaacccgaaccggtaaacccggtacccttacccccggttaattaacgttaccgtaaagtaacggttaacgtaacgtacgttacgtaacgaactacggtacgggtaaccggtacgttaacgttttacgtttcgtttacgtacggttacgaaccgggtaacgggtaccgtaaaccgtacgttacgttaccgtttacaaagtacgtacggtacgtaccgtagttaacggtccggttacg

SEQ ID NO: 190117 - DNA, 731 bp, Homo sapiens
  misc_feature: GYAE6OF01A7MQB.26.12.B01.1.454.CMB.1.raw
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaatatgatgactcagtctccaggcaccctgtctgtgtctccgaggggaaagcgtccaccctctcctgcagggccagtcagagtgttagaacacttagcctggtaccagcagaacctggccaggctcccaggctcctcatctctggtcacatcccaccgagggccctacgtcggtaactccccgggactaggacttcgaggtggccgtagggggtcctggggacaacggtaacttcgaacctctacaccgataccctaacccgacggcccttaggacctacgttaccgttacggtaaggttagttttacgccgttaaggttacctttaacgtttaccgttcggttaccttaacggtacttaaaggttaaactttaactttaaccggttcggttaacctttaccgttcgggttttaccggggtacccgggggggtaaccttaacgggtccgttacgggacgtaccgtaccgtaaacccgggtaaccgtacgggttacggtaccgttacggacccgttaaccgtaacgtttaccgttacggtttacccgtttaccaaccgttttccccgttccccggttaaccccg

SEQ ID NO: 190118 - DNA, 153 bp, Homo sapiens; identical to SEQ ID NO: 190051
  misc_feature: GYAE6OF02INPHJ.26.12.B01.1.454.CMB.1.raw
  modified_base (153)..(153): a, c, t, g, unknown or other
  misc_feature (153)..(153): n is a, c, g, or t

SEQ ID NO: 190119 - DNA, 502 bp, Homo sapiens
  misc_feature: GYAE6OF02H48AW.26.12.B01.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (459)..(459): a, c, t, g, unknown or other
  misc_feature (459)..(459): n is a, c, g, or t
tcagagactatactcacgaccggtgctcgatttagtagtgtagatttccgtcgggggaggaactgctcagtcaggacccagacggaaccatggaagccccagccgcagcttctcttcctcctgctactctggcctcccagatattaccggaaaaatatgatgactcagtctccaggcaccctgtctgtntctccgaggggaanagtccaccctctcctggcgagggccagtcagagtgttagaacaacttgcctggtaccagacaagaacctggccaggctccagctcctcatcntgngcatccacgnggccactggactcccggcagtacttcgagtcggcgtaggggtctgggacagactttcactctcacatcacngctgcagtcngagtnttgtctatctatatntcagcaatataattctgtctcgtcgtcggcggggtacgagcgtagagtanacacgacgtgtgctagcctactatctctcttctactcctcctc

SEQ ID NO: 190120 - DNA, 491 bp, Homo sapiens
  misc_feature: GYAE6OF02F0GI6.26.12.B01.1.454.CMB.1.raw
  modified_base (201)..(201): a, c, t, g, unknown or other
  misc_feature (201)..(201): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagataccactggagaaatagtgatgacgcagtctccagccaccctgtctgtgtctccgaggggaaangtcaccatctcctgtcgggccgtcagagtattagcagcaacttagcctggcaccagcagaaacctgggcaggctcccaggctcctcatctttgatgcgtccaccagggccactggtttcccagccaggttcagtggcagtgcgtctgcgacagagtcactctcaccatcaacagcctgcagtctgaagtattttgctagtttattactgtcagcagtatcatgactgccgctcaccgttcggccagggacacggactggagaattaaacgactgtcggctgcaccattcg

SEQ ID NO: 190121 - DNA, 633 bp, Homo sapiens
  misc_feature: GYAE6OF02JWS4R.26.12.B01.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaataatgatgactcagtctccaggcaccctgtctgtgtctccgaggggaaanagtcaccctctcctgcagggccagtcagagtgttagtaacacttagcctggtaccagcagaactggccaggctccaggctctcatctctgtncactccacgacggccacgttcggtactcccggcagtacttcgaggtggccgaggggtctgggacaggtaacttcacgttcacaccatccaacctacggcctacgctagtctagtaagtatttcgacgtacttacgttatttacgtggttactaggtactaaacttaattaaactttacgttcggtaccttacgttccggttttaccggggccgggggtaactaacggtcggttaggtaggtaacgttacccgtaacgtaacgttcggtcggtactacgggtaaccttaccgtagttaccgttcggtttaccttaccgtaccgttcccgttacccggtaccc

SEQ ID NO: 190122 - DNA, 554 bp, Homo sapiens
  misc_feature: GYAE6OF02IYUC5.26.12.B01.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccagccaccctgtctgtgtctccagggggaaanagtcaccctctcctgcagggccagtcagagtgttagtcgcggcttagcctggtaccagcagacacctgggcagactcccaggctcctcatttangctgcatcccaccagggccactggtactcccagccaggttccaggtcggcaggtgggtctggggacaggagttcactctcaccatcagcacgcctgcagtctagaagtattgtgtactaattttattacttgtcagactaatataatacctcgcctccgcttctacgtttccgggacggtacgggtaccgtaaggttagaaggtactacgtaaaccggtaacttaggtacggtacgtacggacctaccgtatcttacgg

SEQ ID NO: 190123 - DNA, 514 bp, Homo sapiens
  misc_feature: GYAE6OF02HFTF3.26.12.B01.1.454.CMB.1.raw
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtactcccggccagattcagtggcgagggggtctggggacagaattcactctcaccatcaccagcctgcagtctgaagtattttgctagtctattactgtcagcaatataatactgcttctcgtttcgggcgggggacaggctggagtatacgacgactggtggctgcaccatctgttccttcacttccttcccgtcc

SEQ ID NO: 190124 - DNA, 500 bp, Homo sapiens
  misc_feature: GYAE6OF02HLYB5.26.12.B01.1.454.CMB.1.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctccaggggaaangtcaccctctcctgcagggccagtcagagtgttagtaacaacttagcctggtaccagcagaaacctggccaggctcccaggctcctcatctatgatgcatccaacngggccactggcatcccagccaggttcagtggcagtgagtctgggacagacttcactctcaccatcagcagcctagacgcctagaagtattttgactactttattactgtacagcagcgtagcaactggcctctctacgtttcggcggagggacgagggtggagatcgagtacgaacgtgtggctgcactatctcg

SEQ ID NO: 190125 - DNA, 218 bp, Homo sapiens
  misc_feature: GYAE6OF02FS7AX.26.12.B01.1.454.CMB.1.raw
  modified_base (216)..(218): a, c, t, g, unknown or other
  misc_feature (216)..(218): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccaggaactgtggctgcaccatctgtcttcatcttcccgccatctgaagtatagtctctgagcgggctggcaagggcgcatagnnn

SEQ ID NO: 190126 - DNA, 850 bp, Homo sapiens
  misc_feature: GYAE6OF02JE8QD.26.12.B01.1.454.CMB.1.raw
  modified_base (218)..(218): a, c, t, g, unknown or other
  misc_feature (218)..(218): n is a, c, g, or t
  modified_base (312)..(312): a, c, t, g, unknown or other
  misc_feature (312)..(312): n is a, c, g, or t
tcagagactatactcacgaccggtgctcgatttagtagtgtagattccgcgggggggaggagggagccccagccctgagactcccaggtgcttccatttcagtgatcagcactgaacacagaggactcaccatggagttgggactgaactggatttttccttttgacctaatttaaaaggtgtccagtgtgaaggcagctggtggagtcgtggggganacgttggtccagccgtggacaacggtccctaaagactcgttcctggtacgtcgtctttcgtggtacgttctacctttgtatagtaatacgtacnggcccatggtcgtaccttgggtcccgtcaagggcgtaccgaggggtagggggccttggggaacgttggggtacgttcaggggttaattcgaaggttttaccgaaagttaggttacgggttaaacttagttaaccgttcgttaacgttggtaccgggtaacttccggttaagggttcgtaaagggggtcccgtaaagttttaccgaacccgtaaagttccgttacccgaaaggtaaaccggtaacccgaaaacgggttacccctaaaccgggtaaaacccttaccccgttacgtttaaacgttaacccgttaacgggtaaaaacttcggggtaaaccgtaaaggtttacccgttaacggtaaccgaaaaccgtttacgggaaaccgggtttaaccttaaccggggtttaccctttttaagtttccgttaacggtttacgggaccgttaaaaacgggttcggtaaaccgttaacgttaacgttaacgttttaccgaacgttaacggtaccgttagggtaccgtaccgttagggtttaacc

SEQ ID NO: 190127 - DNA, 749 bp, Homo sapiens
  misc_feature: GYAE6OF02HER6H.26.12.B01.1.454.CMB.1.raw
tcagagactatactcacgaccggtgctcgatttagtagtgtagattccgcgggggaggaactgctcagtcaggacccagacggaaccatggaagccccagcgcagcttctcttcctcctgctactctgcctccagatacttaaccggaaaaatatgatgactcagtcctccgaggccaccctgtctgtgtctcgaaggggaaagcgtccacctctcctgcgacgggccagtcaggtagttagttaagtaaacctaacgttacgccgttagggtaaccagtaccgaacgaaaccgtcggaccgaacggccctacccgacggtccttccctctacttccttcgtggtcgccactaccgaccggacgggaccacgttcggtaccgtcccggacagtacttcgaggtcgggcggtacggggtcgtacgggacgtacgtacttacacctctaccacctactacgacgcacgtaccgtagacgtaccgtaagaacgtttagttttcgacctttaacttttaacttacgttcgttacgtacgtacgtacggtacgtaacgaccgtaaccggttcggtacccttacgttaccgtttaccggtttccgggggacggggtaaccggggtaaccgggtaacggggtacgggtaacgtacggtaccggaacggtaaccggtaacggttcgggtacgggtaccgtacggacccgtaaccgtaggttcccgttacggtttacctttaccgtaccgtttccccg

SEQ ID NO: 190128 - DNA, 652 bp, Homo sapiens
  misc_feature: GYAE6OF02HI0CM.26.12.B01.1.454.CMB.1.raw
tcagagactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtcgtgggggagacttggtccagcctggcaagtccctaagctctcctgtgtcgcttctggattcacctttgatgaatatgccatgcactgggtccgtcaggcaccgagggacggggcctgggaggtggggtctgaggtatcagttacaagtagtggtaatatactctatgcgtactctggtggaacgggccattccacctatcctaccgaagacgaaccaaaccgccaacggaacccttccctcttaactcctaagaaacttgggaactacgtcgtagaaccgtaacgtggaacggtaaccgtaaccggtttcctttttttaacgttcgttagggttacgtacggaaacggggtttaccgggaaacccggtacttaacgtttaacttttacccgaaccgtaacggttaccgtacgggtaccctaacgtttcggggttaccctttaaccgg

SEQ ID NO: 190129 - DNA, 114 bp, Homo sapiens
  misc_feature: GYAE6OF02IOP0U.26.12.B01.1.454.CMB.1.raw
  modified_base (114)..(114): a, c, t, g, unknown or other
  misc_feature (114)..(114): n is a, c, g, or t
tcagagactatactcacgaccggtgctcgatttagtagtgtagattccgcggggggaggaggagccccagccctgagactcccaggtgcttccattcagtgatcagcactgacn

SEQ ID NO: 190130 - DNA, 601 bp, Homo sapiens
  misc_feature: GYAE6OF02FPGLX.26.12.B01.1.454.CMB.1.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (584)..(584): a, c, t, g, unknown or other
  misc_feature (584)..(584): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggccaccctgtctgtgtctccgaggggaaangtccaccctctcctgcgagggccagtcaggagtgttaagtaacaacttagcctggtaccagcaagaaacctggccaggctcccaggcctcctcatctctggtncactcccaccgacgggcccacgtcggtactccccggcaagtactttcgaggtcggccgtagggggtctcgggggacaggtaacttcaacgtcctacacctatccaacccgacgtccctgcctacgtcgtaggtaaagtattttgacgtagtcttattacttgtcagtactaatattaattactggtcctacgttcgtttcggggaccgggggtactaagtcgtaggagtactaccgaacgtacgtggtacggcctgacctaccgtatccgttgtccttcncgttccctcccgtaccc

SEQ ID NO: 190131 - DNA, 903 bp, Homo sapiens
  misc_feature: GYAE6OF02FJAHG.26.12.B01.1.454.CMB.1.raw
  modified_base (210)..(210): a, c, t, g, unknown or other
  misc_feature (210)..(210): n is a, c, g, or t
  modified_base (454)..(454): a, c, t, g, unknown or other
  misc_feature (454)..(454): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggcctcccagatattaccggaaaaatatgaatgactcagtctccaggccaccctgtcctgtcgtcctaccgaaggggtaaacncgtccacccctctcctgccagggcccaggtccagtacgttcgttaacgtacctaacgtttacggcccgttacggggtaaccccaggtacccgaaaccgtaaaaccccgtcgggaccccgaaccgggtcccttcccccggaacgggtccccttcccctaccctaacggttccccttacttcggggttaccaccgtaaccttacccgaaccggtaacgggtcccctaacggttccgggttaacccncccccgggtaacctaacggtacgtttaccggaggttcggggaccggtacgggggttactaccgggggaacctaacggttaaacctttcccgaacccttccgtacccctaaccccgtaccgttacccccgaacccggtaaccgtccccgtacggtaacccgtaacggtttaccgtaacggtaaaccgtttacgttttaccggaccgtttacgttaccttacttaccgtacgttaccaacgttaacctaaacttacgttacctacccggttccgtacccgttaccgtaccgttaccgttaaccgggttaccgggaccgggaaaccgttaaccggtaaggttaccgaacgtaccgtaaccgtaaccggtaacgttacggaccgttaccgtaccgtaacccgtaccgttacttaccggttcccttacccgttaccgttcccgttaacccccgg

SEQ ID NO: 190132 - DNA, 531 bp, Homo sapiens
  misc_feature: GYAE6OF02FPVE0.26.12.B01.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaangtcaccctctcctgcagggccagtcagagtgttagtaacaacttagcctggtaccagcagaaacctggccaggctcccaggctcctcatctctggtgcatccaccaggcccatggtactcccggccagattcgagtggctagggggtctggggacagaattcactcncaccatcaccacgcctgctagtctagaagtattttgctagtctattactgtcagactaatataattactgtctcttcgtttcggggcgggggtaccaagcgtaggagactcgaaccgtacgtggtggctcgcacctatctcgtcttctattccgttcccgtacg

SEQ ID NO: 190133 - DNA, 681 bp, Homo sapiens
  misc_feature: GYAE6OF02IQU5W.26.12.B01.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaccggaaaaataatgatgactcagtctccaggcaccctgtctgtgtctccgaaggggaaanagtcaccctctcctgcagggccagtcagngtgttagtaacaacttagcctggtaccagcaagaaacctggccaggctcccgaggctcctcatctcgtggtacncactccacgacgggcccagtcggtactcccggcaagtacttacgaggtcggcggtacggggtcgtacggggacaagtaactttcacttcgtaccaccctactaccacccacgtacccgtgaccgtacgttacgtaaggtaaacgtttagttttacgacgttacgttactttacgttacgttgttacgtagtaactaaattaactttaagttaacgttggttaccttacgtttaccgggtttccgggggaccgggggtaaccgtaagtaccggtaggtaacgtaacgtacccgtaaccggtacgttcggtacggtaccgttcggacctaccgtacgttcgttacgttaccttaccgtacctttcccttacccgtaccg

SEQ ID NO: 190134 - DNA, 569 bp, Homo sapiens
  misc_feature: GYAE6OF02F22X2.26.12.B01.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaangtccaccctctcctgcagggccagtcagagtgttaagtaacaacttagcctggtaccagcagaacctggccaggctccaggctcctnatctcgtggtgcactccgaaccgagggcccacgttggtacctccccgggacaagtacttccgaggttcggactaggtgagtcgtggggacagtacttcacttctacacctatccgagcacgtcctagacgcgtagtaagtattttcgacttaactttattacgttgtctagcagcgtagctaactcggcctctctacgttcggcggtacggacgtagggtgagtacgtacgaagaccggtaacgtggtacggcgtacgccaccgtattccgtacgtcttccg

SEQ ID NO: 190135 - DNA, 564 bp, Homo sapiens
  misc_feature: GYAE6OF02IB617.26.12.B01.1.454.CMB.1.raw
  modified_base (199)..(199): a, c, t, g, unknown or other
  misc_feature (199)..(199): n is a, c, g, or t
  modified_base (423)..(423): a, c, t, g, unknown or other
  misc_feature (423)..(423): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
tcagagactatactcacgaccggtgctcgatttagtagtgtagattccgcgggggagaactgctcagtcaggacccagacggaaccatggaagccccagcgcagcttctcttcctcctgctactctggcctcccagatattaccggaaaaatatgatgactcagtctccaggcaccctgtctgtgtctccaggggaaanacgtccaccctctcctgcagggcagtcagagttgttaataacaacttgcctggtaccagcagtaaacctggaccaggtcctcccaggcctcctacacttcctctgggtctctactcccaccgaggcccacgtggtactccccggcagtcttcgagtcggacggaggggtctagggacagtatcgactctaccactatccacctagcctagctagtctagaagtntttgcgtattctagttactgtacagactaatatatcgtgtctcgttcgttcggggacgggtctaacgngtacggancgtacgaccgtattggcgccgtgaccgtactcgtagttccgttaccttgtacttcccgtcctacg

SEQ ID NO: 190136 - DNA, 633 bp, Homo sapiens
  misc_feature: GYAE6OF02ITVZW.26.12.B01.1.454.CMB.1.raw
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
tcagagactatactcacgaccggtgctcgatttagtagtgtagattccgcggggagctctgggagaggagccccagccctgagactcccaggtgcttccattcagtgatcagcactgaacacagaggactcaccatggagttgggactgaactggattttccttttgacctattttaaaaggtgtccagtgtgaagggcagctggtggaggtcgtggggggagacttggtccagcctggcaagtccctaagacctctcctgtgtcgcttctggattcacctttgatgaatatgccatgcactgggtccgtcgacggcaccgaggggcgggcctgggngtgggtctcgagggtatcagttacaataggtagtaatatactntatgcggtactctgtaggaacgggtcctaattccacctatccttaccagaacgaaccgaaccgccaaacgggtaaccttccccgtaatactaccgtaagtaaagtcggaacctagtacgtacgaactaaccgttggaacggtaaccgtaccgggttaccctttttatttccgttaggtacgttaaccggtaaaaggggttccggaaacccgtaactacgttaactttacgaaccgtaaggtccctagggtacc

SEQ ID NO: 190137 - DNA, 595 bp, Homo sapiens
  misc_feature: GYAE6OF02FSRYE.26.12.B01.1.454.CMB.1.raw
  modified_base (214)..(214): a, c, t, g, unknown or other
  misc_feature (214)..(214): n is a, c, g, or t
  modified_base (446)..(446): a, c, t, g, unknown or other
  misc_feature (446)..(446): n is a, c, g, or t
tcagagactatactcacgaccggtgctcgatttagtagtgtagattccgcggggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctggggganacttggtccagcctggcaagtccctaagactctcctgtgtcgcttctggattcacctttgatgaatatgcctatgcacgtcgggtccgtcgaggccaccgaggggacgggtcctgggagtgggtctcgaggtatcgagttacaagtgtaggtaatatactctagtcgcggactctagtgaagggcctatcaccatcctacgagacgacaacgctaacggacctccctattanctaacgaagtcggaacagtcgtacgaactaacgtgaacggtaccgtacggttacctttttagttacgtgttacgacgtaaagggtccggaaaccgtactaatttaacttcgaactaacggtctaggtacctacgttggtaaccttacgg

SEQ ID NO: 190138 - DNA, 494 bp, Homo sapiens
  misc_feature: GYAE6OF02IN24P.26.12.B01.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (444)..(444): a, c, t, g, unknown or other
  misc_feature (444)..(444): n is a, c, g, or t
  modified_base (491)..(491): a, c, t, g, unknown or other
  misc_feature (491)..(491): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctccaggggaaangtcaccctntcctgcagggccagtcagagtgttagtcgcggcttagcctggtaccagcagacacctgggcagactccccaggctcctcatttatgctgcatccaccagggccactggtactcccagccaggttcagtggcaggtgggtctgggacagagttcactctcaccatcagcacgcctgcagtctagaagtattgtgtactaatttattactgtcagacaatataatactgcctcgctcncgttcgcgaggacaggtgagatacgaacgacgtgtcgctgcactatntcg

SEQ ID NO: 190139 - DNA, 838 bp, Homo sapiens
  misc_feature: GYAE6OF02JQK8M.26.12.B01.1.454.CMB.1.raw
  modified_base (544)..(544): a, c, t, g, unknown or other
  misc_feature (544)..(544): n is a, c, g, or t
tcagagactatactcacgaccggtgctcgatttagtagtgtagattccgcggggagctctgggagaggagcccgacgccctgagactcccaggtgcttccattcagtgatcagcactgaacacagaggactcaccagtggaggttgggactggaacttgggtatttttccttttagacctaagtttttaaaaggtgtccagttgtaggaagggtcacggtcttgggtgggtagtcggtaggggggtacgtacgtttcggaccgtagtcccgtgggtaccaaacgggttccccgtaaaggtaccttccgttcccgttggttacggtccttccgtttcgttacgggttaactttccctaaccgtttttgacctttaaggtaatttcgtacgcctaagtttacggccttaacgggttcggggttaccccgtcggaacgggcctaaacccgggaggggggtccccgggtaacggttcggggtaggttaccgggtccgtaacgtgggtaacttcgaacgttaacgaagttacggtaagtaagttaactnttcgtagtccggcgtacgttgtagggtcggaacgggtaccttgtacctactacgttcctaacggacgtaacgaaccaaccggtagaacccgtttaacccgtccacgtttaatacgaaacggttacaggtaaccaggttttacgaaccgtaaccgaaaacgttcggaaaacggcccggtttaaccgtttacgtttttacgtttaacggcggttaaacgggtaacctaaggggttaacccggaaaccttattaacggttacctttacggaaacgttagtcccgggttaataccggg

SEQ ID NO: 190140 - DNA, 557 bp, Homo sapiens
  misc_feature: GYAE6OF02JCS2U.26.12.B01.1.454.CMB.1.raw
  modified_base (210)..(210): a, c, t, g, unknown or other
  misc_feature (210)..(210): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctntcctgcagggccagtcagagtgttagtaacaacttagcctggtaccagcagaaacctggccaggctcccaggctcctcatctctggtgcatcccaccagggccactggtactcccggcagtattccgagtggcgaggggtctggggacagaattcactctcaccataccaccagccctgctagtctagtaagtatttcgctagttacttattactgtcagactaatataactactagtctcgttcgtttcgggacgggggtacctaagtcgtaggacgtacgtacgacgtaacgtggtcggtactcggctaccgtattcgtcgttcttccgtattccctcccgtacc

SEQ ID NO: 190141 - DNA, 740 bp, Homo sapiens
  misc_feature: GYAE6OF02IMLBL.26.12.B01.1.454.CMB.1.raw
tcagagactatactcacgaccggtgctcgatttagtagtgtagattccgcgggggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtcgtgggggagacttggtccagcctggcaagtccctaagacctctcctgtgtcgcttctggattcacctttgatgaatatgccatgcactgggtcctcgaggccaccgaggggaggggcctgggaggtgggtctcgaggtatcagttacagtagtggtaatatactctagtcgcggtactcgtgaggaacggggccgtaatttccaaccctacttacccgtacccgaaaggacgtaaacccaaacccggacccgtaaacgggtaaaccccttcccccgttaagtttaaacgtacccgttaaaaggaaaacgttcggggtaaacctaacgggttacccttaagggaaaccgtaaaacccgttaggggaaaccggggttaacctacccggggttttaaccctttttttagttttcccgtggtttaacgaaccggttaaaaacggggttacggaaaacccgtaacgttaaacgttttacttttaccgaaaacgtaacggtcgttagggaaccctacggtttacgggttaaccttacgg

SEQ ID NO: 190142 - DNA, 633 bp, Homo sapiens
  misc_feature: GYAE6OF02HH2MB.26.12.B01.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
  modified_base (381)..(381): a, c, t, g, unknown or other
  misc_feature (381)..(381): n is a, c, g, or t
tcagagactatactcacgaccggtgctcgatttagtagtgtagattccgcgggggaggaactgctcagtcaggacccagacggaaccatcggaagccccagcgcagcttctcttctcctgctactctggctcccagatattaccggaaaataatgatgactcagtctccaggcaccctgtctgtgtctccgaggggaangtccaccctntcctgcaggccagtcagagtgtagtaacaattgcctggtaccagcagaaacctgccaggctccaggctctcatctcgtggtncactccgacgaggcctactggtaactccccggacagtattccgaggtcggtcgacggggtcctaggggactaggaactttccgacttccncgaacctatccgaacacgtccctagtacgtagttacgtacgtaagtacgttttcgactacgttcttaactttactcgtacgtagtactaacttattaacgttacgtacgtacttaccgttcgtttaccgggacgggggtaacctaacgtcgtacggtacgtacgtaccgtaacggtacgttacggtcggtaccgtcgtacccaccgttacgttcgttacggttccttacgtccgttccgttacccgtacccg

SEQ ID NO: 190143 - DNA, 627 bp, Homo sapiens
  misc_feature: GYAE6OF02I4KXE.26.12.B01.1.454.CMB.1.raw
  modified_base (345)..(345): a, c, t, g, unknown or other
  misc_feature (345)..(345): n is a, c, g, or t
  modified_base (427)..(427): a, c, t, g, unknown or other
  misc_feature (427)..(427): n is a, c, g, or t
tcagagactatactcacgaccggtgctcgatttagtagtgtagattccgcggggggggagaggagccccagccctgagactcccaggtgcttccattcagtgatcagcactgaacacagaggactcaccatggagttgggactgaactggtattttccttttgacctatttttaaaaggtgtccagtgtggaagggcagctggtggagtcgtgggggagacttggtccagcctggcaagtccctaagactctcctgtgtcgtcttctggacttcacctttgatgaatatgccatgcacgtgggtcctcgaggccaccgaggggcggggcctgggaggtcgggtcncgaggtatcagttacaagttagtagtaatatactactagtgcgtactcgtgtagaagggccgtattcgacctatcctacganacgacaaccgccgaacggtacctccctacgttataccttaagaaattcggacctacgtctagaactacgaggtaccggacgtaccggttccttttacgtttacgtcggtagtaaccgtaaggggttaccgaaaccggtaacttattaacgtttacgaacgtaacggtcgttacggaccacgtttaccgggtacttaccgg

SEQ ID NO: 190144 - DNA, 716 bp, Homo sapiens
  misc_feature: GYAE6OF02HDZG2.26.12.B01.1.454.CMB.1.raw
tcagagactatactcacgaccggtgctcgatttagtagtgtagattccgcgggggggagaggagccccagccctgagactcccaggtgcttccattcagtgatcagcactgaacacagaggactcaccatggagttgggactgaactggtattttccttttgacctattttaaaaggtgtccagtgtgaagggcagctggtggagtcgtgggggagacgttggtccagcctggcaacgtccctaagactctcctgtgtcgcttctggattcacctttgatgaatatgccatgcacgtcgggtcccgtcgacggccaaccggagggggacggggccgtggggaggtcggggttctacgagggttactacgtaaggtttaacaaagttaggttaggttaaataacttacttactaagtcggacggtacttcgtaggtaggaacgggcctattaccaacctatccgtaccaaggaacgaaccaacgaccgaacggtaacccttcccgattaactacctaaagaaacgtcggaacctagtacgtacgaaacctaacgtaggaacggtaccgtaaccgggttttacctttttaacgtttccgtaggttacgtaaccggtaaacgggttaccggaaaacccgtaattaacgtttaactttaaccgaaacgtaaccggttcggtaaccggtaccgttaacggtttacgggttaccctttacgg

SEQ ID NO: 190145 - DNA, 572 bp, Homo sapiens
  misc_feature: GYAE6OF02GZFW2.26.12.B01.1.454.CMB.1.raw
tcagagactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtcgtgggggagacttggtccagcctggcaagtccctaagactctcctgtgtcgcttctggattcacctttgatgaatagtgccatgcactgggtccgtcgaggcaccgaggggacggggcctagggaggtcgggtctcgagggtactcgtagttacaagttaggtaggtaatacttacttactagtgcggtacttcgtgtaggaaggggccgtattccaccatcctaccaggacgaacaaccgaccaacggaaccctccctactactactaagaatgacacgtcgagacctagtggacgacgtcgttaccttttattctgtgacgtaaggtcgaacatagttattacagagtcagactcgtagtctacg

SEQ ID NO: 190146 - DNA, 628 bp, Homo sapiens
  misc_feature: GYAE6OF02GO8PH.26.12.B01.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagagactatactcacgaccggtgctcgatttagtagtgtagattccgcgggggaggaactgctcagtcaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagttgttagtcgcggcttagcctggtaccagcagacaccgtgggcagacctcccgaggcctcctctatttangctgcatccgacacgggccacgtggtactcccagtccaggttcaggtggctagggtggtcgtggggaactaggacgttcactcctacgaaccctatcgacgcacgcctcgactacggttactaggtaaacgtagtttacggtagtaaccgtttaaattttactttaacgtggttaccgtaagtactaaacttaacttaaaccgtaccgtcggtacccctccgtaccttaccgtacgtttccgggacggtaacgggtaacccggtaagggttacggtaacgtaacgtaacgaaaccgtacgttaggtccggtcgacgtaccacctacg

SEQ ID NO: 190147 - DNA, 712 bp, Homo sapiens
  misc_feature: GYAE6OF02FWYPE.26.12.B01.1.454.CMB.1.raw
  modified_base (271)..(271): a, c, t, g, unknown or other
  misc_feature (271)..(271): n is a, c, g, or t
tcagagactatactcacgaccggtgctcgatttagtagtgtagattccgcggggagctctgggagaggagccccagccctgagactcccaggtgcttccattcagtgatcagcactgaacacagaggactcaccatggagttgggactgaactggattttccttttgacctattttaaaaggtgtccagtgtgaagggcagctggtggagtcgtgggggagacgttggtccagcctggcaagtccctaagctctcctgtcgtcgctttcgngtattccactttgattgaatattgccatcgcacgtcgggtcctcgaggccaccgtaggggcggggtcctgggacggtgggtctcgagggtactcgaagttaacaagtagttaggtaattactacttcgtatcggcggaacttcgttggtacgaacggggtccgtaatttacccgaactccgttactccgaaggactaaacgaacccgaccgtaaggtaacccttacccttaccgtaactacgttaaacgtaaaattacgggaaccgtacgttaccgtaagaacccgtaagttaggaaaccggaacgttaaccccgggtttacctttttttaacgttttaccggtaggtttcgggtaaaccggtaaaaggggtttaccgggaaacccgtaattaaacgttttaaccttaccgtaaacgtaaccggtacggttccggtaaccg

SEQ ID NO: 190148 - DNA, 670 bp, Homo sapiens
  misc_feature: GYAE6OF02JEZ7R.26.12.B01.1.454.CMB.1.raw
tcagagactatactcacgaccggtgctcgatttagtagtgtagattccgcgggggagctctgggagaggagccccagccctgagactcccaggtgcttccattcagtgatcagcactgaacacagaggactcaccatggagttgggactgaactggatttttccgtttgacctattttaaaaggtgtccagtgtgaagggcagctggtggagtcgtgggggagacttgggtccaggcctggcaacggtccctaagctcgtcctgtcgtcgcttctaggtattctaaccttttgacttggaaacttatcgccattcggacacgtcggggttcccgtcgaggccgaaccgaggggtacggggcctgggaggttcgggtactcggaggttactcgtaaggttaacaacgttaggttaggtaaatacttacgtacttagtcggacggtacttcgtggtacggaacgggtccgtacttcgaacctatcctacagacgtaccaacgccgaagaccttacccatactacgtacgaaagtggaactacgtactagaaccgtaactcggaacggaactaccgggtttcctttacgttacgtcggtaacggtaaccgaaacgggttccggaaaccgtaacgttacgttaactttaccgaaactacggttcgtaggtccgg

SEQ ID NO: 190149 - DNA, 696 bp, Homo sapiens
  misc_feature: GYAE6OF02JVX0N.26.12.B01.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctcaggcaccctgtctgtgtctcgagggaangtcaccctntcctgcaggccagtcaggagtgttaacgaacaacgttagccgtaggtaccagcaacgtaaccgtggccgaaggcctcccgaggtcctcctcacttctcgtggtcncgtactcccgaccgacgggcctaacgtggtaccgtccccggacaagtacgttccgaggtcgggccgagggggtcgtacggggacagtaatttcgaacttcgtccaacgtacttccgaacgtcgtccgtacgtcgtacgtccgtagtaacgttacgtttcgacgttacgttacttaacgttacgttacgtacgtacgtaactaaacgttaacttaacgttaaccgttcgtaccgttccgtttcgggttttaccggggaccgggggtaaccgtagttccgaaggtacgttaacgaccgttaacgtacgtaggtcggtaccgtcgtaccgtaaccgttaacgttcggttaccgtttaccgttaccgtaccgttcccgttacccgtaccg

SEQ ID NO: 190150 - DNA, 738 bp, Homo sapiens
  misc_feature: GYAE6OF02JMHBX.26.12.B01.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (437)..(437): a, c, t, g, unknown or other
  misc_feature (437)..(437): n is a, c, g, or t
  modified_base (545)..(545): a, c, t, g, unknown or other
  misc_feature (545)..(545): n is a, c, g, or t
tcagagactatactcacgaccggtgctcgatttagtagtgtagattccgcgggggaggaacgtgctcagtcaggacccagacggaaccatggaagccccagcgcagcttctcttcctcctgctactctggctcccagatattaaccggaaaaatatgatgactcagtctccaggcaccctgtctgtntctacgagggaaangtacaccctntcctgcgaggccagtcaggtgtgttaagaacacgttagccttaggtaccagtacgaagtaaaccgtcggaccgaggacccgttcccgacggccttacctacctacgttctaccttgggacgtcactaccccgacgtaacgggcctacctgggtaccctcccgggcccagtacttcgagtcgggcgtaggggtctagggaactagtacgtcactcgtacccactacncctacccgacgttcgcggactacggttcacggtaaagtttacgtttacgcgtaacgtttacctaagttttaacgttgtacctaagaccttaaagtaactttaaacgtnttaccggtactttaccgttcccggttttacggggaccggggttaacccaacgggttcggttagaaccggtaacgtttaacccgaacgttacccggtaggtaaccggttacgtaccggtaacccttaaccggtacgtttcccggttacctttacccggttaccgtttaacccgttccccgtttacccgtacccg

SEQ ID NO: 190151 - DNA, 649 bp, Homo sapiens
  misc_feature: GYAE6OF02JKCSC.26.12.B01.1.454.CMB.1.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (443)..(443): a, c, t, g, unknown or other
  misc_feature (443)..(443): n is a, c, g, or t
  modified_base (489)..(489): a, c, t, g, unknown or other
  misc_feature (489)..(489): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggcctcccgagtatattaaccggaaaaataatgatgactcagtctccaggcacctgtctgtcgtctccgaaggggaacncgtcacccctctccgtgcgacgggccagtcaggngttagttaacgtaacacgttacnccgtgtaccagccaagtaacgtcgccgacgcctccgaggtctcccgatactcgttcggtcggtcgactctaccgaccggtaacgggcccttaaggtccgggtaaccgtccccggacctagtacgtttaccgaggtcggaccggtaggggttcgacggaacagttaaccgttcaccgttanaccgtaaactacgctaaacgcgtacgtgactacgtcgtagtacgtnttacgcttacgttacttacgtctagacgtctagttacactgtacgcgtcggccttcgccttaccggtccgtacggacggtcgaccgagtacgtacgtaagttaaccgtaagcggtactccgttacgacctacgttactcgttactcgttcctacgtcccg

SEQ ID NO: 190152 - DNA, 677 bp, Homo sapiens
  misc_feature: GYAE6OF02FJWIW.26.12.B01.1.454.CMB.1.raw
  modified_base (292)..(292): a, c, t, g, unknown or other
  misc_feature (292)..(292): n is a, c, g, or t
  modified_base (463)..(463): a, c, t, g, unknown or other
  misc_feature (463)..(463): n is a, c, g, or t
tcagagactatactcacgaccggtgctcgatttagtagtgtagattccgcgggggggagaggagccccagccctgagactcccaggtgcttccattcagtgatcagcactgaacacagaggactcacccatggagttgggactgaactggattttccttttgaccattttaaaacggtgtccagtgtgaagggcagctggtggagtcgtgggggacacttgggtcccagcctggcaacgtccctaagacctctcctgtcgtcgcttctggactttcacctttgactgaactntcgccatcgacacgtcggtccgtcaggtccacgtagggacgggtccgtggacggttcggtctccgtaagggttatccgtaagtttaaccgaaagtggttagggtaactaagttaccttacgtaactcggaccggacttacgtggtacggaacgggcctaacttccaacctntacccttccaagtacgaaccaccggcccgtaaggaaccctcccgtacttaccgtacttaacggaacgtcgactacgttacgtacgaacctaagtacgaacgggtaaccttacggttaaccctttttcgttacgttacggtcgtaacgtaacggtccgaaaccggtatacgttacttaccgactaacgcgttcgaccgtacttaggtccttacgg

SEQ ID NO: 190153 - DNA, 771 bp, Homo sapiens
  misc_feature: GYAE6OF02I6CS5.26.12.B01.1.454.CMB.1.raw
  modified_base (197)..(197): a, c, t, g, unknown or other
  misc_feature (197)..(197): n is a, c, g, or t
  modified_base (721)..(721): a, c, t, g, unknown or other
  misc_feature (721)..(721): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatataccggaaaaatatgatgactcagtctccaggccacctgtctgtgtctcgaggggaaancgtccaccctctcctgcgaggccagtcagtagtgttaagtaacctaagttacgccgtacggtaccagtaccaacgtaaaccgtggaccaacgggccgtacccccgagggtcccttcccgtactacttccgtcgttacgggtcgaccgtaccttacccgaacccggacggggtacccctacggttccggtaccgtccccgggactaacggtacgttccgaacgggttggggccgggtaacggggggttcctaacggggggtaactaaacgggtaaaccttttcccgaaccggtttacctacccgaaaccggtacttaacccgaacccgtacgttcccgtaacgaccgttacgttaccgtaggtaaacgttagttttccgacgttcgttacttacgttacgtcgtacacgtacttaaataacgttacgttactagggtccttcggttaccgggtttaccgggggaccgggaactaccgtggtacggaactaaccgtaccggactacggttacggcgtaccgttacnccgtaacgtcgttcttaccggttaccttaccgtccttcccgttccctaag

SEQ ID NO: 190154 - DNA, 538 bp, Homo sapiens
  misc_feature: GYAE6OF02FHLMP.26.12.B01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggccaccctgtctgtgtctccgagggggaaangtccaccctntcctgcagggcccagtcagagtgttagtaacaacttagcctggtaccagcaagaacctggccaggctcccaggcctctcatctctggtgcatccacgaggccactggtactcccggcagattcgagtggcgaggggtctgggacagtaacttcactctacaccatcaccagccctagctagtctgaagtatttgctagttctatactgtcagtacaatataattactgtctcttcgttcggcggggaccagctaggagacgtacaaccgaacgtggtacggctacgtaccaccagtctcgttccttcacttccgttaccccgtacc

SEQ ID NO: 190155 - DNA, 842 bp, Homo sapiens
  misc_feature: GYAE6OF02FNH92.26.12.B01.1.454.CMB.1.raw
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
tcagagactatactcacgaccggtgctcgatttagtagtgtagattccgcggggggaggaactgctcagtcaggacccagccggaaccatgggaagccccagctcagcttctcttcctcctgctactctggctccagattccaccggagacatttgttttgacacagtctccagcccaccctgtctttgtctccaggggaaagngcccaccctctcctgcagggccngtcagagtgtggcagctactagcctagtaccaacacgaaacctggccaggtcctccgaggctcctcatctatgatcgcactccgaacgaggggccacgttcggaccacgtcccgacgccgtacggttacgtaggtcggacgaggtagggtacggttcggtggggaactacggtacgtttacgaccttccgtaccaaacccgtactaccgtaaccggaccctaacgggttaaccgttaaacgggtaaacccggtacccggttaaaggtaaacgggtttaaacgttttttaccggtaacccgttttaaccgttttttaaaccttttaaccggtttacgtttaaccggtaacgttaaccggtacggggtttaacccggttaaaccgggtaccgttaaacccggttacccgggtttacccgtttaacccgtttaccgttaaaccggtttaccccggggggtaaccgggttaaccggggtaacccgggttacggggggttaacgggtaaccgggtaaccggttaaccgggaaacggtaaccgggttaacggtttacgggtacgggttacccggttaaccggtaacccgttacccggttaaccttaccggtttaaccccgg

SEQ ID NO: 190156 - DNA, 698 bp, Homo sapiens
  misc_feature: GYAE6OF02HCG41.26.12.B01.1.454.CMB.1.raw
  modified_base (198)..(198): a, c, t, g, unknown or other
  misc_feature (198)..(198): n is a, c, g, or t
tcagagactatactcacgaccggtgctcgatttagtagtgtagattccgcgggggaggaactgctcagtcaggacccagacggaaccatggaagcccagcgcagcttctcttcctcctgctactctggctcccagatattaccggaaaatatgatgactcagtctcaggcacctgtctgtgtctccgaaggggaacgngtcaccctctcctgcgagggccagtcaggagttgttaagtaacaacttagcctaggtaccagacacgaaccgtggccgacggcctcccgacggtcctcctctactcgtcgtgtcgacgactacccgaccgacggccctacgtcgggtacctcccgggacaggtacttacgtaggtcgggcggtagggggtcgtaggggaacacgtaacttccgacctccgtacctacctacgtaccgaacccgtccgtaccgtgtaaccgtacgtcgtaacggttagtttacgtttcggtaacttacggttacttaacgttcgtacgtactagtaactaagttaagttaacttcggttacgtcgttaccgttccgggttacgggggtacgggtaccgtaaggtcgggtacgtaacgtccgtaacgtaacccggtacgtggtacggtaccgtacgtaccgttacggtaacgttcgttcgttaccgttacttaccgtttccccgtaccgtac

SEQ ID NO: 190157 - DNA, 671 bp, Homo sapiens
  misc_feature: GYAE6OF02JJKZ7.26.12.B01.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctgctccagatattaccggaaaaatatgatgactcagtctcaggccacctgtctgtgtctccgaagggaanagtccaccctctccngacgagggccagtcagagtgttagtaacaacttgcctaggtaccaggtcaagaacctggacctaggctccgaaggcctcctacatcctcgtggtgcctactccaccgtaggccaacgttcggtactccccgggactaggtacttagacggttgggccgtaagggggtctaggggaactagaactttcgaacttctacgctaactccacagtcccagctagtcgtagtaacgtgttacgctagtacttacgttactcgtagtaacgtacttaaagtacgttaactccgttacgtaccgttaccggttccggttttacccgggggacgggggttaacccaagttcggttaacggacgtacgttaacccgtaaccggtacgtacggttacggtaccgtcggtaacccgtaccgttaacgttcgttacggttaccttagtacccggtttcttccccggtaaccg

SEQ ID NO: 190158 - DNA, 1198 bp, Homo sapiens
  misc_feature: GYAE6OF02GKLQI.26.12.B01.1.454.CMB.1.raw
  modified_base (173)..(173): a, c, t, g, unknown or other
  misc_feature (173)..(173): n is a, c, g, or t
tcagagactatactcacgaccggtgctcgatttagtagtgtagattccgcggggggagaggagccccagccctgagactcccaggtgcttccattcagtcgatcagcactgaacacagagactcaccatggagttggactgaactggattttcctttgaccattttaaaaggntccagtcgtgaaggcagctggtggtagtcgtaggggatacgttggtaccagcccgtgggtacctaacggttccccgtaaacgtaaccttcccgttacccgttaaggttcggttaccgtaccgtttttcccggtagggttaacctttttacccgttaaaccccgttttttacggaatttacgggtaaaaactttacgttaccgaccccgttaagtttcgacccgtaaccggttacgggttaccccggttaggaaccgggaccccggtaaaccggtaaggggggtaaccggggcccgttaggggggttaaccggttcgggggttaacctaccgggtaaacgggtttacgttaaccggtaacgtttaaacgtaaacgttaaacgggtttaagggtaaaacttttaccgttaaaccggtttacgaacgggtttcccgggtaaccggttaccgtttacggacgggttttaacccggggaaaacggggggtttccccctaaaccggttttaacctaaaccccgggttaactttaccccccgttaaaccggttaaaccgggtaaaccccgggaaacccgtaaacccggggtaaccccgttaaaaccgggggtttaccccctttaaacccccccggttttaaagttaaaccccggtttaaccggtttaaaaacccgggtaaaacggttttaaccggggtaaccttaaaaaccgggtttccgttttaaacgggaaacccggttaaaaccggtttaacggggtaaaaccccgggtaacccgggtttaaccccggggtttttaaaccccttttttttaacgggttaacccgtttttaaaccggggacccgtttaaacccggggggtttaaaaacccgggtttaaaccccgggggtaaaacccgggtttaaaacccggttttaaccggttttaaaacccggtttaaccccgtaaaccgttaaaacccgggttacccggtacccgggtttaaccggtaaaccgggttttaaccccggtttaacggttttaaacccccc

SEQ ID NO: 190159 - DNA, 782 bp, Homo sapiens
  misc_feature: GYAE6OF02GHEKC.26.12.B01.1.454.CMB.1.raw
tcagagactatactcacgaccggtgctcgatttagtagtgtagattccgcggggagctctgggagaggagccccagccctgagactcccaggtgcttccattcagtgatcagcactgaacacagaggactcacctatggagttgggactggaactggtattttcttttgacctattttaaaggtgtccagtgtgaaggcagctggtggagtcgtgggggatacgttggtccagtccgtggacaacgtccctaagtacctctccgtgtcgtctcttctggtacttcgtaccgtttagacgttgtaattatcgacctagtcgtcacggttcgggtcctacgacggaccgacggaggggccgggtcgtagggtaggttcgggtcgtacgtaggtacgtagtaacgttaacaagttacggttaaggtaactaacgttacgttcgtaagtcgacggtcttgtacgtaggaacgggtcacgttaccgacctacgtaccctaacgaaggtacccgtaactaaccgaccgtaaaccggcccttaacccgttcttaacgtaacgttaaactaacggtaaccggtacttacgggttctaaacggtaaccttaaccgttagggaaacccttttaaccgggtacccgggtttttaacccgtttttttagttaccgggttaccggttaacgggtaaacccgggttaaaccgggtaacggtaaaccccgtttagttaacggttttaaccgtttaaccggaaaccggttacggttaacccggttagggtaaccccgg

SEQ ID NO: 190160 - DNA, 699 bp, Homo sapiens
  misc_feature: GYAE6OF02F2JQB.26.12.B01.1.454.CMB.1.raw
tcagagactatactcacgaccggtgctcgatttagtagtgtagattccgcgggggggggagaggagccccagccctgagactcccaggtgcttccattcagtgatcagcactgaacacagaggactcaccatggagttgggactgaactggattttccttttgacctaattttaaaaggtgtaccagtgtgaagggcagctgggtggagtcgtgggggagtacgttggtccaggcctgggaccaacgtccctaaagacctctccttgtgtcgtcttcgtggtacttcctaccttttgacttagaaatacgtcgacctatcgcgtaccgttcggggtccgtacgacggaccgaccggagggggacggggtccgtggggtagggtcgggtcctacgtaggtatacgtaagttaactaaagtacggtaggtaaactacttacgtatagtcggtacgtactcgtaggtaggtaacgggcctagttcacctagtcctacgaaggtacaaccgaaccgccgaaacgtaccctccttacgtactacgtaagaagtcgactacggtacaggtaaccacggtagaacgtaccgttcgtttacctttagtccgtagtacgacggtaaacgggtcgtaaaccgtacttagttaacgttaccgaaacggttcgaccggtaacggtcctaacggtttacggttacccgtacg

SEQ ID NO: 190161 - DNA, 684 bp, Homo sapiens
  misc_feature: GYAE6OF02FQIYM.26.12.B01.1.454.CMB.1.raw
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggcaccctgtctgtgtctcgaggggaaangtcaccctctcctgcagggccagtcagagtgttaagaacaacttagcctggtaccagcaagaaacctggaccaggcctccccgaggcctccctcacttctcgtggtcncactcccaccgcggccagtcggtactccccggactagtacttcgaggtcgggacggtaggggtcgtaggggaactagtaacgtttcaccttctacacctatcccaaactcgtccgtgaccgtagtcgtaaggtaacgtttcgttttacgacgttaacgttaccttaacgttacgttacggtactaagttaaccttaaattaaattaaactttaccggtcggtaccgtttcgtttaccgggtttaccggggggacccgggggtaacctaacgggtcggtaggtaacgtaacgtaaccgtaacgtacgttcggtcggtacgttaccgacctaaccgtgttccgttcgttaccttccgtacctttccccgtacccgtacg

SEQ ID NO: 190162 - DNA, 696 bp, Homo sapiens
  misc_feature: GYAE6OF02I216H.26.12.B01.1.454.CMB.1.raw
  modified_base (210)..(210): a, c, t, g, unknown or other
  misc_feature (210)..(210): n is a, c, g, or t
  modified_base (476)..(476): a, c, t, g, unknown or other
  misc_feature (476)..(476): n is a, c, g, or t
  modified_base (682)..(687): a, c, t, g, unknown or other
  misc_feature (682)..(687): n is a, c, g, or t
  modified_base (689)..(690): a, c, t, g, unknown or other
  misc_feature (689)..(690): n is a, c, g, or t
  modified_base (692)..(696): a, c, t, g, unknown or other
  misc_feature (692)..(696): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctccagatattaaccggaaaatatgatgactcagtctccaggcaccctgtctgtgtctccgaggggaacagtcacctctcngcaggccagtcagagttgttaagtaacacttagccttggtaaccagacaacgaaaccgttcggaccgacggcccttaccccgaggtccttaccctcgattcctccgttaggtcacctactccccgtaaccgacgggtacccacggttaccggtaccgtaccccggtactaacggtacgttacgaacgggttcgggaccgggtaacggggttcctagggggaaacttacgtaacgttttccacgttcctacctaaccgcttaacccnccgtaacgtcccgtacgtacgtacgttacgtacgtaacggttacgtttacgtacgtacgttacttaacgttacgttcgttacgtaagtacgttaaattaacttaacgttacgttacgttccgttacgtttaccggttacgggtaccgggtaccgtaacggtacggttaacggtacgtaccgtacgtaaccggtacgtacgggtacnnnnnncnngnnnnn

SEQ ID NO: 190163 - DNA, 692 bp, Homo sapiens
  misc_feature: GYAE6OF02GBSLG.26.12.B01.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatatgatgactcagtctccaggccaccctgtctgtgtctccgaggggaaagngtccaccctctcctgcagggccagtcagtagttagttaagtaactaacttaggcctacggtaccagtcaagaacctggcaggcctccgaggcctcnactctcgtaggtcgccactcccgacgacggcctacgttcggtaccgcccggtaccagtacttcgaggtcggcggtaggggtcgaggggacaggtaacgttcacgttcctacacctataccacccgacgccgtgtactagtacgtacgtaagtttcgtttagacttacgttacttaacgttacgtgtacttaacgacttaaagttaactttacgttacggttcgttccgtttacggttcccgggtttacgggggaccggggtacctaaacggtcggtaacgggtactaccgtaaccgtacccggttagtcgggtcggtaccttaacggtaccctaccgttacgttaccggttccgtttacccgtttaccgacccgtttccccgtacccgttaacg

SEQ ID NO: 190164 - DNA, 769 bp, Homo sapiens
  misc_feature: GYAE6OF02FXSV4.26.12.B01.1.454.CMB.1.raw
  modified_base (226)..(226): a, c, t, g, unknown or other
  misc_feature (226)..(226): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaatatcgatgactcagtctacagcctacctgtctgtgtctaccgagggaactagtccaccgtctcgtgacgacggacngtacaggtaactgttaacgtaactaacttacggacgtacgtaaccgagacgtaacgtaaaccgtggaccgaacgccgttacccgtacggtcctacccttacgtacgttccgttcgtgggtcgacctaccgttaccgaaccgaccgggtaccttacggttacgggtaccctaacccccgggagttaacggttacgtacggtaacggtcggggaccgggtacggggtcggttaacggaaaccgtacggttaaccttacggtacctaccgtaacgtaaccaacttccccaacgggtaccctacgtgaccgtaagtacctaagggtaactttgttacgtactacgttcttaacgttcgtacttagacttaataaacgttaattaacgttctacggttctaacgttcgggtacggggaccgggtactaggccgttaggaccgtaactaaccggtacgtaacggtcgtcgtaccgtacggtaacccgtaaccttggttacccgttacctattttaccccgggacccttttacccgtacccgttaacccg

SEQ ID NO: 190165 - DNA, 956 bp, Homo sapiens
  misc_feature: GYAE6OF02FKIOO.26.12.B01.1.454.CMB.1.raw
  modified_base (203)..(203): a, c, t, g, unknown or other
  misc_feature (203)..(203): n is a, c, g, or t
tcagagactatactcacgaccggtgctcgatttagtagtgtagattccgcgggggaggaactgctcagtcaggacccagacggaaccatggaagccccagcgcagcttctcttcctcctgctactctggctcccagatattaccggaaaaatactgatgactcagtctcccaggccaccctgtctgtgtctacgaggggaacngtccaccctctcctgcgacgggcccagtcaggtgttgttaacgactaacttagtcctacgggtaccagcgaaacgaaaccgtcggacctacggcctaccccgaggccttacccgtctaacttccgtcttcgggtactccgaactacccgaaccgtacgggtacccacgttcggttaacccgccccggtacgtaagttaccttacggacggttcggggaccggtaacggggggttcctacgggggtaactaacggtttaacgtttcccgaaacccgtttccgttaaccgaaaccccgtaccgttaccccgaaacccgttaccgcccgttacggaccctcgggttaacctacggtttaaactttacgttttaccggaaccgtaccggtttacttaaccggtttaccttacgggacctaacggttaacctttaaaaccgttaacgttttaaacccgttaccggtttaccgggtttaacccgttttacccgggtttttaacccggggttttaccccggggggggtaaaccgggggttaaacccgtttaaaccggggtacccgtttaaaccgggtaaacgggttaaaccccgttaaccggttaaacccccgggttaaccgttaccgggggtttaaacccggtccgttaaccccggggttaaccctaaaccccgggttttaacttaccccggtttaccggtttaaccccgttttaccgggtttaacccccgttacccccggtttaccccgttaaccccg

SEQ ID NO: 190166 - DNA, 921 bp, Homo sapiens
  misc_feature: GYAE6OF02IGIKV.26.12.B01.1.454.CMB.1.raw
  modified_base (189)..(189): a, c, t, g, unknown or other
  misc_feature (189)..(189): n is a, c, g, or t
tcagagactatactcacgaccggtgctcgatttagtagtgtagattccgcgggggagctctgggagaggagccccagccctgagacctcccaggtgcttccattcagtgatcagcactgaacacagaggactcaccatggagttgggactgaactggtattttcctttagacctaatttttaaaaggtntacctagtggtgaagggcaggcgtagggtggaggttcgtacggggggtagtacgtttgggcccaggtccgtaggactaaacgttacccctaaacggaccttaccttccgtcggtcgttccggttacctttcggtacggttactttccgttaccgttttagacgttaagtaaattacgtaccgtacctagttaccggaccttaaccgggttcggggtaccccgttacggaaccgggacccggtaaccggacgggggggtaaccgggggtccgttaacgggggtcgggttacggggttccgtaccggttacggggttaactacggttaacggtttaaaagaacggtttaaggttaacgttaaagtttactaaccgtttacgtaacgttcccgggtaacggtaccttacggtaacgggttaacggggaaaccgggttccctttaaaacgtccccgtaaacctacgttaccgtacccggaaaggtacccgaaaccccgtaacgtacccggtaaacgttaacccctcctttaacgtaagtttaacgaaacgttaacggttccggaaacttaccgtacggtaaaccaacgttaaaccggttaggaaaccggtaccggttaccgttttaacctttttgttccgggtttacaacgggttaaaccggtaaacggtacccgggttaaccaattaccggttttaacttaacccgggataaaccggggttcctaaagggttacc

SEQ ID NO: 190167 - DNA, 897 bp, Homo sapiens
  misc_feature: GYAE6OF02GA62J.26.12.B01.1.454.CMB.1.raw
  modified_base (179)..(179): a, c, t, g, unknown or other
  misc_feature (179)..(179): n is a, c, g, or t
tcagagactatactcacgaccggtgctcgatttagtagtgtagattccgcggggggggagaggagccccagccctgagactccaggtgcttccattcatgatcagcactgaacacagaggactcaccatggagttgggactagaactggatttttccttttgacctattttaaaaggtntcagtgtaggagggcaggctgggtggagttgtagggggggactacgtttgggtacccaggtccgtacgggactaaacgttccctaaagcccttcgtccgttggttcggtccgtacgtttcgtcgggtatttccttaaccgttttggattacggtaacttagtacggtcccctagtacgccgtaaccggtgggggttccctacggaaggcccctacggaacggggggcggggtacctggggtacgggtcgggttctacggtaaggttactcctaaggttaacaacggttaggttaggtaataactaccggttattactggtaccggaccttgtaaggggtaggtaacgggtcccttaatccctaactacgtccctacgaacgtactacccggaaacccacggtaaccggtaaccccttaccttacgtttaaacgagttaaagtaaacccgtagggtacttaaccgggactttaccgggaacctaacggggttaaccgaacggttaaccggtttacccgtttttacggttttttaaaccctttggtaacgggtttcgggaacccgggtaaaacgggggtttttaccgggaaaaccggggtttaaactttaaccgggtttaaacggttttaaccccgaaaacccgtttaagggtttcccgggttaacccggggttaacgttaccggggtttaaaccccggggtttccttttaaacccgggg

SEQ ID NO: 190168 - DNA, 807 bp, Homo sapiens
  misc_feature: GYAE6OF02H0LL6.26.12.B01.1.454.CMB.1.raw
  modified_base (201)..(201): a, c, t, g, unknown or other
  misc_feature (201)..(201): n is a, c, g, or t
tcagagactatactcacgaccggtgctcgatttagtagtgtagattccgcgggggaggaactgctcagtcaggacccagacggaacatggaagccccagcgcagcttctcttcctctgctactctggcctccagtatattaaccggaaaaatatgatgactcagtcctcgaggcctacctgtctgtcgtctcgaagggaancgtccaccctctcctgcgacgggccaggtcagtagttgttaagtaactaacgttagcctacgggtaccagaccgaacgtaaaccgtggaccgtacggcctccgacggccttacctctacgttcttcgttggtcgtcctacctaccgaccgcggtcctaacgttcggtaccgtcccggaacacggttacgttcgtcgggtacggtaccggggtacgggttcggaacgggtaccaaaggttaaccgttcccgaaccttccgtaccgaacccgttacaaccctaccggtcgaccgtcggaccgttacggtacgttacggttaacgtttacgttacggacgtttaaccgttacttacgtttaacggcgttaacccgtaataacctttaaagttacgttaaacgtttcccggtaggtttcccctttacggggttaccggtttacccgggggggtaaccggggaaacctcggggttaacgggaaccgttaacggtaaccgtaaaccggtaccgttaccgggtttaggaaccgttcggttaccgtaacggtaccttaccggtttccttaggttccctttaacccggtttactttcccccgggtaccttaccgg

SEQ ID NO: 190169 - DNA, 740 bp, Homo sapiens
  misc_feature: GYAE6OF01B7HA0.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggaggcctcgtccagccgtgggggtccagtgagactctcctgtgtagcctctgtaactttcccctttacggtctttagttggatggagtcgtcggggtccgccgaggcctccggaagggggaaggggcgtgggaggtggggtacggaccaaacgaagtaaaacggacgaaagagtagggaaaggtagggaagggtagttagtggtaggtaatcgtaggtaggaacgggtccgtttacaccgtatcctaccgaagacgaaccgaaccgtaccgaaacgtaaccgtcccggtagacctaacttaccgtagaacaaagtacgaaaccgtagtaccgtaggaacggacggacccggaacgggaaccgtaccgggtactttaacgttttaacgttaaccgtggaccggtacggaaggaacgggtaaacgggtcggttacgggggtaccgggttttccggaacgttacgggtccgggggaacccgtaaccgggggtaaaccccttcgggtaccctaccccggttcgtccccgtcggtaaccccg

SEQ ID NO: 190170 - DNA, 713 bp, Homo sapiens
  misc_feature: GYAE6OF01CDV99.36.10.A10.1.454.CMB.1.raw
  modified_base (299)..(299): a, c, t, g, unknown or other
  misc_feature (299)..(299): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccatgagactctcctgtgtagcctctgtaacttcccctttacggctttattggatgagtcgtcggggtcccncgacggcctccggaggggaagggggctgggaggtggggtcggaccaaacgaagtaaagcaaaggatagggaaggtagggagggagtagtggtaggaatcgtggtaggaacgggtcccgtttacgacctatcctaccgaagacgaaccaacgacccaaagtaccttccggtagacctaatccgtagaactaaagtcgaaactggtactaggaacgtacggaccggaaggaaccctacgggtactttaagttttaacgtacgcggacggtacgaaggtacggtaaacggtccggttagggggtaccggttttaccggaacggtttaaccggggtccgggggtaacccgtaaaccggggtaacccccgttcgggttaaccccgtaccccggttacccttcccgtaccgtaaccccgg

SEQ ID NO: 190171 - DNA, 599 bp, Homo sapiens
  misc_feature: GYAE6OF01B2VTV.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttcctgttgctattttggaaggtgtccagtgtgaggtgcaattggtggagtcgtgggggaggcctcgtccagccgtgggggtccctgagactctcctgtgtagcctctgaacttccccttacggcttattggatgagctgggtccgccaggctccgagggaggggctggagtgggtggccaacataaagcaagatgggaagtagggagggagtatggtaggaatcgtaggtaggaacgggtccgttttaccaccgtattcctaccgaaggacgaaccaaccgacccaaagaacctccgtgacatctgacaaatgaacagtctagagacgccggaaggacgacggtacttagttttatacgtgccggacgagagaggacgtggggacgtttaccgacgttacggtggggacccaggggaaccccttgggtacccaccggttactccctcgcgtcccc

SEQ ID NO: 190172 - DNA, 717 bp, Homo sapiens
  misc_feature: GYAE6OF01B0KFA.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccatgagactctcctgtgtagcctctgaacttcccctttaggcttattggatgagctggtccgccaggctccgagggaggggctgggagtgggtggaccaacagtaaagcaaagagtaggaagtagggagggagtagtggtaggaatcgtggtaggaaggggtccctttcgacctatccgtacccgaggaacgaaccaaaccggcccaaaaggaacccttcccggtagacctaattccgacggacctaaaagttcgaaaccgtagttccgtagggaacgggacccgaacgggaacgtaccggtaccgtttaacttttaagttaccgtaggtccggacggaaggtaacgggaaacggggtaccggttacggggttccggggttttaccgtaccgggttaaccggttacggggggtacccggaaaccggggttaaccccggtacggttccggtaccccgttacccgttccccgtccgtacccgtacccccgg

SEQ ID NO: 190173 - DNA, 625 bp, Homo sapiens
  misc_feature: GYAE6OF01B422P.36.10.A10.1.454.CMB.1.raw
  modified_base (446)..(446): a, c, t, g, unknown or other
  misc_feature (446)..(446): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccatgagactctcctgtgtagcctctgacttcccctttacggcttattggatgagctgggtccgccaggctccgaggggaaggggctggagtgggtggccaacataaagcaagagtaggaagtagggagggagtatgtaggaatcgtgtggaagggtccgtttcaccatctcagagacaacgccaagactccgtgcatctgacaatcgaacagtctagagngaccggaggaccacgggtcttaagttttacttacgtgaccggtacgaaggtaaggaacgggtacgttcgggggtaccggttttccgaaccggtttaaccgggtccggggggaccctaacgggggtaacccccgttggggttaccccaaccccgggtttccttccccggtcgtaccccgg

SEQ ID NO: 190174 - DNA, 774 bp, Homo sapiens
  misc_feature: GYAE6OF01DMR96.36.10.A10.1.454.CMB.1.raw
tcagtacgctgtctcacgaccggtgctcgatttagcgtcgatctcaggggaggtctcagagaggagccttagccctggactccaaggcctttccacttggtgatcagcactgagcacagaggactcaccatggaattggggctgagctgggtttccttgttgctattttggaaggtgtcagtgtgaggtgcaattggtggagtcgtgggggaggcctcgtccagccgtggggggtccctgagactctcctgtgtagcctctgaactttccccttacggcttattggatgagctgggtccgccgaggcctaccgaggggaaggggcgtgggacggtggggtggacccaaacagtaaaagcaagatagggaaagtagggaggggagtagtggtaggaaatcgtaggtaggtaacggggtccgttttacgacctagttcctacccgaaggaacggtaaaccaaaccggaccctaaaacggaacccgttacccggtagaccctaagttccttaggaacctaaaaagttccggaaaaccgtaggtttacccgttaggaaacgggtaccggtacccgggaaaggggtacccgtaaccggggttacttttaaacgtttttaactttaaccggttcggaccgggtaccggtaaagggaacgggtaaaacggggtaaccgggttcgggggggttacccgggtttttaccggaaaccggttaccgggttccggggggaaccccgtaaggggggtaaacccccttggggttccctaacccccggg

SEQ ID NO: 190175 - DNA, 772 bp, Homo sapiens
  misc_feature: GYAE6OF01EZ1G6.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagcctggggggtccatgagactctcctgtgtagcctctgtaacttcccctttacggctttattggatgagcgtgggtccgccaggctccgagggaggggcgtggaggtgggtggaccaacaagtaaagcaagagtaggaagtagggagggagtagtggtaggaatcgtaggtaggaacggggtcccgtttacacctatcctaccgaaggacgaacgaaccgacccaaacgaacctccggtgactaactctagaaccaaattcggaaaacgtacgttacgtaggaacggtaacggacccgggtaagggaacccgtaaccgggttacccttttaaagtttttaaccgttaccggtacggtacccggtacgggtaaacggtaacggggtaaacggggttaccgggttcggggggttacccgggttttttaaccggaacccggtttaaaccggggtcccgggggggtaacccccgtaaaaccgggggggtaaccccccgtttagggggttaccccccttaaccccggggttcccctttacccccggtaccgtaacccccggg

SEQ ID NO: 190176 - DNA, 611 bp, Homo sapiens
  misc_feature: GYAE6OF01BFM93.36.10.A10.1.454.CMB.1.raw
  modified_base (506)..(506): a, c, t, g, unknown or other
  misc_feature (506)..(506): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggaggcctcgtccgagccgtgggggtccagtgagactctcctgtgtagcctctgtaacttcccctttaggctttattggatgagctgggtccgcaggctccgagggaggggctgggagtgggtcgccaacataaagcaagagtaggaagtagggagggagtagtggtaggaatgtagtaggaagggtccgtttacacctatccgtacgaagacggaaccaaccggaccaaacggaacctcccgtagaccaagtctagacaaagtgaaactagtacctaggacggacgccggaagaccgacggtnttaattttatactggcgacgaggagaaggacgtgggtcggttacgacgtacggtcggggaccctaacggggacccgtggtacctacccggtctcccgtcgacccg

SEQ ID NO: 190177 - DNA, 753 bp, Homo sapiens
  misc_feature: GYAE6OF01EI44V.36.10.A10.1.454.CMB.1.raw
  modified_base (189)..(189): a, c, t, g, unknown or other
  misc_feature (189)..(189): n is a, c, g, or t
tcagtacgctgtctcacgaccggtgctcgatttagcgtcgatctcaggggtccctgagactctcctgtgtagcctctgaattcccctttacggcttattggatgagctgggtccgccaggctccagggaaggggctggagtgggtgccaacattaaggaagatggaagtgagacatactatgtggactntgtgaaggcattcacatctcagagacaacgccaagactcactgtatctgacaaaatgaacagcctagaggaggacgaggaccgacggctggtgttattacgtggtcggcggacggggacctaaacgttagttagtttgggtttggacggttaactttaattaacgtaaacgtacggtaaggttcgggggaccgtaacggggtaacccttcgggtacctaacccgtccttacccgtacgaccgtaccctacccaacccgaacggggcccctaagttcccgggttcccttccccccggtcgggtcccgccccgttcgccccgttacccgaacgggtacgcccgtaacccgtacccggaaggaccgccgaaccgaaccggcccgggtccccggtacggggtccttccgggtcccgttacgggtaaccgtaaacgggtaaccctttaccgttacccgaacggtacccgaacggtcccggttaaaccgttcgggaacggggtcccggggtaccgtaacggggaccggaaaccgggtcccggaaccgtaaaggttacggactgagtcgag

SEQ ID NO: 190178 - DNA, 529 bp, Homo sapiens
  misc_feature: GYAE6OF01BYVCP.36.10.A10.1.454.CMB.1.raw
  modified_base (220)..(220): a, c, t, g, unknown or other
  misc_feature (220)..(220): n is a, c, g, or t
  modified_base (297)..(297): a, c, t, g, unknown or other
  misc_feature (297)..(297): n is a, c, g, or t
  modified_base (417)..(417): a, c, t, g, unknown or other
  misc_feature (417)..(417): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
  modified_base (512)..(512): a, c, t, g, unknown or other
  misc_feature (512)..(512): n is a, c, g, or t
  modified_base (517)..(529): a, c, t, g, unknown or other
  misc_feature (517)..(529): n is a, c, g, or t
tcagtacgctgtctcacgaccggtgctcgatttagcgtcgatctcaggggtccctgagactctcctgtgtagcctctgaattcccctttacggcttattggatgagctgggtccgccaggctccgagggaaggggctgggagtgggtggccaaacataaaagcaagatgggaagtaggagggagtatgtggaatctggtgaagggtccgtttcaccatcnccagagacaacgccaaagaactccgtgcatctgacaaatgaacagtctgagagccgaggacacggctattatactgngcgagagaaggctgggcgtttcgactacgtgggaccagggaaccctggtccaccgtctctcacgcctccaccgaaggcccagtccggtccttccccctggccgccctgcctccgaggacncacctcgagacgcacgacggccggcccgtgggctgccgtggcaacgggactaccgtccaagacngaccgtacnggagcgggtcnggcgaaggccnagtgnnnnnnnnnnnnn

SEQ ID NO: 190179 - DNA, 627 bp, Homo sapiens
  misc_feature: GYAE6OF01A4X0O.36.10.A10.1.454.CMB.1.raw
  modified_base (512)..(512): a, c, t, g, unknown or other
  misc_feature (512)..(512): n is a, c, g, or t
  modified_base (614)..(614): a, c, t, g, unknown or other
  misc_feature (614)..(614): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtacgcctctgtaacttcccctttacggcttagttggatgagcgtgggtccgccgaggctccgaggggaagggcgtgggaggtgggtgaccaacaagtaaagcaagagtagggaagtagggagggagtagtggtaggaatcgtggtaggaacgggtccgtttacacctatcctccgaagacgacaacgaccaagtaacctccgtagctatctgacaaagtgaactgtctagagacgaccgaggacacggtacttaagtttacttacgngtcgacgaggaacggaaggtaccgtggggtaccggtttacgaccgttaccgggtcggggacccgacggggtaaccctcgggtacccacccgttccgtacccngacccgtaccccg

SEQ ID NO: 190180 - DNA, 603 bp, Homo sapiens
  misc_feature: GYAE6OF01EZSIK.36.10.A10.1.454.CMB.1.raw
  modified_base (102)..(102): a, c, t, g, unknown or other
  misc_feature (102)..(102): n is a, c, g, or t
  modified_base (302)..(302): a, c, t, g, unknown or other
  misc_feature (302)..(302): n is a, c, g, or t
  modified_base (441)..(441): a, c, t, g, unknown or other
  misc_feature (441)..(441): n is a, c, g, or t
tcagtacgctgtctcacgaccggtgctcgatttagcgtcgatctcagggggaggagccttagccctggactccaaggcctttccacttggtgatcagcactnagggggggggcacagaggactcaccatggaattggggctgagcttgggttttccttgttgctattttggaaggtgtccagtgtgaggtgcaattggtggagtcgtgggggaggcctcgtccagccgtgggggtccctgagactctcctgtgtagcctctgtaactttcccctttacggcttattggatgagctgggtccncaggctccgagggaggggctgggagtggggtggaccaacgataaagcaaagagtagggaagtagggagggagtagtgtaggaatcgtggtgaagggtccttcacctatctcagagacaacgccaagaactcgagcatcngacaaatgaacagtcagagagaccgaggacacggcttattactactggacgacgagaaggaacggtacgttggggtaccggttttacgacgttaggtcgggggacccgaacggggtaaccccttcgggtacccacccggttactcccgtaccgacgtccccc

SEQ ID NO: 190181 - DNA, 687 bp, Homo sapiens
  misc_feature: GYAE6OF01BABJ3.36.10.A10.1.454.CMB.1.raw
  modified_base (160)..(160): a, c, t, g, unknown or other
  misc_feature (160)..(160): n is a, c, g, or t
  modified_base (168)..(168): a, c, t, g, unknown or other
  misc_feature (168)..(168): n is a, c, g, or t
  modified_base (171)..(172): a, c, t, g, unknown or other
  misc_feature (171)..(172): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagcgtggtttcgtgtagctattgagntcatgtgngtnnatgtgngtngggngcngtcagccgtggggtcagtgagactctcctgtgtagcctctgtaactttccccttacggtcttaagttggatggacgcgttcgggtcccgccgaggcctccggaaggggaagggcgtggaggtgggtcgaccgaaacgagtaaagacgtaagagtaggaagtaggaggtagtagtgtaggaatcgtaggtagaacgggtccgtttacacgtacgttcaccgtagacgaacgaaccgtaccgaaagtacctccgtagtcaacgttcgacggtaaaccaaagttcgaacgtacgttaccgttggaagttcccggaaaccggaacggtacccgttaaccgggtactttaaggttttaacttaccggaggaccgttaaccggaggtaacgggaaaccggttaggtaaccggggtttccgtttaccggagttaacccggtcggggaaccgtaacccgggttaccgtccggtaccctaacccggttccttcccgtacccgtacccg

SEQ ID NO: 190182 - DNA, 741 bp, Homo sapiens
  misc_feature: GYAE6OF01C0PJ4.36.10.A10.1.454.CMB.1.raw
tcagtacgctgtctcacgaccggtgctcgatttagcgtcgatctcgagggggaggagccttagccctggactccaaggcctttccacttggtgatcagcactgagcacagaggactcaccatggaattggggctgagcgttgggttttcctgttgctagtttggaaggtgtccagtgtgaggtgactaagttggtggagtcgtgggggacgcctcgtccgagccggtgggggtccctgacgtactctccgtgtgtacgccttacgtgtaacctttcccccgttaggtctttagttaggagtcgacgtcgtcgggtccaccgaggtcctaccggaggggtacgggctagggaggttgggcgacaacaagtaagacgtaagagtagggaaggtagggaggtagtacgtggacggtaatcgtagtacgggaacggttcccgttacaacccgtagttccgaacgaggaacgaacccaacggtacccaaacgtaccgtccgttacgactaacgtttcaacggaaacctaaagttacggaacttcgggtactaggacgtaaccgggcgtaaacgaccgtacgtacttttagttaaacgtccgtaacgccggttaagacggtaagggtaacggtacgggtcggggttaacttaccgggaacgtacccgggttaggggacccctaaacgggggtacccctttgggaacccccttagggttccccacccggttaccgaccgtaacccccg

SEQ ID NO: 190183 - DNA, 749 bp, Homo sapiens
  misc_feature: GYAE6OF01B4XS8.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattgggggctgagctgggttttccttgttgcttattttggaaggtgtccagtgtgaggtgcaattggtggagtcgtgggggaggcctcgtccagccgtggggggtccctgagactctcctgtgtacgcctctgtacttcccctttaggctttagtggatgagctgggtccgcaggctcgaggggagggctggagtgggtgaccaagataaagcaagagtaggaagtagggaggtagtagtggtaggtaatcgtaggtacgggtaaacgggtcccgttttaccgaaccgtacgttcccgtaccgtaacggaacgtaacccgaaacccgggaaccctaaaacggtaaccttccccgggtagacccttaacgttccgtaacggaaacccttaaaagccgggtaaaactaggttaccgtaggaacgggaccggtaccccggaaagggtaccaaccgggttaactttaagttttaaccgttcggacgtacggacgggaagaacggaacgggtaccgttgggggtaccggttttaccgacggttaccggggtaccgggggaccctaaaccgggtaaccccgttcggttaacccgtaccccggttactcccgttaccgaaccggtccccccg

SEQ ID NO: 190184 - DNA, 687 bp, Homo sapiens
  misc_feature: GYAE6OF01DFRBH.36.10.A10.1.454.CMB.1.raw
tcagtacgctgtctcacgaccggtgctcgatttagcgtcgatctcaggggaggtctcagagaggagccttagccctggactccaaggcctttccacttggtgatcagcactgagcacagaggactcaccatggaattggggctgagcttgggttttccttgttgcttattttggaaggtgtcagtgtgaggtgcaattggtggagtcgtgggggaggcctcgtccaggccgtggggggtccctggagacctctcctgtgtacgccttctgtaactttccccgtttacggtctttagttggattgagtcgtgggtcccgcgagggcctccggagggggaaggggctgggaggtgggtcggaccaacgaagtaaacgcgaaaggagtagggaagtagggagggtaagtagtggtaggaatcgtaggtaggtaacgggtccgtttacacctattcctaccgaagacgaaccgaaccgacccaaagtaaccctccggtagacctaattccgtagaactaaaagttcgaaactaggttcctaggaacgacggacccggaaggtacaccggtatttaagttttacgtacgtgccgacggaagaacgggtaaagggtcggttagggggttccgtttacggaacgttacgggtcgggggaacccacggggtaacccctggggttaccctacccgg

SEQ ID NO: 190185 - DNA, 777 bp, Homo sapiens
  misc_feature: GYAE6OF01CH1TY.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggaggcctcgtccagccgtgggggtccagtgagactctcctgtgtagcctctgtaacttcccctttacggctttagtggatgagcgtgggtccgccgaggtctccggaggggaaggggcgtgggaggtggggtcggacccaacgaagtaaagacgaaaggagtagggaaggtagggagggtaagtagtagtaagtaatcgtaggtaggaacgggtccgtttaccacctagtacctaccgaagaacgaaccgaaacgacccgaaacggtaaaccttccggtagactacttacgtacgaactaaagtagtaaactacgtacgtaggaaggtaccggacccggtaaggaccctaaccgggttactttaaacgttttacgttaaccggttcgaccggggtacgaaagggaagggtaaacgggtccgggttaacggggggttacccgggtttttaccggaaaccggtttaacccggggtaccgggggggtaacccccgtaaaccggggggttaaaccccccgttggggttaacccccgttaaccccgggttcccttacccccggtacccggtaccccgg

SEQ ID NO: 190186 - DNA, 854 bp, Homo sapiens
  misc_feature: GYAE6OF01EOF16.36.10.A10.1.454.CMB.1.raw
  modified_base (223)..(223): a, c, t, g, unknown or other
  misc_feature (223)..(223): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattgggctgagctggttttcctgttgctatttggaggtgtcagtgtgaggtgcaattggtgagtcgtggggaggcctacgtccagccgtgggggtcccngacgactctcctgtgtacgcctctgtaacgttccccttacggtctttagttggatcggagtcttgggtcctaccgaggtcctaccggaaggggaagggggtctagggagggttgggggtacggaacccgaaactaagtaaaacggaccgaaaaggtaggtaggtaaaggtaggggaaggtactagtggtaggaatggttaggtaggtaacgggttcctttaccgaaccttactcccgtaacgaagggtaaaccaacggtaaacccgaccgtaaaccggtaacccgttcgggtaccgtaactaacgtaccgttaacggaaacgtaaaacgttacgaaaacccggttagtacccgtagggtaaacggcccgggtaaccggaacggtaacccgtaaccgggttaaccctttaaggtttttaaccgttaaccgttacggaccgggaacggtaacgggaaacgttaacgggggaacccggtttcggggttacccggtttttaaaccggaaacggttacccgggggaaggggttaaccccccggaagggggggttaaaaccccccctttcggggtaaccccccgttaacccggttacccccgtttaacccgacccgttacccggttaaacccccccg

SEQ ID NO: 190187 - DNA, 671 bp, Homo sapiens
  misc_feature: GYAE6OF01AY3CW.36.10.A10.1.454.CMB.1.raw
  modified_base (312)..(312): a, c, t, g, unknown or other
  misc_feature (312)..(312): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (641)..(641): a, c, t, g, unknown or other
  misc_feature (641)..(641): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagtcgttgggtttttccttgttgcttagttttggaaggtgtccagtgtgaggtgataagttggtggagtcgtgggggacgcctcgtccagccgtcgggggtcctggagactctccgtgtcgtacgcctctagtaactttccccgttacggtcttattggtatggagtcgtcgggtccnccgaggccgtcggaggggaggggcgtaggaggtggggtcggaccaacgtaagtaaacggcgaaagtaggtaagggaaggtagggaagggtagttagtaggtagtaagtcgtaggtaggacgggtccgtttcactagtccgtacacgagacacgaccaagactcgtgacntacgcaanaaacgtgaaacgtgtcgtaaggacggacggtaccggaccggaagtccggtaactttaacgttatacgtcggccgaagacgtaaggaaggtcggtagggtccgtttaccggacgtagggtacggggaccgtaaccggtacccgtcggttaccncccggttacctcccggtcgcccgtaccccg

SEQ ID NO: 190188 - DNA, 869 bp, Homo sapiens
  misc_feature: GYAE6OF01D3MEF.36.10.A10.1.454.CMB.1.raw
  modified_base (855)..(855): a, c, t, g, unknown or other
  misc_feature (855)..(855): n is a, c, g, or t
tcagtacgctgtctcacgaccggtgctcgatttagcgtcgatctcgagggggaggagccttagccctggactccaaggtcctttccacttggtgatcagcactgagcacagaggactcacagtggaagttgggggctggagtcgtttgggtttttccttgtttgtctttagttttagggaggttcgtcctagtggtaggtaggtgactaaggtttgggtggtaggttcggtggggggacgtcccgttccggtcccgacgggtccgggttcgggggggtaccaggttacggacgttaccttcctccgttggtacggtcgtccttcgttacgttaaccgttttaccccggttttacggtctttaggtaggtacgttcggacggtccggtcggggtacccaccggtacggtccggtaacccgggggaagggggggtaacgggtcggtaagggggtacgggtttacgggggaccggtaacccaaaagtaacgtaaaacggaacgtaaagggtaagggtaagggtaagggtaagggggaagggtaacgtttaggtacggggtaaaggttacggttcgggttaaggtaacgggtaaccgggtttccgttaccgaacccgtacttccgacgtaaggaaccaaaccgtaacccggaactaaacggtacgtaccgtacgtactaacgttcgaacgtaacgtaagtaggtaaccttgacgtaaggaacggacgacccggtaaggccttaacggttattaatttaccgtagtggacggtacgaaaggtacggtagggtccgtagggttcccgtacggtacgacgggttacgggaccgtaccgggtacgtccgtactacccggttcnccgtaaccgcccgg

SEQ ID NO: 190189 - DNA, 749 bp, Homo sapiens
  misc_feature: GYAE6OF01CMVD3.36.10.A10.1.454.CMB.1.raw
tcagtacgctgtctcacgaccggtgctcgatttagcgtcgatctcagggggaggagccttagccctggactccaaggccctttccacttggtgatcagcactgagcacagagactcaccatggaattgggctgagctgggttttccttgttgtcttattttggaaggtgtccagtgtgaggtgctaagttggtggagtcggtgggggaggcctcgtccgagccggtgggggtccagtgacgactctccgtgtgtacgcctctagtacctttccccgtttacggtctttagttggtatggtagtccgtcgggtcccgccgtaggtccgtaccggaaggggacggggtcgtgggtaggtcggggtacgacccgaaacgtaagtaaaacgcgaaaggtagtagggaaggtagggaaggtagtagtaggtagtatcgtagtacggaacggtccgttacactaacgtcctacgagaacgacgaaccgtacccaaacgtaaccgtccgtacgtacgtacgttacgtaacgtacaaagtacgaaacctaggtaccgtaggaacgacggtaccggaacgtacccgtacggtacctttaagttacttacgtacgtacgacggtaagacggtaacggtacgtccgggttaccggttttaccggacggttaccgggtccggggtaacccggttaaccgggtaaccccggttcgggtaaacccgtaccccggttaccgttcccccgttaccgtaaccccgg

SEQ ID NO: 190190 - DNA, 921 bp, Homo sapiens
  misc_feature: GYAE6OF01A2W4U.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcacatggaattggggctgagtcgttgggttttccttgttgcttagttttggaagtgtccagtgtgagtgctaagttggtggtagtcggtgggggacgccgtcgtccgagtccggtgggggtccagtgagtactcgtctgtgtacgcctctcgtaacctttcccgtttagctttagtacggtatggacgtccgttcggggtcccgccgtacggtcctaccgggaagggggtaacggggtccgttaggggtagggttacggggtaccggaacctaaacgtaaagtaaaacggaccgtaaaggtaaggttacgggaaagggttaacggggaagggtaaggttaagtgggttaaacgggtaacgttacgggtacgggttaaacgggtaaccgggttacccggtttaaccgtaaaccgtaccgttaccgtacccgggaaaggtaaccggaaacccgtaaacccggaacccgtaaaaacgggtaacccgttcccgggtaacgtaaccgtaaccgtttaccggtaacgtaaaaccgttaaacgttacccgggaaaacgtaacggtttcccgaaggggaaaccgtaccgggtaacccggaaaccgggtacggtaaacccgggttctttaagggtaccttaacggtttaacgtggggtaccgtaacgggtaaccgtacgggtacccctcccggtttacccgtaccgggtacccgttaacccgggtttaggggttaccggggttaaccggggtaaccgtttaaaccgggacccttaaacgggtacgggttaccccggggttcggttaaaccggggg

SEQ ID NO: 190191 - DNA, 802 bp, Homo sapiens
  misc_feature: GYAE6OF01B7MA1.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagcgttgggtttttccttgttgtcttagttttggaaggtgtccaggtgtgaggtgctaagttgggtggagtcggtgggggaggcctcgtccgaggccggtgggggtccagtgacgactctccgtgtgtacgcctctagtacctttccccgtttacggtactttagttggatggacgcgtcgggtcccgccgacggtccgtaccggagggggacgggggtcgtaggggacgggttggggtacggaacctaaacgtaaagtaaaacgacgaaaggtaggtagggtaaagggtaggggaacgggtaggttacgtgggtaggtaacgttcggttagggtacgggtaacgggttccgtttaccgaaccctacgttccgtaaccgaaggaaccgaaccgaaacccgtaaaccctaaaaacctccgtaacggtacgttaaccttacgtacggaaactaaacggttcgggaaccggtccgtaaggacggtaaccgtacccgggaaggtacccggtcgggtagttaggtttagttagtttagttggtacggtaggtaaggttaagttaaggtttaactaaacggttaaaccgttaaggtttacgtaggttacggttaacggttaggttaacgtaggtacgttacgttagttaagttcgtaaccgggttaacccgggg

SEQ ID NO: 190192 - DNA, 616 bp, Homo sapiens
  misc_feature: GYAE6OF01B37WT.36.10.A10.1.454.CMB.1.raw
  modified_base (146)..(146): a, c, t, g, unknown or other
  misc_feature (146)..(146): n is a, c, g, or t
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagcggtgttcgngtagctattggaagtgcagtgtgagtgcaattgnggactgngggcgctcgcagcctggggtcgagctctccgtgagtncctntgaacttccgtaagctagttgatcgatgnggtccnaggcttacggaggtaacggnaggcgtgcanaanataagnaagagtagaacggtagaggtatagngtacgattcgtagaacggtacggtcctanacgtactcgaacgacgtaaacgacaacgtacgtaagtactacgactactacgtacgacgaagaataacgaacgtacgtacgacggacgaacggacgtagactacggtaattacgtaacgtacgtacggacgtaagacggtaacgaacggtaccggttacggttacggtacccggtaccggtaaccgggtcgggtaacccggtacccggtaaccggtacggttacccgaacgtttacctacccggtacgtccggtaccccg

SEQ ID NO: 190193 - DNA, 910 bp, Homo sapiens
  misc_feature: GYAE6OF01BNSAZ.36.10.A10.1.454.CMB.1.raw
  modified_base (884)..(884): a, c, t, g, unknown or other
  misc_feature (884)..(884): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagcgttgggttttccttgttgcttattttggaagtgtccagtgtgagtgcaagttggtggagtcgtggggacgcctcgtccagtccgtcgggggtccctgacgacctctccgtgtgtacgccttcgtacgtaacctttccccgtttacggtctttagttaggtagtcggacgtcggttcgggtcccgaccgacggtccgtaccggaagggggtaacggggtcgtaggggtacgggttgggggtaccggaacccgtaaacgtaaacggtaaaacggaccgtaaaaggtaagggttaaggggaaaagggttaagggggaaagggtaggttaaggttggtaacggtaacgttcggttagggttacgggtaaacccggggtttccccgttttaaccgaaacccgttacgtttacccgttaacccgaaacgggtaaaaccggaaacccgtaaacccgggtaacccgtaaaaacccggtaaacccgttccccgggtagtaccttaacgttaccgttaacgaaactaaaacggtacgaaaccgttacggttacgtaggaaccgtacggggaacccgtaacgggaacccgttacgttaacttttacgtttaacgttacggtcggacggtagggaaggtaaacgggtacggggttcggttacggggttacccggtttaaccgacgggttaacccggggcccggggtaacccgtaaacccggggtccccgttacggttacccccgtcccgggtttacccncccgttcccggacccgtaccccccgg

SEQ ID NO: 190194 - DNA, 746 bp, Homo sapiens
  misc_feature: GYAE6OF01CI35Z.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaagttgggctgagcttgggttttccttgttgcttatttggaaggtgtcagtgtgaggtgctaagttggtggagtcggtgggggacgccgtcgtccgacggtcccggttcggggggtccctggacgtacttccgtccgtgtgtacgtcctcgtacgtacctttccccgttacggtctttagttggatggaggtccgtcgggtcccgacgacggcctaccggaggggacggggcgtgggacggtgggtacggaccaaacgtaagtaaaggcgaaagtagtaagggtaaggtaggagggtatagtggtagtaagtcgtaggtaggtacggtccgttacaccgtactcctacgagacgaaccgaaccgtaacgaacgaccgtcgtacgctatcgagtaactaaagtacgaacttagtacgtaggacggaacggccggaaggaccgtacggttactttaaagtttaccgtacgtacggacgaagggtaaggaaccgggttacgggacgggttcggggttaacccggttcggaaaccggttcggggtacggggacccgtaaccggggttaacccgttcccggttaacccgtacccggttacccctccgttaaccgccccgtacccccgg

SEQ ID NO: 190195 - DNA, 878 bp, Homo sapiens
  misc_feature: GYAE6OF01BQDQY.36.10.A10.1.454.CMB.1.raw
  modified_base (858)..(858): a, c, t, g, unknown or other
  misc_feature (858)..(858): n is a, c, g, or t
tcagtacgctgtctcacgaccggtgctcgatttagcgtcgatctcgagggggaggagccttagccctggactccaaggcctttcacttggtgatcagcactgagcacagacgactcaccagtggaagttgggctggagtcggttttggggtttttacctttggttgtacgttttagttttagggaaggttcgttaccgtaggttggtaggtagggttgacgtaaaggtttgggtgggtaggttcgggtaggggggaccgtccgttccggtacccggacgggtcccgggttacggggggtaccaagttcggaacgtaccttccgtttccgttggttacgtaccgtccttacgtaaccgttaacccgtttttccccgtttacggtaactttaaggttaggtaacgtacggtaccggttccgggtaccggggtacccgaccgacgggtaccgtaaccggggaagggggaacgggtcggttacggggtaaggtccgggtaaccggaacctaaaacgaaggttaaaacgagtaaaggtacgtaagggaaagggtagggaacggtaagttagtaacggtagtaacgttcggtaggtaacgggtaaccggtttccgtaacaccgtaaactcgtaaccgaggtaacaacgaaccgaactaacggtactaccgtagacgtaatctaaaggaactaagtaacgaacgtacgtgaacgaggtaccgaacggagtaacgtacgttactttaagtttacgacgtacggagaacggaggtaaaccggagggttcggtacggggttacccgttacggaacgggttaccgggcgggtaacccggtacggttaaccggtacgtacccgttacccnccgttcccgtacgaccccgg

SEQ ID NO: 190196 - DNA, 809 bp, Homo sapiens
  misc_feature: GYAE6OF01BPTAK.36.10.A10.1.454.CMB.1.raw
  modified_base (267)..(267): a, c, t, g, unknown or other
  misc_feature (267)..(267): n is a, c, g, or t
  modified_base (606)..(606): a, c, t, g, unknown or other
  misc_feature (606)..(606): n is a, c, g, or t
  modified_base (613)..(613): a, c, t, g, unknown or other
  misc_feature (613)..(613): n is a, c, g, or t
tcagtacgctgtctcacgaccggtgctcgatttagcgtcgatctcagggggaggagccttagccctggactccaaggcctttccacttggtgatcagcactgagcacagaggactcaccattggaattggggctggagcgttgggttttccttggttgtacgttagtttttacgggaaggttcgtaccagtggtcggtaggtgctaagttgggtaggtacgtcggtagggggacgtcctacgtccgagtccgggtcgggggtctagngacctcgtccgtagtcgtacgtcctacgtagtaaccttccccgttaacgtcgtttagtggtacgtggtacgtcggttcgggtaccgacgtaggtccgtaccggaagggggacggggtccgtaggggtacggtcggggtacggaccgtaaacgtaacgtaaaggaccggtaagtagtaacggggaggtaacggggtaagggtattcggtaggtgttaaagtcgggtagtacggggaaaccgggtttctacgaaccttacgtcgtaccggaagtaacggaccctaaaccgacgtaaccgaaccgtcggtaactcgaatacgcaaacgtaagtacaacgttnttacggnggtaccgagtccggtaagctacggtattaaccggttcgtacgtacgggtaccaaggggtaccggtaagacccgggggttatacccgggggtttacgtacggtaacggtcccggggttaccgggaaacggttcccggggaaacttcggggttaaccctaccccggttacctacggtcccgtaacccgttcccccggg

SEQ ID NO: 190197 - DNA, 500 bp, Homo sapiens
  misc_feature: GYAE6OF02IRHQ4.36.10.A10.1.454.CMB.1.raw
  modified_base (488)..(500): a, c, t, g, unknown or other
  misc_feature (488)..(500): n is a, c, g, or t
tcagtacgctgtctcacgaccggtgctcgatttagcgtcgatctcaggggtccctgagactctcctgtgtagcctctgaattcccctttacggcttattggatgagctgggtccgccaggctccagggaaggggctggagtgggtggccaacataaagcaagatggaagtaggagggagtatgtggaatctgtgaagggccgtttcaccatctccagagacaacgccaagaactccgtgcatctgcaaatgaacagtctgagagccgaggacacggctatttattactgcgcgagagaaggactgggcggtttcgactactggggtcagggaaccctggtcacgtctctcagcctccacaagggcccatcggtcttcccctggcgccctgctccaggagcacctccgagacgcacagcggccctgggctgcctggtcaaggactacttccagacagcgtactgacgcgggctggcaaggcgcagtagnnnnnnnnnnnnn

SEQ ID NO: 190198 - DNA, 507 bp, Homo sapiens
  misc_feature: GYAE6OF02GEUJ5.36.10.A10.1.454.CMB.1.raw
  modified_base (290)..(290): a, c, t, g, unknown or other
  misc_feature (290)..(290): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctcttttaagaggtgtccagtgtcaggtgcagctggtggagtctgggggaggcgtggtccagcctgggaggtccctgagactctcctgtgcagcctctggattcaccttcaatacctatggcatgcactgggtcccnccaggcctccaggccagggggctgggagtgggtggcagttatatcatatgatggaagtaataaatactatgcagactcgtgaagggccattcacatctcagagacaatccaaagaacactctgtatctagacaaatgaacagcctagagagcgtagaggacacggctgtactaattactggtagacgaaagtctcggaggtgtacgtggtactaagg

SEQ ID NO: 190199 - DNA, 533 bp, Homo sapiens
  misc_feature: GYAE6OF02FGFPL.36.10.A10.1.454.CMB.1.raw
tcagtacgctgtctcacgaccggtgctcgatttagcgtcgatctcaggggaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattccctttacggcttattggatgagctgggtccgccaggctccgagggaaggggctgggagtgggtggccaacagtaaagcaagatggaagtaggagggagtatgtggaatctgtgaagggtccgtttcaccatctccagagacaacgccaagactccgtgcatctgcaaatgaacagtctagagagccgaggacacggctaatttatactgcgcgagagaaggcgtgggtcgtttcgacgtacgtggggccagggaccctggtcaccg

SEQ ID NO: 190200 - DNA, 566 bp, Homo sapiens
  misc_feature: GYAE6OF02G41TJ.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccgagggaaggggctggagtgggtggccaacataaagcaagatgggaagtagggagggagtatggtggaatcgtgtgaagggccgttttcaccatctccagagacaacgccaagaactcgtgcatctgacaaatgaacagtctagagagccgaggacacggacttatttattactgcgacgagagaacggacgtggggcgtttacggacgttacggtgggggccaacggggaccctgggtacccaccggttcctacccgtcacgtccccg

SEQ ID NO: 190201 - DNA, 553 bp, Homo sapiens
  misc_feature: GYAE6OF02FZS8M.36.10.A10.1.454.CMB.1.raw
  modified_base (358)..(358): a, c, t, g, unknown or other
  misc_feature (358)..(358): n is a, c, g, or t
  modified_base (546)..(546): a, c, t, g, unknown or other
  misc_feature (546)..(546): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattgggggctgagctgggttttccttgttgctattttggaaggtgtccagtgtgaggtgcaattggtggagtctgggggaggcctcgtccagcctgggggtccatgagactctcctgtgtagcctctgaacttccctttacggcttattggatgagctgggtccgcaggctccagggaggggctggagtgggtggccaacagtaaacgcaagatggaagtaggagggagtatgnggaatcgtgtagaaggtccgttcaccatctccagagacacgacaagaactcgtagcatctgcaaatgaacagtctgagagccgagacgacggtctatttatacgtgacgacgagacgaagtacgtgggacggtttcacgttacgtcgggggaccagggtaacccgtggtaccacccgtcgttacccgntacccgg

SEQ ID NO: 190202 - DNA, 566 bp, Homo sapiens
  misc_feature: GYAE6OF02G91SC.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcagctgctgggagtcgtggggggaggcttggtacaggccgggggggtccctggagactctcctgtgaagcctctggattcacctttgacaagtgtgccatgacctgggtccgccaggcctccgaggggaagggctgggagtgggtctcgagttattaggtggtagtggtagtagcacagattacgctagactcggtggaacgggtcccggttcaccatcctaccagtacgactaacttccaaacagcacgctgtattgactacatagaacagcctgagacgaccgaggacacggaccaatactattatgtagacgtaactttccgtttagacttcggttaattacgttcccgtagtcgacctcgtacggggacccaggtacccg

SEQ ID NO: 190203 - DNA, 638 bp, Homo sapiens
  misc_feature: GYAE6OF02IQRYS.36.10.A10.1.454.CMB.1.raw
  modified_base (334)..(334): a, c, t, g, unknown or other
  misc_feature (334)..(334): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaatttggtggagtcgtgggggaggcctcgtccagccgtgggggtccatgagactctcctgtgtagcctctgtaacttcccctttacggcttattggatgagctgggtccgccaggctccgaggggaaggggctgggaggtgggtggccaanataaagcaagatagggaagtagggagggagtatggtaggaatcgtggtaggaacgggtccgtttacgacctatcctccaggacgaccaacgaccaaagaacctccgtagcatctagacctaaaatcgaaacagtctaggacgacggacccggagggaaccacggtacttaattttactaccgtgaccgacgaaggaacggaagggcgttaggggggtccggttttaacgaaccggttacggtcgggggacccgtaaggggtaaccccgttgggttcccacccggttccttacccgtacgacccg

SEQ ID NO: 190204 - DNA, 713 bp, Homo sapiens
  misc_feature: GYAE6OF02FS2KH.36.10.A10.1.454.CMB.1.raw
  modified_base (391)..(391): a, c, t, g, unknown or other
  misc_feature (391)..(391): n is a, c, g, or t
tcagtacgctgtctcacgaccggtgctcgatttagcgtcgatctcagggggaggagccttagccctggactccaaggccttttccacttggtgatcagcactgagcacagaggactcaccatggaattggggctgagcgtggtttcgtgttaggctatttggaaggtgtccagtgtgagtgcaattggtggagtctgggggaggcctcgtccagccgtgggggtccctgagactctcctgtgtagcctctgaacttcccctttaggcttattggatgagctggtccgccaggctccgagggaggggctgggagtgggtggccaacagtaaagcaagatggaagtagggagggtagtagtggtaggaattcgtagttgaagggtcccgtttnacctagtcctaccgagacgaacaacgccaaagaactccgtgactatctacgactaaaacgtcgaaacgtagtaccgtaggaacggtacgggcccgaagggaacccgtacggggtaccttaaggttttttaacgtttaaccgttacgggacgggttacccgaaagggttaaacggaacggggtaccgggtttacggggtaccggttttaaccgggaaccgttaacgggtacccggggggtaaccccgtaacgggggtaaccccgttacgggttcccgtaaccccggtttcccgtaccggttaccccgtaacggtcccccccgg

SEQ ID NO: 190205 - DNA, 579 bp, Homo sapiens
  misc_feature: GYAE6OF02FHD4D.36.10.A10.1.454.CMB.1.raw
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtctggggagctcgtccagcctgggggtccatgagactctcctgtgtagcctctgaattcccctttacggcttattggatgagctgggtccgccaggctccagggaggggctggagtgggtggccaacataaagcaaagatgggaagttaggagggagtagtgtggaatcgtgtgaagggccgtttacacctatctccagagacaacgcaagaactccgtagcatctgacaaatgaacngtactganaggccgaggacacggctatttaactacgtgcgacgaggaagaaggtacgtcggggacggttttccgaacgtttaccggtggggaccccgtagggaaccccgttgggacccgtaccggtttcctacccgtactaacccgg

SEQ ID NO: 190206 - DNA, 635 bp, Homo sapiens
  misc_feature: GYAE6OF02FJ18H.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaacttcccctttaggcttattggatgagctgggtccgcaggcctccgagggaaggggctgggagtgggtggaccaacaataaagcaagagtgggaagtagggagggagtagtggtagggaatcgtggtaggaacgggtccgtttacgacctatcctaccgaggaacgaccaaaccgccaaagaacctccgtagcctaatctaggaccaaatgaacctagtctagaagtacgaccgacgggaacaccggtacttaattttacgttaccgtaggcgtacgaaggtaagaagggtcgtggggtccgtttacggaaccgttacgggtcggggaccctaacggggaaccccgtgggtacctacccggttctcccgttagcgtaccccc

SEQ ID NO: 190207 - DNA, 742 bp, Homo sapiens
  misc_feature: GYAE6OF02IY6O3.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctatttggaaggtgtccagtgtgaggtgcaattggtggagtcgtggggaggcctcgtccagccgtgggggtccatgagactctccgtgtgtagcctctgtaactttccccgtttacggctttagttggattgagtcgttcggggtccgccgaggtcctccggaaggggtaacgggggtctggggacggttggggtcgacccgaaacgtaagtaaaaacggccgtaaaggagtagggaaaggtaaggggaagggaagttaagtggtaggtaaagtcgttagggtacggaaacggggtcctttacgaaccgtagttccgtaccgtaacggaacgtaaccgaaaccggacctaaaaggtaaccgttccgtacggactaagtccgtagaacaaagtcgtaaacgacgtcgtagaacgacgcccggaagtaccgacggtcttaaactttactaccgtgaccgtacgaacggaagtaacggacggttacggggttaccggttacggtaaccttacggggtaccggggacccgtaacggggtaacccccgttggtaaccccggtacccggtttccgtacccgttacgtaaccccgg

SEQ ID NO: 190208 - DNA, 595 bp, Homo sapiens
  misc_feature: GYAE6OF02IBF9M.36.10.A10.1.454.CMB.1.raw
  modified_base (216)..(216): a, c, t, g, unknown or other
  misc_feature (216)..(216): n is a, c, g, or t
  modified_base (331)..(331): a, c, t, g, unknown or other
  misc_feature (331)..(331): n is a, c, g, or t
  modified_base (584)..(595): a, c, t, g, unknown or other
  misc_feature (584)..(595): n is a, c, g, or t
tcagtacgctgtctcacgaccggtgctcgatttagcgtcgatctcaggggtccctgagactctcctgtgtagcctctgaattcccctttacggcttattggatgagctgggtccgccaggctccgagggaaggggctggagtgggtggccaaacataaagcaagatggaagtaggagggagtatgtggaatctgtgaagggtccgtttcaccatcnccagagacaacgccaaagaacctccgtgcatctgacaaatgaacagtctgagagccgaggacacggctatttattactgcgcgagagaaggacgtggggtcggtttcgactacgnggggccgacgggaaccctggtccaccgtctcctcacgccctcaaccgaacgggcccagttccggtcccttccccccgtggcccgccccgtgcctaccgaggacgcccacccgtaccggagacgaccgacgacggcccggcccgtcggggctcggcctcgggtaccgaacggtacctaccgttccgaagtaccgagtaccgtacgtcgggacggccggggtacgtcggaacggacgggccgacgtaagtagcgnnnnnnnnnnnn

SEQ ID NO: 190209 - DNA, 600 bp, Homo sapiens
  misc_feature: GYAE6OF02H9VD3.36.10.A10.1.454.CMB.1.raw
  modified_base (594)..(595): a, c, t, g, unknown or other
  misc_feature (594)..(595): n is a, c, g, or t
  modified_base (598)..(599): a, c, t, g, unknown or other
  misc_feature (598)..(599): n is a, c, g, or t
tcagtacgctgtctcacgaccggtgctcgatttagcgtcgatctcaggggtccctgagactctcctgtgtagcctctgaacttcccctttacggcttattggatgagctgggtccgccaggctccgagggaaggggctggagtgggtggccaacataaagcaagatggaagtaggagggatatgtggaatctgtgaaggccgtttcaccatctcagagacaacgccaaagactccgtgcatctgacaaatgaacagtctgagagccgagacacggctattatactgcgacgagagaagacgtgggcgtttcgactacgtgggccagggaaccctggtccaccgtctcctcacgccctccacgaacgggcccagtccggtacccttccccgtggccgtcccctgcctcccgaggacgccacccgtcgaacgacgcacgacggccggccccgtagggcctcgtccgtacggtcgaaacggtacctaacctttaccgaacggaaccgtaacggtaccgttaaccgtacgggaccggtccggggtaccgtaccggggacgaacgggtacgaccgtaagtacgatacgcacgcagacanncgnnc

SEQ ID NO: 190210 - DNA, 582 bp, Homo sapiens
  misc_feature: GYAE6OF02GZI8U.36.10.A10.1.454.CMB.1.raw
  modified_base (465)..(465): a, c, t, g, unknown or other
  misc_feature (465)..(465): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccatgagactctcctgtgcagcctctgggacttccccttcagttgacctactggatgcacgtggggtcccgccaagcctccgaaggggaaggggtctgggtggtgggtctcgacgttattagtagtgatgggattacacaactaatggtggagtccggtgggacgggcgattccgaccatctccagacgacaacgccaaagaacacgctgtactcgtagacaaatcgaacgagtcagganaggaccggaggaccgacggctagttgtaatttattgtgacttaacgtttgggtaatttaggttcggaaccgacgtcgacgtaagtccgggggaccacggggtaaccctggtaacccg

SEQ ID NO: 190211 - DNA, 903 bp, Homo sapiens
  misc_feature: GYAE6OF02HSGP8.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggagcctcgtccagccgtgggggtccctgagactctccgtgtgtagcctctgtaactttcccctttacggtctttagttggatgagcgtcgggtccgccgaggcctaccgaggggaacggggtcgtagggaggttgggtcggaccaaacgaataaaagcaaagagtagggaaggtaggagggagtagtggtaggaatcgtaggtaggtaaacgggtccgtttacgacctaacgttcctaccgaaggtaacgaacccgaaaccggacccgtaaaaacggtaaacccgttccccgggtagaacctaacgttccgtaacggaaccgtaaaaagttacggaaaaccgtaggtttaacccgtaagggaaaccgggtaaccgggaacccgggaaacggggtaacccgtaaacccgggtttaacctttttaaacgttttttaaaccgttaaccgggttaccgggtaaccgggtaaacccgggtaaagggaaaaccggggttaaacgggggtacccgggtttacgggggggttttaacccccgggttttttaacccgggaaacccgggtttttaaccccgggggtaaccgggggggtaacccccggttaaaaccgggggggttaaacccccccgtttgggggtttaacccccgtaaaccccccggttttcccgtaaccccccgttaccggtaaccccggtaaccccccgg

SEQ ID NO: 190212 - DNA, 622 bp, Homo sapiens
  misc_feature: GYAE6OF02JICTK.36.10.A10.1.454.CMB.1.raw
  modified_base (461)..(461): a, c, t, g, unknown or other
  misc_feature (461)..(461): n is a, c, g, or t
  modified_base (514)..(514): a, c, t, g, unknown or other
  misc_feature (514)..(514): n is a, c, g, or t
  modified_base (534)..(534): a, c, t, g, unknown or other
  misc_feature (534)..(534): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgcttattttggaaggtgtccagtgtgaggtgcaagttggtggagtcgtgggggaggcctcgtccgagccgtgggggtccatgagactctccgtgtgtagcctctgtaacttccccgtttaggtctttagttggatgagtcgtcgggtcccgcgaggtcctaccggaggggaacggggtcgtgggaggttggggcggaccaaacaagtaaagcaagagtagggaagtagggagggtatagtgtagaatgtgtaggacggtccgttacacctatccaccgagacgaacgaaccgacaaacgacctccgtanactaatcctagaacaaagtcgaaacgtgttacaggacgacggaccgaaggacncgttacttaatttgtaccgnggacgacgaaggaggagtcgtcgggttacgttcgacggttcggcggggacccaagggtaccctggtacccaccgtcctccgaggtacc

SEQ ID NO: 190213 - DNA, 707 bp, Homo sapiens
  misc_feature: GYAE6OF02F31FC.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggagcctcgtccagccgtgggggtccctgagactctcctgtgtagcctctgaactttcccctttacggctttattggatgagcgtgggtccgccaggcctccgagggggaacgggcgtgggaggtggggtcggacccaacgaataaaggcaaaggagtagggaagtaaggggagggaagtagtgtaggaatcgtaggtaggtacgggtccgtttacgacctagttcctaccgaaggacgaacgaacgaccaaaagtaaccgtccggtagacctaattccgtaggaacaaagttacgaaacgtagttacgtgaagacggacccggaggaaccgacgggttactttactttaacgttaccgtggaccgtacggaaaggtacgggaaacgggtaccgttcgggggtaccgtttaccggaacggttacgggtccgggggaacccgtaaccggggtaacccgttcgggacccgttaccccggttccgtacccctaccggaccgtacccccg

SEQ ID NO: 190214 - DNA, 668 bp, Homo sapiens
  misc_feature: GYAE6OF02FYI81.36.10.A10.1.454.CMB.1.raw
tcagtacgctgtctcacgaccggtgctcgatttagcgtcgatctcagggggaggagccttagccctggactccaaggccttttccacttggtgatcagcactgagcacagaggactcaccatggaattggggctgagctgggttttccttgttgcttattttggaaggtgtccagtgtgaggtgcaagttggtggagtcgtgggggaggcctcgtccagccgtgggggtccatgagactctcctgtgtagcctcgtgtaacttcccctttacggcttacttggatgagcgtgggtcccgccgaggcctccgaggggaagggctggaggtgggtggccaacgagtaaacgcgaaagagtagggaagtagggagggaggtagtaggtaggaatcgtagtaggaaggggtcctttacaccgtatcctacgagacgacaaccgcaaagaacctcgtagctactcgtagactaaagtcgaaactgtcgtagaagacggaccggaggacgacggacctttaagtttctacgtgacggtacgagggaagtaacggtacggtcgggggtacgggtttccggaaccggttacggtacccggggggaccctaaacccggggggtacccttacggggtaccccttaacccggtccccttacccggaccgttaaccccgg

SEQ ID NO: 190215 - DNA, 751 bp, Homo sapiens
  misc_feature: GYAE6OF02G47XA.36.10.A10.1.454.CMB.1.raw
  modified_base (202)..(202): a, c, t, g, unknown or other
  misc_feature (202)..(202): n is a, c, g, or t
tcagtacgctgtctcacgaccggtgctcgatttagcgtcgatctcaggggaggtctcagagaggagccttagccctggactccaaggcctttccacttggtgatcagcactgagcacagaggactcaccatggaattggggctgagcgtgggttttccttgttgctattttggaaggtgtccagtgtgaggtgcaagttggnggagtcgtgggggagcctcgtccagccgtgggggtccctgagactctcctgtgtacgcctctcgtaacctttccccgtttacggtctttattggatggagtcggtcgggtcccgccgagggcctaccggaagggggaacggggctaggggagggttcgggggtcggacccaaagtaagtaaaacgacgaaagagtagggaaagtagggagggtagtagtggtaggaatcgtaggtaggtaacgggttcccgtttacgtacctagtaccgtaccgaaggtaacgaacccgaaacggaccaaacggtaaccctcggtacgtaccacttacgttagaaccaaaagtaccgtaaagtacgtacgtaggaaggaccgtaccggaacggggtaaccgaccgggtttactttaacgttttaactaccggtggtaccggacggaagggaacgggtaaacgggtacgggtacggggttccgggtttaacccgacggtttaaccggggtccggggaacccggtaaccggggtaacccggttcggaacccctacccccgg

SEQ ID NO: 190216 - DNA, 816 bp, Homo sapiens
  misc_feature: GYAE6OF02HQ2OM.36.10.A10.1.454.CMB.1.raw
  modified_base (193)..(193): a, c, t, g, unknown or other
  misc_feature (193)..(193): n is a, c, g, or t
tcagtacgctgtctcacgaccggtgctcgatttagcgtcgatctcagggggaggtctcagagaggagccttagccctggactccaaggcctttccacttggtgatcagcactgagcacagaggactcaccatggaattggggctgagctgggttttccttgtgcttattttggaaggtgtccagtgtgaggtncaattggtggagtcgtgggggaggcctcgtccacgccgtgggggtccctgacgactctcctgtgtacgccttcgtagtaacctttccccgtttacggtctttagttggatgagtcgtcggggtcccgccgaggcctccggaaggggacgggcggtgggaggtggggtcggaccaaacgaagtaaagcaaaggagtagggaaggtagggaggggtagttagtaggtacggtaatcggttaggtaggtaacggggtccgtttaccaccgtagtcccgtacgaacggtaacgaaccaaacccggaccaaacggtaacccgtccggttaggaccttacgtaccttaaggtaaacctaaagttacggaaaaccgtacggttaccgtaagggtaacggacccgggaacccgggtaaacgggaaccccgtaacggggtttacctttttaaacgggtttttaactaacccgggttttagggaccggtacgggaacgggtaaagggaaacgggttaccggggttcgggggtaacccggttttttaccggaaccgggtttaaccggggtaccggggggtaaccccgggtaacccgggggttacccccgttgggggttaccccctaaccccggg

SEQ ID NO: 190217 - DNA, 716 bp, Homo sapiens
  misc_feature: GYAE6OF02FMDNK.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggagcctcgtccagccgtgggggtccatgagactctcctgtgtagcctctgaacttcccctttacgcttagttggatgagtcgtgggtcccgccgaggcctccgaggggaacggggcgtgggaggtgggtcggccaacgaagtaaagcgaaagagtaggaaaggtagggaagggtagtagtggtaggaatcgtggtaggaacgggtccgttacaaccgtactacccgtaccgtaagacgaacgaaaccgtacccaaaaggaaccccgtttccgtagaccgtactttacccgaagtaacccgaaaagttcggaaaaccgttgttccgtaagggaaacgtacgggaccccggaagggtaaccctaacggtctttttaaacgtttagttaaccgtcgacggtacgaaaggacgaagggttccgtgggggtaccggttttccgaaacgttcgggtcggggtaacccgtaacgggaaccccgttgggtaccccgaccgtttcccgtacctcgtaccccgg

SEQ ID NO: 190218 - DNA, 834 bp, Homo sapiens
  misc_feature: GYAE6OF02GT0YA.36.10.A10.1.454.CMB.1.raw
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
tcagtacgctgtctcacgaccggtgctcgatttagcgtcgatctcagggggaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggccgtcgtccagccgtgggggtcccgtcgagactctcctgtgtagcctctgtacttcccttaccggtcttattggtagtgtagngtcggtccgccgcggtcgtccgacgggaaggggnggtgggaggtgggtcggaccgaacgaacgtaaagacgaagaagtagggaaggtaagggagggaggtagtagtaggagtagtagtaggtaacggtacggttcctaacctacgtactccgacgtacgaacgaaccgtacccgaaagtaacccgtccgtacggacctaaacgttcgttaacgaaccgtaaaactcggtaaaccgtagtaccgttaggaacggtaaccggacccggtaaaggggaaaccgtaccgggttaaacttttacggtttttaaccgttacgtaccgggtaccggtaacgggtaaacggaaacggggtaaagggttaccccgggtttaggggggttacccggggtttttaaacccgaaacccgggttttaaacccggggtaccgggggggtaaccccccgggtaaaacccgggggtttaaaccccccgggttacgggttcccccttaaaaccccggggtttcccctttacccggttaccccgaacccggttacccccccgg

SEQ ID NO: 190219 - DNA, 813 bp, Homo sapiens
  misc_feature: GYAE6OF02G4W3G.36.10.A10.1.454.CMB.1.raw
  modified_base (655)..(655): a, c, t, g, unknown or other
  misc_feature (655)..(655): n is a, c, g, or t
  modified_base (766)..(766): a, c, t, g, unknown or other
  misc_feature (766)..(766): n is a, c, g, or t
tcagtacgctgtctcacgaccggtgctcgatttagcgtcgatctcgagggggaggagccttagccctggactccaaggcctttccacttggtgatcagcactgagcacaagaggactcaccagtggaagttggggctgagcgttgggttttccttgttgtcgttagttttggaaggtgtccgtagtgtgtaggtgacgtaagttgggtggtaggtcggtgggggtacggtcctccggtccgacggcccgggttcggggggttccccgtaggacgtaccgttccttccgttggtacgtacggtcccttcgttacgttaaccgttttccccgtttaccggtacgtttaggttacggtagtaggtacgtccgtccgggttacccgccgacggtccgtacgggaacgggggtacggggtcggtaggggacggtggggtaccggtaacccgtaaaacggtaaaggtaaaaagggaaggtaaggtaacgggtaaaggtacgggtaagtaaaccgttaagttaggttacgtaacgttcggtagggtacgggtaaccggggtacgtaacgttacccgaccgtacccgtacggaacggaacgtaaccgaacgtaaccgtaaagaaccgtgtaacgtctcgtaactacgaaactaaagacgtaanaccgtaacgtggtaacgacggtacggaagaccgtcggtacgtcgtagttacgttcgtcgtacggtaccgtacgtagttacttacggactaagggttaacggtcgggttacncggccggtcgggaccggcggtacgtggttagcggttagtcgttacgg

SEQ ID NO: 190220 - DNA, 950 bp, Homo sapiens
  misc_feature: GYAE6OF02I3YKU.36.10.A10.1.454.CMB.1.raw
tcagtacgctgtctcacgaccggtgctcgatttagcgtcgatctcagggggaggagccttagccctggactccaaggcctttccacttggtgatcagcactgagcacagagactcaccgatggaagttggggctaggagtcgttgggtttttcccttaggttcgtcttagtttttagggaaagggttcggttacccaggttggttggtaacgggttggcctaaagtttgggtacgggtaaggttcggtggggggaacggtcccgttccggttcccgacggtcccgggttcgggggggttcccccttagaacggttacccgtccgttacccggttggtacggttaacggtccccgttacttcggtaaacccttttacccccgttttaacgggtctttaaggtttacggaattgggaacgtaccggttcgggtacccccgacgtaacggggtcctacccgggaagggggtacggggtcgtaggggtacgggttcggggtaccggacccgtaaaagacgttaaaacggcgaaaaggttggtaaacgggtaagggtagggggaagggttaagttacggttaggtaacgggtacttcggtggtacgggtaaaccggggttccttttccgaacctacgttacccgtaacgaacggtacgaaaccgtaacccggacccgtaaaacggtacccttaccgtacggtacgaacgtttcgaaaccgtaactaaaggttaccgaaccgttagtttaccggacgtaaacgggtaccggaaccggaccgttaaacggaaccggttactttaaggtttacctttaaggtacgtacgaccgggtaagaccggtaaccggtacgggttacgggtacggtttaccggtaaccggttacgggtccggggaaacgttaccccgggtacttacggtacccgtacccgtaccctgtaccccgtaccgaaccc

SEQ ID NO: 190221 - DNA, 792 bp, Homo sapiens
  misc_feature: GYAE6OF02HDLMW.36.10.A10.1.454.CMB.1.raw
tcagtacgctgtctcacgaccggtgctcgatttagcgtcgatctcagggggaggagccttagccctggactccaaggccttttccacttggtgatcagcactgagcacagaggactcaccatggaattggggctgagcttgggttttccttgttgcttagttttgggaaggtgtccagtgtggaggtgcaagttggtggagttcggtgggggaggtcctcgtccgaggtccggtggggggtccagtggacgactcgtccgtgtgtacgcctctagttaaccttccccgtttacggtccttagttggatggaagtcggtcgggtcccgccacggtccgtaccggaagggggaacggggtcgtggggtaaggtggggtcgaccgtaaagaacgtaaaacgcgtaaagagtagggaacggttagggaacggtagtagtcgggtaagtagttacggtaggtaagggaacgggtccgtagttacccgacctagtacctacgggaacgaacgacgtacgacccgtaacctaacgtacctacctacgaaccgttagttaaccttaccgttagaaaccgtaaaagttaaccggaactacggtaccgtacggaagtacccgggaacccgtaaagggacctaccggttaccgtttagttttaactacggttgtaccgggtaacggaggtaacggggttaacggtcgtttacgggttttagggaacgggttttacgttacggttacccggtttcgtttaccgggtaacgttacccggggtcggggaacccggtttaacccggg

SEQ ID NO: 190222 - DNA, 931 bp, Homo sapiens
  misc_feature: GYAE6OF02I2P7H.36.10.A10.1.454.CMB.1.raw
tcagtacgctgtctcacgaccggtgctcgatttagcgtcgatctcagggggaggagccttagccctggactccaaggcctttccacttggtgatcagcactgagcacagaggactcaccatggaagttggggctgagcgttgggttttccttgttgtcttagttttggaaggtgtccagtgtgaggtgctaagttggtggagtcgtggggagccgtcgtcgagccgtggggtccagtgactactctcgtgtgtacgccttcgtagtaacctttccccgtttaacgtcgtttataggtatgacgtcgtcgggtcctaccgacggtccgtaccggaaggggtaacggggtcgtagggacgggttggggtaccggaacccaaagtaagtaaaacggacgaaaaggtaaggtaagggaaaagggtaaggggaagggttaagtaaggttacggtaaggtaagttcggttaggttaagggtaaccgggttaccgtttaccgaaacccgttaagttacccgtaccgaaaggtaacgtaaacccggtaaaccggaaccctaaaaacggttaaccccgttacccggtaagtcccgttaaaacgttcccggttaaaggaaaccgtaaaagttaccgggaaaacttaaccgggttacgtaaggggaaacgtaaccgggtaacccgggtaaagggtaaccccgtaaacggggtttaccttttaaacgtttttaaccggttaaccgtaaccggggtaccggtaaacgggtaaagggaaaacccgggtaaaggggtttcccgggttacggggttttaaccccggtttaaccggtaacccgggttaaccggggttaccggggaccccggttaaaaccgggggtccccgtttaccgggtaaccccgttaaccccggtttaccccgtacccggtaaccggtaaccccg

SEQ ID NO: 190223 - DNA, 977 bp, Homo sapiens
  misc_feature: GYAE6OF02IBH1G.36.10.A10.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagtacgctgtctcacgaccggtgctcgatttagcgtcgatctcgagggggaggagccttagccctggactccgaaggcctttccacttggtgatcagcactgagcacagaggactcaccatggaattggggctgacgcgttgggtttttccttgttgtcttagttttggaagtgtcagtgtgaggtgactaagttgggtagngttcggtgggggacggtccttcgtaccgnggtccggtcgggggtcctaggtacgactccttccgttggtcgtcgtcctacgttacgtaacccttttcccgttttaacggtcgttttagttacggattcggaggtccggttcggtcccggtaccgaggccgtaccgggaagggggagggtccggtaggggtacgggttggggtaccggaacctaaacgtaagtaaaagacgtaaaagtggtaaggtaaaaggggcggggtaagggtagttaaggtagggttaacggtaagtttcggtaggttacgggtaaacggtttccgttaacctacgtaacgtttccgtaaccggaaccggtaacgggtaaaccctaacccgaaaccgtaaacgggttaaccccgttaacccggttaccggtaaaccttaacgttaccggttaaaccggtaaacccgtaaaaggttaacccggttaacgttaacccggttacgttaacgggaacccggttaaacggggaccggtaaaccggggtaaccgttaaccggttttaaccgtttaacgtttttaaccgtttaaccgggccgggttaaacgggtaaccggtaaacgggtaaacgggggtaaacgggttaccggtttaccgggggtttaacgggtttttacccgggaacccgggttttaaccgggtaaccccgggggacccggttaaccccgggttaccgttacccgggttaccgtacccggtttcccgggtccctaccggtacccccggtaaccccg

SEQ ID NO: 190224 - DNA, 537 bp, Homo sapiens
  misc_feature: GYAE6OF01CQBAV.2.77.G11.1.454.CMB.1.raw
  modified_base (537)..(537): a, c, t, g, unknown or other
  misc_feature (537)..(537): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaaacagcctgaaaaccgaggacacggccgtgtatcactgtgttagagatcggagttggagctatgagtacgtggggccagggaaccctggtcaccgtctcctcagcctccaccaagggcccatccggtccttcccccgtcggccgccctcgcctccgacggacgccaccctccgagacgccacgacgccggcccgtgggcctgcccgtggtccgaacggacctaccgttcctgtcgacgtccgttctggacggcgggcgtgggcgaaggcgcagtgn

SEQ ID NO: 190225 - DNA, 533 bp, Homo sapiens
  misc_feature: GYAE6OF01DU3H5.2.77.G11.1.454.CMB.1.raw
  modified_base (434)..(434): a, c, t, g, unknown or other
  misc_feature (434)..(434): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccagggaaccctggtccaccgtctccctcacgccctccaccgaacgggcccagttccggtccttcccccgtgggcccgtcccctcgcctccgacgggcnccacctccgagacgcacgacgccggccctgggcctcggcctggtccaacggactacttcctgtccgacgtcgtctgaggcgggctggcaggcncagtgn

SEQ ID NO: 190226 - DNA, 527 bp, Homo sapiens
  misc_feature: GYAE6OF01DYKVQ.2.77.G11.1.454.CMB.1.raw
  modified_base (278)..(278): a, c, t, g, unknown or other
  misc_feature (278)..(278): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaccgnggacacggccgtgtatcactgtgttagagatcggagttggagctatgagtacgtggggccagggaaccctggtcaccgtctcctcagccctccaaccgaacgggcccagtccggtccttcccccgtgggcccgccctgcctcccgaggacgccacccgtccgagagccacagccggcccgtgggctgcctggtcaggctacgttcctcgtcgagcgtnggngcgggtctcggcgaacggcgacngtgng

SEQ ID NO: 190227 - DNA, 513 bp, Homo sapiens
  misc_feature: GYAE6OF01B94Z2.2.77.G11.1.454.CMB.1.raw
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagactcactgtatctgcacatgaacagcctgaaaaccgaggacacggccgtgtatcactgtgttagagatcggagttggagctatgagtactggggccagggaaccctggtcaccgtctcctcagcctccaccaagggcccactcggtccttccccctggcccgccctgcctcccagggacgccacctccgagacgcacagccggccctgggcctgcctggtcaaggactacttcctggtcgagcgtcnggacgcggcgtgggcagggcgcagtagn

SEQ ID NO: 190228 - DNA, 527 bp, Homo sapiens
  misc_feature: GYAE6OF01EU4XZ.2.77.G11.1.454.CMB.1.raw
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcgggagttggagctatgagtacgtggggccagggaaccctggtcaccgtctcctcacgccctaccaccgaacgggccccagttccggtccttcccccgtggcccgccctgcctcccgaggacgccaccctccgagacgcacagccggccctgggcctgccgtggtcaacggctacttcctgtcgagcgtctggcggcgggctcggcgaggcncgagtgn

SEQ ID NO: 190229 - DNA, 547 bp, Homo sapiens
  misc_feature: GYAE6OF01C1PE8.2.77.G11.1.454.CMB.1.raw
  modified_base (279)..(279): a, c, t, g, unknown or other
  misc_feature (279)..(279): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaaacagcctagaaaaccgnggacacggccgtgtatcactgtgttagagatcggagttggagctatgagtacgtggggccagggaaccctggtcaccggtctcctcagcctccaccgagggcccatccggtccttcccccgtggccgtccctgcctcccgaggacgccacccgtccgagacgcacgacggccggcccgtgggcctcggccctgggtaccaaggaccttaccttcccgtgtcgacgtccgtctggacggccgggcgtcgggccgaagggcgcgagtggc

SEQ ID NO: 190230 - DNA, 586 bp, Homo sapiens
  misc_feature: GYAE6OF01CW4RA.2.77.G11.1.454.CMB.1.raw
  modified_base (278)..(278): a, c, t, g, unknown or other
  misc_feature (278)..(278): n is a, c, g, or t
  modified_base (584)..(584): a, c, t, g, unknown or other
  misc_feature (584)..(584): n is a, c, g, or t
tcagacgctcgacacacgaccggtgctcgatttagctagtcactcaagggaaagggtgagactctcctgtgcagcctctggattcatcttcagtgactactacatggactgggtccgccaagctcagggaggggctggtgtgggtctcacgtattaatagtgatgggagtagcacaagctacgcggactccgtgaaggccgattcaccatctcagagacaacgccaagacacgctgtatctgacaaatgaacagtctgagagccgagacacggctgtntattactgtgcaagagatagcagcagctggtacgcgactcgtggggccaagggaccctggtaccaccgtctcctcacgtccctccaaccgacgggcccctagtcccggtcccttcccccgtcggcccgtcccgtcgtcctccgaggaccgccacccgtaccgacgacgaccgaccgacggccggccccgtgggccgtcggtccgtcggtacgaacggtaccttaccgttccgtcggtaccgtacggtccgttcggtacggtacgggtccggggacggttcgggaccggaacggacggacacgtggncg

SEQ ID NO: 190231 - DNA, 567 bp, Homo sapiens
  misc_feature: GYAE6OF01BDR7O.2.77.G11.1.454.CMB.1.raw
  modified_base (395)..(395): a, c, t, g, unknown or other
  misc_feature (395)..(395): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgaggacacggccgtgtatcactgtgttagagatcggagttggagctatgagtacgtggggccagggaaccctggtcaccgtctcctcagcctccaccaagggcccatcggtccttcccccnggccgccctgcctccgaggacgcaccctcgagacgcacacgccggccctggggcctcggcccgtggtaccaacggtacctacctttcccgtcggtccggaacggtccggttccgtgggaacggtcccggggtcgttacggggaccgtaaacggggccggaactagtaaggcg

SEQ ID NO: 190232 - DNA, 539 bp, Homo sapiens
  misc_feature: GYAE6OF01AP97S.2.77.G11.1.454.CMB.1.raw
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
  modified_base (500)..(500): a, c, t, g, unknown or other
  misc_feature (500)..(500): n is a, c, g, or t
  modified_base (528)..(528): a, c, t, g, unknown or other
  misc_feature (528)..(528): n is a, c, g, or t
  modified_base (538)..(538): a, c, t, g, unknown or other
  misc_feature (538)..(538): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtaatctgcacatgaacagcctagaaaaccgaggaccacggccgtgtatcactgtgttagagatcggagttgagctangagtactggggcacgggaacctggtcaccgtcncctcacgcctccacgacggccatccggtctccccctggcnccgtcgcctcgacggagccaccgtccgagcgcacgacggccgccgtcgggctcggccttgggtaccaaggtcctaccgttcctacgggtccgtaggtccggtntcggacggcgggtacgtggaccgacggngcctagacgng

SEQ ID NO: 190233 - DNA, 550 bp, Homo sapiens
  misc_feature: GYAE6OF01B8BAD.2.77.G11.1.454.CMB.1.raw
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (508)..(508): a, c, t, g, unknown or other
  misc_feature (508)..(508): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctgaaaaccgaggacacggccgtgtatcaactgtgttagagatcggagttggagctangagtacnggggccagggaccctggtcaccgtctcctcacgcctccaccaagggcccatccggtccttccccctggcccgccctgcctccgaggacgccacccgtccgagacgccacgacgccggccctgggcctcggccgtggtaccgaaggaccttaccttccgtcgtccggtacgcggttcncggacggccgggcgtcgggacgtaacgggccgacgagtgacg

SEQ ID NO: 190234 - DNA, 564 bp, Homo sapiens
  misc_feature: GYAE6OF01CO4Y6.2.77.G11.1.454.CMB.1.raw
  modified_base (370)..(370): a, c, t, g, unknown or other
  misc_feature (370)..(370): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggagaggctggagtgggttggccgtattagaaatgagcaagagttacagcacagactacgccgcgtctgtgaaaggcagattcaccatctcaagagatgattcaaaagactcactgtatctgcacatgaaacagcctagaaaaccgaggacacggccgtgtatctaactgtagttagagtagtcggaagttggaagtctagtgagtacgtggggacccagggaaccctggtccacgtctccntacgcctaccactacgggccagtcggtccttccccgtggccgccctgcctcaggcgcacctcgagagcacgacgccggccctgggacctcgccgttcggtacaacgggtaccttaccgttcctcggtcgaccggtacggttcgtaggacggtccggggtctacgggaccgaaaggggtccgaaccgtgtaggac

SEQ ID NO: 190235 - DNA, 554 bp, Homo sapiens
  misc_feature: GYAE6OF01BR559.2.77.G11.1.454.CMB.1.raw
  modified_base (428)..(428): a, c, t, g, unknown or other
  misc_feature (428)..(428): n is a, c, g, or t
  modified_base (554)..(554): a, c, t, g, unknown or other
  misc_feature (554)..(554): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccagggaccctggtccaccgtctccctcacgccctccaccgaacgggccccagtccggtccttcccccgtggcccgccctgcctccgaggacnccaccgtccgagacgcacacggccggcccgtgggcctcgccgttggtacaaggtaccttacgttcccgtggtaccgagtccgttgtcggcggccgggtcgtcgggaccgaacggtcgcgtaagtgn

SEQ ID NO: 190236 - DNA, 539 bp, Homo sapiens
  misc_feature: GYAE6OF01BBWMN.2.77.G11.1.454.CMB.1.raw
  modified_base (278)..(278): a, c, t, g, unknown or other
  misc_feature (278)..(278): n is a, c, g, or t
  modified_base (432)..(432): a, c, t, g, unknown or other
  misc_feature (432)..(432): n is a, c, g, or t
  modified_base (539)..(539): a, c, t, g, unknown or other
  misc_feature (539)..(539): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaccgnggacacggccgtgtatcactgtgttagagatcggagttggagctatgagtacgtggggccagggaccctggtccaccgtctcctcacgccctccaccgaacgggcccacgtccggtccttcccccgtggcccgccctcgcctcccgacgggacnccacccgtccgagacgcacgacgccggcccgtgggcctcggcctggtacaaggacctacttcctggtccgaggcgtctggcggcgggctcggcgaacggcgcagtgn

SEQ ID NO: 190237 - DNA, 733 bp, Homo sapiens
  misc_feature: GYAE6OF01EBIIR.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccgagggaagaggctggagtgggttggccgtattagaaatagagccaagagttacagcacagactacgccgcgtctgtgaaaggcagattcaccatctacaagagatgattacaaaagaactcacttgtatctgacacatagaacagacctaaggaaaacccggacggaaccaccggccgtagtactaccacgttgtagttaggagtagtcggtaggttggagtctagtgaggtacgtcgggggacccgaagggtaaccctggtacccaccgtctcccgtcaccgccctacccgaaccgacgggcccctacgtcccggttcccttccccccgtcggtccccgtccccgtacgtcccgtacccggaacgggtcccgacccgtaccccgtaccggaacggaaccgacccgaacccggaccgggaccccggggtccccgtacgggggccccttccgggtaccccggttacgggtaaccgtaaccggttacccgtttaacccggttcccgttaccgggttaccggtaaccgggtcccggtttacggaccgggtaccggggtccggggtaccggtaccggggtaccgaacgggtcccggaacgtacggtcgacg

SEQ ID NO: 190238 - DNA, 574 bp, Homo sapiens
  misc_feature: GYAE6OF01B2YQ0.2.77.G11.1.454.CMB.1.raw
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (411)..(411): a, c, t, g, unknown or other
  misc_feature (411)..(411): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaaccgnggacacggccgtgtatcactgtgttagagatcggagttgganctatgagtacgtggggccagggaaccctggtccaccgtctcctcagccctccaccgaagggcccacgtccggtccttcccccgtggcccncccgtgcctccgacggacgccacccgtccgagacgcacgacggccggcccgtgggcctcgccgttcggtaccgaacgggtaccttaccgttccgtcggtccggacggtccgttcgtcgggacggccggggtcgtcggggaccgtaacgggccgacgagtggac

SEQ ID NO: 190239 - DNA, 601 bp, Homo sapiens
  misc_feature: GYAE6OF01D9P52.2.77.G11.1.454.CMB.1.raw
  modified_base (368)..(368): a, c, t, g, unknown or other
  misc_feature (368)..(368): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagacctagaaaaccgaggacacggccgtgtatcactgtagttagagatcggagttggagctatgacgtacgtggggaccagggaaccctggtccaccgtctcctcncgccctccaaccgacgggccctacgttcccgtccttcccccgtggcccgtccctgcctcccgaggcgccacccgtcgacgacgccacgacgcccggcccgtacgggcctcggcccgttagggaccgaacggtcccttaacccgttccgttaggtacccgacggtcccggttacgtcggggacggtacccggggtcgtacggggaccgtaaacggggcccgtaacgtagtcgga

SEQ ID NO: 190240 - DNA, 644 bp, Homo sapiens
  misc_feature: GYAE6OF01CZLTZ.2.77.G11.1.454.CMB.1.raw
  modified_base (284)..(284): a, c, t, g, unknown or other
  misc_feature (284)..(284): n is a, c, g, or t
tcagacgctcgacacacgaccggtgctcgatttagctagtcactcaagggaaagggtgagactctcctgtgcagcctctggattcatcttcagtgactactacatggactgggtccgccaggctccgagggaagaggctggagtgggttggccgtattagaaatagagccaagagttacagcacagactacgccgcgtctgtgaaaggcagattcaccatctacaagagatgaattacaaaagactcactgtatctgcaacatagaacagcctaagaaaaccgnggacacggccgtagtactcacgtgtagttagagagtcgggaagttggagctagtgacggtacgtcgggggaccgaacgggtaaccctgggtacccacccggttcctcccgttacgacgtcccctacccgaacccggaacgggcccctacggtcccgttacccgttcccccgcgggcccgtcccgtgccctccgaggaccgccctacccgtccgacgacgaccgacgacgggcccgtacccggtcgggacctcggcccgttcggtacgtaacggtacccttaccgttccgtacggtccgtacggtccgttcggtacggacgggccggggtcgtcgggtaccgaacgggcgtacgagtgacg

SEQ ID NO: 190241 - DNA, 830 bp, Homo sapiens
  misc_feature: GYAE6OF01BL3SV.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctacaagagatgattcaaagaactcactgtatctgcacatagaacagacctagaaaaccgaggacacgggccgtgtatccgacgtgtagttagagtagtcggtaggttggacgtcttaagtggtaacggttacggtcgggggacccgaagggggtaaaccccgttgggttacccgtaacccggttccttaccccgtacccgaaccggtacccccgttaccccgaaacccggtaaacccgggggtaccccctaaccggttccccgggtttaccccctttccccccccggttccggggtcccccggtacccccgttccggtcccgtttaccccggaacgggtacccggtaccccgtaacccccgttaccccgggaacggaacccgggacccaacccgggaaccgggccccggggtacccccggttcgggggtaccccttccggggtcccccgtttacgggggtaacccggaaaccgggtaacccttttaccccggtttcccgttcgggttacccgggtaacggttcccgggttaccggttaacggggtacggggtcccgggggtaccgtacgggggtaccccggaacggggtaccccgaacgaggtaacgcgg

SEQ ID NO: 190242 - DNA, 547 bp, Homo sapiens
  misc_feature: GYAE6OF01DEYZW.2.77.G11.1.454.CMB.1.raw
  modified_base (278)..(278): a, c, t, g, unknown or other
  misc_feature (278)..(278): n is a, c, g, or t
  modified_base (417)..(417): a, c, t, g, unknown or other
  misc_feature (417)..(417): n is a, c, g, or t
  modified_base (442)..(442): a, c, t, g, unknown or other
  misc_feature (442)..(442): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
  modified_base (547)..(547): a, c, t, g, unknown or other
  misc_feature (547)..(547): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattacaaaagactcactgtatctgcacatgaacagcctagaaaaccgnggacacggccgtgtatcactgtgttagagatcggagttgagctatgagtacgtcggggaccacgggaaccctggtaccaccgttctccctcacgccctacccaccgaacgggcccctaagtccggttcccttcccccgnggcccgtccctgcctccgagggacncctacccgtccgagcgccacgcgccggcccgtgggcctgccgtgacaggtaccttacttccgngtcgacgtcgtnggacggcgggctggccgaaggcacgagtgn

SEQ ID NO: 190243 - DNA, 598 bp, Homo sapiens
  misc_feature: GYAE6OF01A1919.2.77.G11.1.454.CMB.1.raw
  modified_base (597)..(597): a, c, t, g, unknown or other
  misc_feature (597)..(597): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagacctagaaaaccgaggacacggccgtgtatcactgtagttagagatcggagttggagctatggagtacgtcggggccagggaaccctggtccaccgtctcctcacgcctccaacgacggcccacgtccggtccgttccccctcgggtcccgtcccgtcgcctccgacggacgccacccgtccgacggacgccaccgacggtccgggacccggtcgggccgtccggtcccgtacgggttaccgaaccggtaccgttaccgttcccgtacggtaccgtacggtccggttcgtacggccggtcggggccgtcgggacgaacgggccgcagtacgng

SEQ ID NO: 190244 - DNA, 612 bp, Homo sapiens
  misc_feature: GYAE6OF01A4RYP.2.77.G11.1.454.CMB.1.raw
  modified_base (461)..(461): a, c, t, g, unknown or other
  misc_feature (461)..(461): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctacaagagatgattacaaaagactacactgtatctgcacatgaacagcctagaaaaccgaggacacggcgtagtactctacgtgtagttaggagtagtcggagttggatctagtggagtacgtggggaccgaacgggaccctggtaccaccgtcctccgtacacgtccctaccgaccgaacgggcccctaagtcccggtcccttcccccgtggcccgtcccgtcgcctacccgagggaccnccctacccgtccggagaccgacaccgacggccggtcccgtgggcctcgtccgttcggacgtaacgtccttaccgttccgtcggtaccgtacgtccggttactcgggacggtccgggtaccgtgggtaaccgacgggtaccggctaggtgcg

SEQ ID NO: 190245 - DNA, 623 bp, Homo sapiens
  misc_feature: GYAE6OF01BQSH0.2.77.G11.1.454.CMB.1.raw
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (620)..(620): a, c, t, g, unknown or other
  misc_feature (620)..(620): n is a, c, g, or t
tcagacgctcgacacacgaccggtgctcgatttagctagtcactcaagggaaagggtgagactctcctgtgcagcctctggattcatcttcagtgactactacatggactgggtccgccaggctccgagggaagaggctggagtgggttggccgtattagaaatagagccaagagttacagcaacagactacgccgcgtctggtgaaaggcagattcaccatctacaagagatgattacaaagaactcaactgtatctgcacatagaacacgacctaacggaaaaccggaggaccacggtccgtgtactcgacttggtagttagagagtcgggtagttcggagtctagtggaagtacggtggggaccgaacgggtacccgtgggtaccacccggtctcccgacgacgtccctacccgaaccgaaccgggccctacgtccggtccccttccccgtggccctcccgtgccctcgacgggaccncctacccgaccgganaccganacccgacgggtcccgccgtggcctcgggccgttgggacctacggtcctacgttcccgtggtacccggtaggccgtacggtccggagggcccgggtcgagggaccgacggtacgctagnggc

SEQ ID NO: 190246 - DNA, 872 bp, Homo sapiens
  misc_feature: GYAE6OF01E0MGL.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccgagggaagaggctggagtgggttggccgtattagaaatagagccaagagttacagcacagactacgccgcgtctgtgaaaggcagattcaccatctacaagagatgattacaaagactacatgtactctagcatatagaacacgacctaacggaaaaccggaacggaaccgaccgggtaccggttagtacgtaccgtacgttaggtggttaacggtaggtaacgttcggggttaaggttacgggtacgtacgttacgtaggtaacggttacggtacgggggacccgtaacggggtaacccgttcggttaccccgaccggttccctacccgtaccgaccgtccccgttaacccaacccgggtaaccgggtcccctaaccgggttttcccccggttcccccgtttaccccccgggtcgggtaccccccggttcccgtaccggtccccgtaaccccgggtaacggggtcccctacccggtaaccccgtaccggaaacgtccgggaacccgttaacccgggccggtccccggggttacccggaggggtcccttaccgggcccggtttaaaccggggtaccgtaaaaccgggttacccctttaccgggtttaccccgggttacggtaacccggggttaccggttacccggggtttacccgggaacgggggttaccccggggtacccggggttaaggggttaccccggaaaaccggggttccgggggtaccctaacgggtcgtaacgggtcc

SEQ ID NO: 190247 - DNA, 849 bp, Homo sapiens
  misc_feature: GYAE6OF01EEDFE.2.77.G11.1.454.CMB.1.raw
  modified_base (263)..(263): a, c, t, g, unknown or other
  misc_feature (263)..(263): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacngcctagaaaccgaggacacggccgtagtatcacttgtcgttagagtactcggtagttggaatcgtaattggacgttacggtcgggggaccaacgggggtaaccccctgggtaccctaacccgttcctaccccgttacgaccgtccccgtccccgaaacccgaaccggggtacccctaaccgttacccgggttccccgtttcccccccggtccgggtccccgtacccccggttccggtccccgttaccccggaaccgggtaccggtacccctaaacccccggtaccgggaccggtaaccggcccgaaccggaaccgggtccccggggtaccccggttaccgggggtcccgttacccggggttcccccggtaccggggttaaccccggtaaaccggggttaaccccggtttaaacccgttttacccccggttacggggtttaccccgggtaacccgggttcccggttttaacccgggttaccgggtacccggggttaccccgggggggtcccggttttacccggggggaacccggttaaaccggggggtaccccgggttaacccgtaaaccggtaacgggttacccgg

SEQ ID NO: 190248 - DNA, 645 bp, Homo sapiens
  misc_feature: GYAE6OF01A5OJY.2.77.G11.1.454.CMB.1.raw
  modified_base (183)..(183): a, c, t, g, unknown or other
  misc_feature (183)..(183): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcanagactacgccgcgtctgtgaaagcagattcaccatctacaagagatgattacaaagaactcactagtatctgcacatagaacagcctaagaaaccggaggacacggaccgtgtactcactggtagtagagtagtcggagttggagtcgtagtgagtacgtcggggaccgacgggtaaccctggtacctaccgtcctcctcgaccgtcccctacccaacccggaaccgggtccctacggttcccgttaccccttcccccgtcggcccctacccgtctcccgtaccgacggaccgacccgacccgtccggacgacgaccgacgacgggcccggtccgtcgggacctccggtaccgtacgggtaccaacgggtacccttacgttcccgtcggtacggtacgtcccggtagttacggggcggtcccggggtcgtacgggaacggtacgggaaccgtgtaaagtgcg

SEQ ID NO: 190249 - DNA, 538 bp, Homo sapiens
  misc_feature: GYAE6OF01AL341.2.77.G11.1.454.CMB.1.raw
  modified_base (168)..(168): a, c, t, g, unknown or other
  misc_feature (168)..(168): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctgggagtgggttggccgtattagaaataganccaagagttacagcacagactacgccgcgtctgtgaaaggcagattcaccatctcaagagatgattcgaaaagactcactgtanctgcacatgaacngcctagaaaccgngacacggcctagtactcactggtagttacgagagtcggaaggttcgagtactagtgacgtacgnggggccaggacctggtcacgtcncctagacncctaccacgacggccagtccggtcctccccgngcccgctcgctccgaggcnccgacctcgagacgcacgacgccgacgtgggctccggcgtggaccacggtcctacgttcgtgacgaccggtcgtcgaggccggtccggcgtacggacgtaggccgtacngcggn

SEQ ID NO: 190250 - DNA, 715 bp, Homo sapiens
  misc_feature: GYAE6OF01BKJDG.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtagaaaggcagattcaccatctcaagagatgattacaaagactcactgtatctgccacatacgaacacgcctaggaaaaccggaggaccacgggtccgttagtactcgacgttgtaggtttaagagtagttcgggtaaggttcggagtccgttaggtcggtaacggtacggtacggggggacccgtaacgggggtaaccccgttgggtacccaacccggtttcctaccccgttacgaccggtcccctaccccgaaccggaaccgggaccccgtacgttcccggttaccccgttccccccgtcgggccccgtcccgtcgtacccgtccgacggtaccgtacccgacccgtaccggacgacgaccgaccgacggacccgggtcccgtccgggaccgtccggtaccgttcgggtaaccgtacggtacccttaccgttacccgttcggtaccggtacggtccggtacggtcggtacgggccgggtacggtcgggaaccggacgggacgtcgtaggtgcg

SEQ ID NO: 190251 - DNA, 723 bp, Homo sapiens
  misc_feature: GYAE6OF01B2SIJ.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctacaagagatgattacaaagactcactgtatctgcacatacgaacacgacctaggaaaaccggaggaccgaccgggtccgtagtactcctacgttggtaggttagagtagttacgggtagttggaacgtcgtagtaggtagttacgggcggggacgaaccgggtacccgtgggtaccctaccgtcctcccgtacgaccgtcccctacccgaaccggaaccgggtccccgtacgttacccggttccccgttccccccgtcgggcccccgtccccgttcgtcccgttacccgaacgggtaccgaccccgtaacccgtacccggaacggtacgaccgaacccggtacgggccccgggtaccccgggtgggtacccgtccggtaccggttcgggtaaccgaaccggttacccttaccggttcccgtacgggtaccggtacgtccgggttacggtcgggtcccgggtacggggtcgtccgggtacggaacgggtccgacgtacgtggc

SEQ ID NO: 190252 - DNA, 712 bp, Homo sapiens
  misc_feature: GYAE6OF01BBE03.2.77.G11.1.454.CMB.1.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtagaaaggcagattcaccatctacaagagatgattacaaagactcactgtatctgcacatgaacngcctaggaaaaccgnggacaccgggtccgtgtactcctacgtggtagttagaggtagtcgggagtttcggagtctaagtggaacgttacggtcgggggacccgtacggggtaacccgtgggtacccaccggttcctcccgtacgaccggtcccctacccgaaccggtaaccggggtcccctaacggttccccgggttaccccttccccccggtgggcccccgtcccgttcgcccgtacccggacggtaccgcccaacccgtccgggaagaccgaccaccggacggcccggtacccggtcggggtccttcggtcccggttacgggtaaccgtaacggttaccgttaccccgttccgttggggtacccggacggttcccggttcggacgggtacgggttccccggggacgttccggggaacccggaacggggcccgtaacgtaggtgcg

SEQ ID NO: 190253 - DNA, 607 bp, Homo sapiens
  misc_feature: GYAE6OF01E2393.2.77.G11.1.454.CMB.1.raw
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggagaggctggagtgggttggccgtattagaaatgagccaagagttacagcacagactacgccgcgtctgtgaaaggcagattcaccatctcaagagatgattcaaagactcactgtatctgcacatgaacagcctagaaaaccgngacacggccgtgtatcacttgngttagagatcggagtttgagctatgagtacgtggggcccaagggaccctggtcacccgttntccgtcacgccctaccaccgaacgggcccacgttccggtcccttcccccgtggcccctcccgtcgcctcccgagggacgccaacccgtccggaagtacgaccaccgacggcccggcccgtcgggccttcgcccgtgggtaccaaagggtaccctttaacccgtcccttcggtaccggtacggtcccggttacgtcggtaaccgggccgggggtaccgttaccggggcgaaacgggtccgcgtaagtagcg

SEQ ID NO: 190254 - DNA, 745 bp, Homo sapiens
  misc_feature: GYAE6OF01AGKY3.2.77.G11.1.454.CMB.1.raw
  modified_base (741)..(741): a, c, t, g, unknown or other
  misc_feature (741)..(741): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctacaagagatgattacaaagaactcactgtatctgcacatagaacagcctagaaaaccgaggaccgacgggccgtgtatcacgttggtgttaagagagttcgggtagttggagtcgtagtggacggttacggtcggggacccgaacggggtaaccccgtggtacccgtacccggttctccctacgaccgtccctacccgaacccgtaacggggtcccctaaggttccccggtttccccgttcccccggtcgggaccccgttccccgtcggtccccgttacccggaacgggtccaccccgtaacccccggtaccggacggacccggtaccgaaccggtccgggccccgggtcccgggtcgggtcccgttaccgggaccgtttaaccgggaaccgtaaacgggttacccctttcccggtttacccgtcgggtacccggtacggtccccggttaggttacccgggggaccgggccggggttacccggtacggggtaaccggtaacggggcccggattaaacggnggag

SEQ ID NO: 190255 - DNA, 680 bp, Homo sapiens
  misc_feature: GYAE6OF01ELZI6.2.77.G11.1.454.CMB.1.raw
  modified_base (478)..(478): a, c, t, g, unknown or other
  misc_feature (478)..(478): n is a, c, g, or t
  modified_base (641)..(641): a, c, t, g, unknown or other
  misc_feature (641)..(641): n is a, c, g, or t
  modified_base (669)..(669): a, c, t, g, unknown or other
  misc_feature (669)..(669): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattacaaagaactcactgtatctgcacatagaacagacctagaaaaccgaggaacacggtccgtagtatcacgtgtacgttagagtagtacggtaggttggagtactagtggtaaggtacggtacgggggaccgtaacggggtaacccgtcgggtaccgtaacccgtcctacccgtaccgaaccgacccttaccccgaacccggtaaccgggtcccctaacgttccccggttccccttaccccccggngggtccccctaccccgtcgtccctacccgggtaacgccgacccgtaccccgtacggacgtaccaccggtaccacgggccccggaacccggtgggcttaccggccgttggaaccgtaacgtaccttaccgttccgtcggtacgaccgtccggttgtaaccgggngggtccgggtcgacgggacgaaccgggnactaggtcacg

SEQ ID NO: 190256 - DNA, 660 bp, Homo sapiens
  misc_feature: GYAE6OF01B5UOD.2.77.G11.1.454.CMB.1.raw
  modified_base (331)..(331): a, c, t, g, unknown or other
  misc_feature (331)..(331): n is a, c, g, or t
  modified_base (645)..(645): a, c, t, g, unknown or other
  misc_feature (645)..(645): n is a, c, g, or t
  modified_base (651)..(651): a, c, t, g, unknown or other
  misc_feature (651)..(651): n is a, c, g, or t
  modified_base (656)..(656): a, c, t, g, unknown or other
  misc_feature (656)..(656): n is a, c, g, or t
tcagacgctcgacacacgaccggtgctcgatttagctagtcactcaagggaaagggtgagactctcctgtgcagcctctggacttcatcttcagtgactactacatgactggtccgccaggctcgagggaagaggctggagtgggttgcgtattagaaatgagccaagtagttacagacacaggacctacgcccgtcgttctggtagaaacgggcaagtactacaaccatctacaagtagtactgtattacgaaaacgactcaactgtactctacgactacgaactacaacgtacgacctaaggaaaaccgacggacgaccggccgtactnaccgtacgtgttacgtagagtagtcggttaggtcggagacttagtaggacgttcgggacgggaccgtaacggtaccgttacgccgtaccgttccgttccgactccgtcccgtaaccgaacccggaccggtaaccccgtacgttacccggttaccccgtttccccgcggtcccctaccgttcgacccttacggccgacgtaccacccgtacgacgcgaccacgtaccggccgtccggcgtcgacgtccggtacggagtacctccgttactaccgtggtaccggacgtccgtgaccggtcgggcggttgcggaacnggaccngacgngtcg

SEQ ID NO: 190257 - DNA, 737 bp, Homo sapiens
  misc_feature: GYAE6OF01COFIS.2.77.G11.1.454.CMB.1.raw
  modified_base (721)..(721): a, c, t, g, unknown or other
  misc_feature (721)..(721): n is a, c, g, or t
  modified_base (735)..(735): a, c, t, g, unknown or other
  misc_feature (735)..(735): n is a, c, g, or t
tcagacgctcgacacacgaccggtgctcgatttagctagtcactcaagggaaagggtcgagactctcctgtgcagcctctggattcatcttcagtgactactacatggacgtgggtcccgccgacggcctcccgaagggggaaggagggcctgggacggttggggttcggaccgttaattaagaaatagacgaccaagtacgtacagcacaggacctacgccgtcgtctggtagaagcagtacttacacctatcctacaagagtatgtaacttacaaacgtctacatgtactcgtagactacgatacgaactacgacgtaacgaaacggaggaccacggtacctagtactactacgtcgttaggtagtagacgtagggtacgtaggactcgttaagtcggtaggttaccggtacgggggacccgaaaccggggtacccgttaaggtcccgtaaccgtcccgttacccgtacaccccggtacccgtaacccggacccggtaaccgggtacccttaccgggtccccgtttcccccgttaccccccggcggtcccccgttacccgtaccggtccccgtaccgggaaccggtcccgtacccgaccccggtcgtaaccggaccaccgtaccggaccggtcccggccggtcgggtaccgtccgtaccggtaccgttaacggaacccgtacgttcctacgcgttcgacgtcgtagcggcggtggacgnggtcgaagcgcagngc

SEQ ID NO: 190258 - DNA, 878 bp, Homo sapiens
  misc_feature: GYAE6OF01EBCD7.2.77.G11.1.454.CMB.1.raw
tcagacgctcgacacacgaccggtgctcgatttagctagtcactcaagggaaagggtgaggctctcctgtgcagcctctggattcatcttcagtgactactacatggactgggtccgccaggctccgagggaagaggctggagtgggttggcgtattagaaatgagccaagagttacagcacagactacgccgtcgtctgtaggaaaggcagtacttccaacctatctacgaagagatgtaattacgaaaagtaacctacacgttagttaactctacgacctaacctagtaacgaaaccacgtacccgtaaacggaaaaccggacggtaaccgaccgggtccgtagtactccgtacgttagttaggttaggatacggtacgggtagttacggaacgtcgttaaggtaggtacggttacggtaccgggggacccggtaaaccggggtacccgttacgggtacccgttacccggttacccgttacccgtccgaacccgttcccccgtaaccccgaacccgggaacccgggtacccctaccgggttacccccgttcccccggttacccccggtccggtacccccggtccccttaccggtacccgtacccggaaccggacccgtcccgtaaccccgtacccgggaacggaccgacccggaaccggacccgggtccccgggtaccccgggtccgggttacccgttcccgggtacccgggtttacggtaaacccgtaacccgggttccctttaacccgggtttccggtacccgggtaacgggtacccggttcgggtacccgggtaccgggggttacggggtaccccggggtacggtacccgggggtaaccggtaacccgggacggtaccggtaacgtaaggcgg

SEQ ID NO: 190259 - DNA, 786 bp, Homo sapiens
  misc_feature: GYAE6OF01CIJV2.2.77.G11.1.454.CMB.1.raw
  modified_base (519)..(519): a, c, t, g, unknown or other
  misc_feature (519)..(519): n is a, c, g, or t
  modified_base (781)..(781): a, c, t, g, unknown or other
  misc_feature (781)..(781): n is a, c, g, or t
tcagacgctcgacacacgaccggtgctcgatttagctagtcactcaagggaaagggtgagactctcctgtgcagcctcgtggattcatcttcagtgactactacagtggacgtgggtccgccgaggctccgaagggaagaggcgtaggaggtgggttcggacgttattagaaatagacgaccaagacgttacaagacaacgagaacctaccggcccgtacgttctaggtaaggaaacggccagtacttaccacctatctacgaagagatagtattacgaaaagtactactacgtagttactcgtacgacctactaacgtacgaaccgacggtaaccgtaaacgggaaaaccccggacgggaacccggtaccgggtaccgttaaggtacctaccgtaacgttggtaaggtttaacgaaggttacgttacgggaggttcggaagtaccgtaagtacggtacggttcgggacggggaccgtaaccgggttaccgtcggtaccgtacccgttctcccgtaacnccggttaccccacccgtaaccgaccggtaccctaccgttcccgttcccgtccccggtaccgccctccgtcgaccgttaccgacgaccgtaccgtaccgtacgaacgcgaccgacgaccgggtcccgggaccggtcgggtccgtccggtccggttacggtaccggtaaccggtaccgttaccgtttaccgtcggtaccggtaggtccgtacggttcgggccgggtaccggacgggtacggaccgggtacgaccggacgtacgnggtcg

SEQ ID NO: 190260 - DNA, 648 bp, Homo sapiens
  misc_feature: GYAE6OF01EN7N7.2.77.G11.1.454.CMB.1.raw
  modified_base (327)..(327): a, c, t, g, unknown or other
  misc_feature (327)..(327): n is a, c, g, or t
  modified_base (574)..(574): a, c, t, g, unknown or other
  misc_feature (574)..(574): n is a, c, g, or t
  modified_base (613)..(613): a, c, t, g, unknown or other
  misc_feature (613)..(613): n is a, c, g, or t
  modified_base (646)..(646): a, c, t, g, unknown or other
  misc_feature (646)..(646): n is a, c, g, or t
tcagacgctcgacacacgaccggtgctcgatttagctagtcactcaagggaaagggtgagactctcctgtgcagcctctggattcatcttcagtgactactacatggactgggtcccgccaggctccgagggaacgaggctggagtgggttggccgtattagaaatgagccaagagttacagcacagactacgccgcgttctggtagaaaggcagattcaccatctacaagagatagtattacaaagtaactcactgtatctgaccaactatgaaacacgtaccctaacggaaaaaccggacggaaccgtacgggtccgttagtacnccaacgttggtaggtaagaaggacgtcgggtagttacggagacttaaggtgtacggtacggtcgggggaccgtaacggggaacccttgggtacccaccgtctaccgacaccggtcccctaccgaccgaacgggtccctacggtccccgttcccttacccccggcgggtccctaccccgtccgctacccggaacggcctaccgtacccgtcggacacgcaccgacggtccggaccggtcggcgtccgngtacgacgaacgtactccggttctggcgtagtccgtcgnggtcggcggtcgcggtacggacggacgagtacngc

SEQ ID NO: 190261 - DNA, 781 bp, Homo sapiens
  misc_feature: GYAE6OF01DLGDC.2.77.G11.1.454.CMB.1.raw
  modified_base (152)..(152): a, c, t, g, unknown or other
  misc_feature (152)..(152): n is a, c, g, or t
  modified_base (780)..(780): a, c, t, g, unknown or other
  misc_feature (780)..(780): n is a, c, g, or t
tcagacgctcgacacacgaccggtgctcgatttagctagtcactcaagggaaagggtgagactctcctgtgcagcctctggattcatcttcagtgactactacagtcggacgtcgggtccgccacggctccgaagggaacggaggcgtgggnggttggggttcggaccgttaagtttaaggaaaagtaggaacggaccaaaggtaagttacaacgccaacgaagaaccgtaccgccgcgttccgtggtaggaaacggcaagtacttaccacctatactacgaagagtatagtacttaacgaaagactcacgttgtactgtacgacactagtagaacacgacctaacgaaaccgaggacgacggcgtgtactctagtgttagtagagtagtacggtaggtaggacgtacgtagtacggtacggtacggtcgggaaccggtaccggtaacccgtcggtccgtacccgtccgtccctacgtaccgcccgtaacccgaaccggtaccggcccttaccggttccgttcccccgtttaccccggcggtaccccgtcccgttgcccgtaacccggagggtacccgtcccgaacccggtacggaaccgaaccgttccggaaccggcccgggtacccggtccggtttacccgggccgttacccggttaacggtacccggtaaacgtaccggtttacccgttaacccgtccgttacggtaccgtccgggtcgttaccgggacgggtcccgggaccggtaggtaccggacggacggaccgtaggtaagcgng

SEQ ID NO: 190262 - DNA, 227 bp, Homo sapiens
  misc_feature: GYAE6OF01E4QVE.2.77.G11.1.454.CMB.1.raw
  modified_base (189)..(227): a, c, t, g, unknown or other
  misc_feature (189)..(227): n is a, c, g, or t
tcagacgctcgacacacgaccggtgctcgatttagctagtcactcaaggggaaagggtgagactctcctgtgcagcctctggattcatcttcagtgactactacagtggactgggtccgccaggtctccgaggggaagacggctagggaggtggggttgacgtattaagaaagtagagaccaaggtagnnnnnnnnnnnnnnnnnnnnnnnnnnnnnnnnnnnnnnn

SEQ ID NO: 190263 - DNA, 495 bp, Homo sapiens
  misc_feature: GYAE6OF02GLJLA.2.77.G11.1.454.CMB.1.raw
  modified_base (412)..(412): a, c, t, g, unknown or other
  misc_feature (412)..(412): n is a, c, g, or t
  modified_base (495)..(495): a, c, t, g, unknown or other
  misc_feature (495)..(495): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgaggacacggccgtgtatcactgtgttagagatcggagttggagctatgagtactggggccagggaaccctggtcaccgtctcctcagcctccaccaagggcccatcggtcttcccctggcgccctgcctccaggacncacctccgagagcacagccggccctgggctgcctgtcaggactacttcctgtcgagcgtctgagcggctggcaaggcgcatgn

SEQ ID NO: 190264 - DNA, 577 bp, Homo sapiens
  misc_feature: GYAE6OF02FZ6P7.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgaggacacggccgtgtatcactgtgttagagatcggagttggagctatgagtactggggccagggaaccctggtcaccgtctcctcacgcctccacaacgggcccatcggtccttcccccgtggccgccctcgcctcccgaggacgccacctccgacgacgccacgacgccggcccgtggggcctcggcccgttcggtccgaaacggtacctaccgttcccgtcgttccggaacggtccggttaccgttcggtacgggccggggtccgtcggggccgaaacggggtccggacgtacgtaggcg

SEQ ID NO: 190265 - DNA, 534 bp, Homo sapiens
  misc_feature: GYAE6OF02H3R4V.2.77.G11.1.454.CMB.1.raw
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
  modified_base (534)..(534): a, c, t, g, unknown or other
  misc_feature (534)..(534): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgaggacacggccgtgtatcactgtgttagagatcggagttggagctatgagtacgtggggccaggggaaccctggtcaccgtctcctcagcctccaccaacgggcccagtccggtccttcccccgnggccgccctgcctccgaggacgccaccctccgagacgccacaggcccggcccgtgggcctcggcccttggtccaaacggtcctacgttcctgtcgagcgtcnggacgcgggcgtcggcgaacggcgacgatagn

SEQ ID NO: 190266 - DNA, 507 bp, Homo sapiens
  misc_feature: GYAE6OF02GLF3F.2.77.G11.1.454.CMB.1.raw
  modified_base (416)..(416): a, c, t, g, unknown or other
  misc_feature (416)..(416): n is a, c, g, or t
  modified_base (489)..(489): a, c, t, g, unknown or other
  misc_feature (489)..(489): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctgaaaaccgaggacacggccgtgtatcactgtgttagagatcggagttggagctatgagtactggggccagggaaccctggtcaccgtctcctcacgcctccacaagggcccatcggtccttcccctggccgccctcgctccgaggacncacctccgagacgcacacgccggccctgggctgcctggcaaggacctacttcctgtcgagcgtctgacgcggntcggcaaggcgcagtagc

SEQ ID NO: 190267 - DNA, 519 bp, Homo sapiens
  misc_feature: GYAE6OF02HN27Y.2.77.G11.1.454.CMB.1.raw
  modified_base (519)..(519): a, c, t, g, unknown or other
  misc_feature (519)..(519): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaccgaggacacggccgtgtatcactgtgttagagatcggagttggagctatgagtacgtggggccagggaccctggtcaccgtctcctcagccctccaccgaaggcccactccggtccttcccccgtggcccgccctcgcctccgaggacgccaccctccgagacgcacacgccggccctgggctgcctggtcaaggcttacttcctgtcgagtcgtctgacgcgggctggcgaaggcgacagtgn

SEQ ID NO: 190268 - DNA, 582 bp, Homo sapiens
  misc_feature: GYAE6OF02IBMDN.2.77.G11.1.454.CMB.1.raw
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (581)..(581): a, c, t, g, unknown or other
  misc_feature (581)..(581): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgaggacacggccgtgtatcactgtgttagagatcgggagtttggagtctatgaagtacgtggggccaggggaaccctggtcaccgtctcctcacgccctccaccgaacgggcccagtccggtccttcccccgnggccgccctcgcctccgaggacnccacctcgagcgccacgacggccggcccgtgggcctcggcccgttggtaccgaaacggtaccttaccgttcccgtaggtccggacggtccgttccgttgggaacgggtccggggtcgtcggggaccgaaaggggtcccgacgtagtacggng

SEQ ID NO: 190269 - DNA, 588 bp, Homo sapiens
  misc_feature: GYAE6OF02GTL5V.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaacccgaggaccacggccgtgtatcactgtgttagagatcggagtttggagctagtgaagtacgtgggggaccaaggggaaccctggtccaccggttctcctcacgccctacccaaccgaacgggcccagtccggtccttcccccgtgggcccgtccctcgcctcccgagggacgccacccgtccgagacgccacgacgccggccctcgggcctcgccgttcgggtaccgaaacgggtaccttaccgttccgtacggttccgacggtccgtcgtggacggcggggtcgtcgggacgtaacgggcgacgagtaggc

SEQ ID NO: 190270 - DNA, 595 bp, Homo sapiens
  misc_feature: GYAE6OF02IOSZ1.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatagaacagcctaagaaaaccgaggacacggccgtgtatcactgtgtagagtagtcggagttggagtctagtgagtacgtcgggggaccacggggaacctggtaccaccgtctccctcgacgtccctacccgaaccgaccgggccctaacgttcccggtacccttcccccgtcggcccgtccctcgtcctcccgaggtacgccacccgtccgagacgcacgacggcccgtcccgtgggcctcggccgttggtacgaacggtaccttacgttccgtgtccgacggtccgttacgtggtacggcgggtcgtcgggacgtaacgggccgtacgtacgtgcg

SEQ ID NO: 190271 - DNA, 536 bp, Homo sapiens
  misc_feature: GYAE6OF02II53O.2.77.G11.1.454.CMB.1.raw
  modified_base (426)..(426): a, c, t, g, unknown or other
  misc_feature (426)..(426): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagactcactgtatctgcacatgaacagcctagaaaaccgaggacacggccgtgtatcactgtgttagagatcggagttggagctatgagtacgtggggccagggaaccctggtcaccgttctcctcacgccctccaccgaacgggcccagtccggtccttcccccgtggcccgccctcgcctccgaggcnccgacctccgagcgcaacacggcgcccgtgggctcgccgtgtcaacggacctacttccgtgtcgagtcgtctggcggcgggtcgtcgggacgaagggccgacgagtagcg

SEQ ID NO: 190272 - DNA, 553 bp, Homo sapiens
  misc_feature: GYAE6OF02GGGB0.2.77.G11.1.454.CMB.1.raw
  modified_base (553)..(553): a, c, t, g, unknown or other
  misc_feature (553)..(553): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgagacacggccgtgtatcactgtgttagagatcggagttggagctatgagtactggggccaggggaaccctggtcaccgtctccctcacgcctccaaccacgggcccatccggtccttcccccgtggccgccctgcctccgaggacgccaccctccgagacgcacgcggccggcccgtcgggcctcggcccgttgggtaccaagggtacctaccgttccgtgtccggaggtccgttcgtggacggtccgggcgtcgggacgaagggccgacgagtaggn

SEQ ID NO: 190273 - DNA, 573 bp, Homo sapiens
  misc_feature: GYAE6OF02HGIRI.2.77.G11.1.454.CMB.1.raw
  modified_base (445)..(445): a, c, t, g, unknown or other
  misc_feature (445)..(445): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatagattcaaagactcactgtatctgcacatgaacagcctagaaaaccgaggacacggccgtgtatcactgtgttagagatcggagttggagctatgagtacgtggggccagggaaccctggtcaccgtctcctcacgccctccaccgaacgggcccagtccggtccttcccccgtggcccgccctcgcctccgaggacgccaccgtccgagcgcacncgccggcccgtgggcctcggcccgttggtaccgaacggtaccttaccgttcccgtcggttaccggtacggtccggtcgtgggaccggccggggtcgttcgggaccgaacgggccggtacgtagtagcg

SEQ ID NO: 190274 - DNA, 523 bp, Homo sapiens
  misc_feature: GYAE6OF02IKEGO.2.77.G11.1.454.CMB.1.raw
  modified_base (364)..(364): a, c, t, g, unknown or other
  misc_feature (364)..(364): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccgagggaaccctggtcaccgtctcctcngccctcccaccgaacgggcccaagtccggtccttcccccgtggccgtccctcggcctcccgacggacgccaccctccgagacgcaacgcgccggcccgtggctgcctggtacaagactccttccgngtcgagcgtctgcggnggcgtggcaggcnatgn

SEQ ID NO: 190275 - DNA, 550 bp, Homo sapiens
  misc_feature: GYAE6OF02GYVXI.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaccgaggacacggccgtgtatcactgtgttagagagtcggagttggagcttatgagtacgtggggccagggaaccctggtccaccgtctcctcagccctccaccaacgggcccagtccggtccttcccccgtggcccgccctgcctccgaggcgccaccgtcgagcgcacgacgccggcccgtgggctcgccgtggtaccaacggtaccttacttccgtgtccgaggtccgtcgttggacggtccgggcgtcgggacgaacgggccggcgacgtagc

SEQ ID NO: 190276 - DNA, 571 bp, Homo sapiens
  misc_feature: GYAE6OF02FR16D.2.77.G11.1.454.CMB.1.raw
  modified_base (542)..(542): a, c, t, g, unknown or other
  misc_feature (542)..(542): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccagggaaccctggtaccaccgtctcctcacgccctccaccgaacgggcccactccggtccttcccccgtcggtcccgccctcgcctcccgacggacgccacccgtccgagacgccacgacgcccggcccgtcgggcctcggccgttcggtacgaacggaccttaccgttccgtcgtccggtaggtccgtcgtcggacggtccgggngttcgggacgaacgggcgacgacgtgacg

SEQ ID NO: 190277 - DNA, 591 bp, Homo sapiens
  misc_feature: GYAE6OF02GCJP0.2.77.G11.1.454.CMB.1.raw
  modified_base (278)..(278): a, c, t, g, unknown or other
  misc_feature (278)..(278): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctagaaaaccgnggacacggccgtgtatcactgtgttagagatcggagttggagctaatggagtacgtgggggaccagggaaccctggtacaccggtctcctcacgccctaccaaccgaacgggcccaagtccggtccttcccccgtggcctccctgcctccgaggcgccacccgtccgagacgcaccgacgccggtcccgtggggcctcggcccgttagggtccgaaacgggtacctttaccgttccgtcggttccggaacggtccggttacgttcgggacggtccggggtactcgggaccgtaaacggggccgacgagtagcg

SEQ ID NO: 190278 - DNA, 547 bp, Homo sapiens
  misc_feature: GYAE6OF02G36AG.2.77.G11.1.454.CMB.1.raw
  modified_base (322)..(322): a, c, t, g, unknown or other
  misc_feature (322)..(322): n is a, c, g, or t
  modified_base (442)..(442): a, c, t, g, unknown or other
  misc_feature (442)..(442): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctgaaaaccgaggacacggccgtgtatcactgtgttagagatcggagttggagctangagtacgtggggccagggaaccctggtcaccgtctcctcagcctccacacgggcccatccggtccttcccccgtggccgccctgcctccgacggacgccgacccgtcccgagacgacacncgccggccctggggcctcggccttcgggtacaaacggaccttaccgttcccgttgtccgagtccggttcgtggcgcgggctcgggcgtaacgggcgcgagtagcg

SEQ ID NO: 190279 - DNA, 589 bp, Homo sapiens
  misc_feature: GYAE6OF02G51ZD.2.77.G11.1.454.CMB.1.raw
  modified_base (404)..(404): a, c, t, g, unknown or other
  misc_feature (404)..(404): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggcgtagtatcactgtgttagagatcggtagttggagctagtgagtacgtgggggccagggaaccctggccaccgtctcctcagtccctccaaccgacggcccagtccgtcccttccccgnggcccgtcccgtgcctcccgaggacgtccaacccgtcgagacgccgacgacggccggcccgtcggggcctcggtcccgtcggtaaccgtaaacggtaccgttaccgttacccgtgttaccggacggttccggtacgtcgggaacggtccgggcgttacgggacggtaccggacgaccgagtagcg

SEQ ID NO: 190280 - DNA, 572 bp, Homo sapiens
  misc_feature: GYAE6OF02HJXLA.2.77.G11.1.454.CMB.1.raw
  modified_base (433)..(433): a, c, t, g, unknown or other
  misc_feature (433)..(433): n is a, c, g, or t
  modified_base (571)..(571): a, c, t, g, unknown or other
  misc_feature (571)..(571): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccaggggtaaccctggtcaccgtctccctcacgccctccaaccgaagggcccagtccggtccttccccccgtggcccgcccgtcgcctccgacggacnccacctcccgagacgcacgacgccggccctgggcctcggccgtgggtaccgaaaggtacctaccgtttccgacggttccgacggtccggttcctaggaccggtcgggtcgtcgggaccgaacgggcggacgagtacgng

SEQ ID NO: 190281 - DNA, 517 bp, Homo sapiens
  misc_feature: GYAE6OF02I6LPO.2.77.G11.1.454.CMB.1.raw
  modified_base (321)..(321): a, c, t, g, unknown or other
  misc_feature (321)..(321): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (509)..(509): a, c, t, g, unknown or other
  misc_feature (509)..(509): n is a, c, g, or t
  modified_base (517)..(517): a, c, t, g, unknown or other
  misc_feature (517)..(517): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagactcactgtatctgcacatgaacagcctagaaaaccgaggacacggccgtgtactcactgtgttagagtagtcggagttgganctagtgagtacgtggggaccagggaccctggtcaccgtctctcagcctccacgacggcccagtcgtcctccccgtgcccncctgctccgnggacncacctccgagacgccacacgccggtcccngggctgcctggtacacggtactcgttcngtcgagcgttcnggngccggngtcggacgaaggccncgagtagn

SEQ ID NO: 190282 - DNA, 558 bp, Homo sapiens
  misc_feature: GYAE6OF02FW1BE.2.77.G11.1.454.CMB.1.raw
  modified_base (407)..(407): a, c, t, g, unknown or other
  misc_feature (407)..(407): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccagggaaccctggcaccggtctcctcacgccctccaccgaacgggcccagtccggtccttccccctggccncccgtgcctccgaggcgccacctccgagacgcacgacgccggacccgtgggcctggcccgtgggtccaaacgggtaccttaccgttccgtcgtccggacgtccggttactcggacggcgggtcgtcggccgtaacgggccgactagtagcg

SEQ ID NO: 190283 - DNA, 584 bp, Homo sapiens
  misc_feature: GYAE6OF02I60EI.2.77.G11.1.454.CMB.1.raw
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
  modified_base (583)..(584): a, c, t, g, unknown or other
  misc_feature (583)..(584): n is a, c, g, or t
tcagacgctcgacacacgaccggtgctcgatttagctagtcactcaagggaaagggtgagactctcctgtgcagcctctggattcatcttcagtgactactacatggactgggtccgccaggctccgagggaaggggctggtgtgggtctcacgtattaatagtgatgggagtagcacaagctacgcggactccgtgaagggccattcaccatctccagagacaacgccaagaacacgctgtatctgacaaatgaaacagtctagagagccgaggacacggctgtntattactgtgacaagagatagcagcagctaggtaccnccgactacgtggggaccagggaaccctgggtaccaccgtctcctcacgtccctccaaccgaacgggccccacgttcccggttcccttccccccgtcggcccgtcccctggccctccgacggaccgcctaacccgtccgacgacgccaccgacggcccggcccgtgggcctcgccgttcggtaccaacggtacttaccttccgtcgtacgacgtccgtcgtacggacggccggtcgtcgggacgacggccgacgacgtagnn

SEQ ID NO: 190284 - DNA, 549 bp, Homo sapiens
  misc_feature: GYAE6OF02GFODR.2.77.G11.1.454.CMB.1.raw
  modified_base (548)..(548): a, c, t, g, unknown or other
  misc_feature (548)..(548): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccagggaccctggtcaccgtctcctcacgcctccaccgaacgggcccagtccggtccttcccccgtggccgccctcgcctccgaggcgccacccgtccgagcgcacgcgccggcccgtgggcctggccgtcggtaccaaacggtaccttaccgttccgtgtccggaggtccgttctggacggcgggcgttcgggcgaacgggcgcgtagtagng

SEQ ID NO: 190285 - DNA, 608 bp, Homo sapiens
  misc_feature: GYAE6OF02HYDS3.2.77.G11.1.454.CMB.1.raw
  modified_base (351)..(351): a, c, t, g, unknown or other
  misc_feature (351)..(351): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattacaaaagaactcaactgtatctgcacatgaacagcctagaaaaccggaggaacacggaccgtagtactccgaacgttggtagttagagtatcgggagttgggagctaagtgagtacgnggggtaccaacgggaacccttggaccacccgttctcccgtacgacgtccctaccaacccgaacgggccccaacgttccggttccccgttaccccccgnggaccgtccctcgccgtcccgaggaccncccaccgtcgaanacgcaacgcgccggcccgtggctcgccgtgaaccgaagtaccttaccttcgacggtcgacggtctaccgtaggacgggtccggacgttacggacgaaccgggtccgactaggtacgcg

SEQ ID NO: 190286 - DNA, 820 bp, Homo sapiens
  misc_feature: GYAE6OF02HW2S0.2.77.G11.1.454.CMB.1.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
tcagacgctcgacacacgaccggtgctcgatttagctagtcactcaagggaaagggtgagactctcctgtgcagcctctggattcatcttcagtgactactacatggactgggtccgccaggctccacgaagagctggagtggtggcgtatagaatagagcaagagtacagcanagactacgccgcgtctgtagaaaggcagattcaccatctcaagagatgacttacaaagaactcactgtaactctagacanatagaacagtacctacggaaaaaccgagggaaccaccgggaccgttaggtaacaccgtacgttagttaaggtttaaggaacggtaagttaccggggaaggttttcgggaacggtacggttaagttaggaaacggttaaccgggttacggggggaacccgtaacgggggtaacccccttgggttacccgtaacccgggttcctaccgttaccgaacggtcccccgtaacccaacccgggtaaaccggggtcccctaagggtttcccccgggtaaacccccttttcccccctcggggggacccccttccccggttcggaccccggtttaccgaacgggtaccggtacccgaccccgtcccgggtaagggaaccccacgacccggccgggaaccccggtcccgggttccggggtcccctcgggcccccggtttaaggggaacccgtaaacggtaccctttacccgtcccggttagggacccgtcgggtccccgtttaaggtcggaaccggggtcccggtacggggtttccccggaacgggtaccgacgggggttacccaagggttggac

SEQ ID NO: 190287 - DNA, 557 bp, Homo sapiens
  misc_feature: GYAE6OF02IOFT7.2.77.G11.1.454.CMB.1.raw
  modified_base (333)..(333): a, c, t, g, unknown or other
  misc_feature (333)..(333): n is a, c, g, or t
  modified_base (401)..(401): a, c, t, g, unknown or other
  misc_feature (401)..(401): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtagtatcactgtagttagagatcggattcggagctatgagtacgnggggccagggaacctggcaccgtctcctcacgccctccacgaaggcccagtccgtcctcccctggccnccctgcctccgaggacgcacccgtccgagacgcacgacggccggcccgtgggcctacggccgtaggtaccaaaggtaaccttaccgttctacggtacgacggtcgttacgtcggtaacggtcgggactcgggacgtaacgggccgacgtagtagcg

SEQ ID NO: 190288 - DNA, 647 bp, Homo sapiens
  misc_feature: GYAE6OF02IFFOA.2.77.G11.1.454.CMB.1.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagaccaagagttacagcacagactacgcgcgtctgtagaaaggcagattcaccatctcaagagatgattacaaagactcatgtatctgacanatgaacngacctagaaaaccgnggacacggcgtagtactcactgtgttagagtagtcggtagttggagtctatggagtacgtcggggaccaacggggaccctggtaccaccgttcctaccgtcacgcccctacgacccgaacggcccncgtccggttcccttacccccgcggtcccgtccnccgtaccgtccgacgggaccgaccgtacccgtccgaacgtacgccgtaaccgacgggccccggtaccggtccgggtacccgtccggtccccgttagggaacccgtaaacggtacccttaccgttccgtacggtaccgacggtcccgtacggtggtaccggtccggggtacgtaccgggaccgtacggacccggtacgtaacgtcggacg

SEQ ID NO: 190289 - DNA, 552 bp, Homo sapiens
  misc_feature: GYAE6OF02IX5J7.2.77.G11.1.454.CMB.1.raw
  modified_base (278)..(278): a, c, t, g, unknown or other
  misc_feature (278)..(278): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (551)..(551): a, c, t, g, unknown or other
  misc_feature (551)..(551): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattacaaagaactcactgtatctgcacatgaacagcctagaaaaccgnggacacggccgtgtatcactgtgtagagagtcggagttggagactagtgagtacgtggggacccagggaccctggtacaccgtctcccgtacacgccctccaaccgacgggccctagtccggtccttcccccgtggccgtcccgtgccctccgaggaccgccacccgtcgacgcgcacgngccggccngggctcgccgtggacgaacggtcttaccgttccgtgtacgacgttcgtcgtggcgtcggctcgggacgtacggcgacgtagtagng

SEQ ID NO: 190290 - DNA, 561 bp, Homo sapiens
  misc_feature: GYAE6OF02GHFP1.2.77.G11.1.454.CMB.1.raw
  modified_base (279)..(279): a, c, t, g, unknown or other
  misc_feature (279)..(279): n is a, c, g, or t
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
  modified_base (530)..(530): a, c, t, g, unknown or other
  misc_feature (530)..(530): n is a, c, g, or t
  modified_base (560)..(560): a, c, t, g, unknown or other
  misc_feature (560)..(560): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagactcactgtatctgcacatgaacacgcctagaaaaccggngaccacgggccgtgtactcacgtgtgttaagagtagtcggagttggagtctatgagtacgtggggaccaacggggaccctggtaccaccgtctccncgacgccctccgacgacgggcccagtcccggttccctcccccgtggcccgtcccgtcgcctaccgacggcnccgtacccgtcgagacgaccacgacgccgccgtggcctcggccgttgtaccgaacggtacttaccgtcgtgtcgacgtcgtcgngacggcggtcgcggacgaggcgcgtagtgng

SEQ ID NO: 190291 - DNA, 613 bp, Homo sapiens
  misc_feature: GYAE6OF02IXFA8.2.77.G11.1.454.CMB.1.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (609)..(609): a, c, t, g, unknown or other
  misc_feature (609)..(609): n is a, c, g, or t
tcagacgctcgacacacgaccggtgctcgatttagctagtcactcaagggaaagggtgagactctcctgtgcagcctctggattcatcttcagtgactactacatggactgggtccgccaggctccgagggaagaggctggagtgggttggccgtattagaaatgagccaagagttacagcacagactacgccgcgtctgtgaaaggcagattcaccatctcaagagatgattcaaagactnaactgtatcngcacntgaacngtcctagaaaaccgnggaacacggcctgtaactcactgtgttaagagtactcgggagttacggaagcgttatggaacgtagtcggggacctacggggtaacctgggacctccggtactctacgacgtccctaccgaacgacggcccagtccggtacctttcccccgaggcctacccgtgtacctaccggacggaccgtccgaacccttcggaacgacgccaaccgacggcccggtaccccttgggccctcggccctacgggtaccaacggtaacctcgttcccaggtaccgacgtcgttaccgcggaacggccggttacgcggtaacgtacgccggtaacacggtnacgg

SEQ ID NO: 190292 - DNA, 600 bp, Homo sapiens
  misc_feature: GYAE6OF02GS3W2.2.77.G11.1.454.CMB.1.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (468)..(468): a, c, t, g, unknown or other
  misc_feature (468)..(468): n is a, c, g, or t
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
tcagacgctcgacacacgaccggtgctcgatttagctagtcactcaaggggaaaggggtgagtactctcctgtgcagcctctggattcatcttcagtgactactacatggactgggtccgccaggctccagggagaggctggagtgggttggccgtaattagaaactagaaccaagagttacagcacagactacgccgcgtctgtgaaaggcagattcatcatctcaganatgattcaaagactcactgtatctgcacatgaacagcctagaaaaccgngaccacggccgtgtatcactgtgttagagatcggagttggagtctagtgtagtacgtggggaccacgggaccctggcctacgtcctcctccagccctaccaccgaacgggccctaacgtcccggttcccttcccccgtgggcccgtcccgtcggtccctacccgaggcgtccacccgtaccgagtaccnccacgaccggccggtcccgtggggccttacggccgttggaccgtaacggtaccttaccgtcccgtgtccggacggtccgtacgtcggacggtccggggtacttggggaccgtaagggccgtacgtanaggtn

SEQ ID NO: 190293 - DNA, 565 bp, Homo sapiens
  misc_feature: GYAE6OF02F94PD.2.77.G11.1.454.CMB.1.raw
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattacaaagaactcactgtatctgcacatgaacagcctagaaaaccgaggacacggccgtgtatcactgtgttagagatcggagttgganctangagtacgtggggccagggaaccctggcaccgtctcctcacgccctaccaccgaagggcccatccggtccttcccccgtcggccgccctcgcctaccgacggacgccaccctcggacgacgccacgacgccggcccgtagggcctcggccgtggtacgaacggtacctaccgttcctacgtcggacggtccgtcgtacggacggtccgggtgtcgggacgaacgggccggacgtaacgtgcg

SEQ ID NO: 190294 - DNA, 535 bp, Homo sapiens
  misc_feature: GYAE6OF02G5LCP.2.77.G11.1.454.CMB.1.raw
  modified_base (300)..(300): a, c, t, g, unknown or other
  misc_feature (300)..(300): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaaagaactcactgtatctgcacatgaacagcctgaaaacccgaggacacggccgtgtatcactgngttagagatcggagttggagctatgagtactggggccagggaccctggtcaccgtctcctcacgcctccaccgaacgggcccatccggtccttccccctggccgcccgtgcctccgacgggacgccaccctccgagacgcacacgcggccccgtgggcctggcctggtccaaggtacctacttccgtgtccgaggtcgtctaggacgcgggcgtcggcgaacgggcgacagtagc

SEQ ID NO: 190295 - DNA, 596 bp, Homo sapiens
  misc_feature: GYAE6OF02IUAXM.2.77.G11.1.454.CMB.1.raw
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (595)..(595): a, c, t, g, unknown or other
  misc_feature (595)..(595): n is a, c, g, or t
tcagacgctcgacacacgaccggtgctcgatttagctagtcactcaagggaaagggtgagactctcctgtgcagcctctggattcatcttcagtgactactacatggactgggtccgccaggctccgagggaagaggctggagtgggttggccgtattagaaatagagccaagagttacagcacagactacgccgcgtctgtagaaaggcagattcaccatctacaagagatgattacaaaagaactacactagttaactctgcacatgaacagcctagaaaaccgacggaacgaccggccgtagttaatcgactgtagttaggagtagtcggtaggttggagtctagtgagtacgngggccgacggaaccgttcgcgtaccgtctctcgacncctccaaccgacggcccagtcccgtcctccccgtcggcccgcccgtcgcctaccgacgcgccgaccgcggacgacgcaccgacggccgaccgtcggccgtcgccgtcgggtactaacggtacctaccgttccgtacgtccgacggtccggttcgtaggtccggcgggtccgtacgggacacggggtccgacgtacggtacgng

SEQ ID NO: 190296 - DNA, 680 bp, Homo sapiens
  misc_feature: GYAE6OF02I3GCZ.2.77.G11.1.454.CMB.1.raw
  modified_base (366)..(366): a, c, t, g, unknown or other
  misc_feature (366)..(366): n is a, c, g, or t
  modified_base (485)..(485): a, c, t, g, unknown or other
  misc_feature (485)..(485): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagaggctggagtgggttggccgttattagaaatagagaccaagagttacagcacagactacgccgcgtctgtgaaaggcagattcaccatcacaagagatgattacaaagtactcactgtactctgcactatacgaaccacgacccgtaacggaaaacccggtaggaacccgaccgggtaccgttagtactccgtacgttggtacgttaaggagtaggtcggtaggttcggagtntagtaggtaggtacggtcgggggacccgacgggtaacccgttggtaccgtacccgttcctccgtacaccggtccctacccgaccgacggccccgtacgtcccggttcccttcccccggnggtcccgtcccgtcgacccgtaccgacgggtccaccgacccgtaccgacgccgaccgaccgaccgggtcccgggtacccgtcgggtccgtcggtacccgttcggtaaccgaaaccggttcctaccgtttccggtgtacggtacggtcgtacggtcggcggtccgggtcgtacggccggacggtcgacgtagtgcg

SEQ ID NO: 190297 - DNA, 786 bp, Homo sapiens
  misc_feature: GYAE6OF02FMUFV.2.77.G11.1.454.CMB.1.raw
  modified_base (780)..(780): a, c, t, g, unknown or other
  misc_feature (780)..(780): n is a, c, g, or t
tcagacgctcgacacacgaccggtgctcgatttagctagtcactcgaagggaagggtgagactctcctgtgcagcctctggattcatacttcagtagactactacatggactcggtccgccaggctccagggagacggctggaggtgggttggccgtagttagaaatagagccaagagttacgagcacagactacgccgtgtctggtgaaaggcagattcaccatctacaagacgatacgacttacaaaacgaactcacgttagttactaccgtgactaacgactcgaaccagtcccgtaacggaaaaaccgacgggaccgtaacgggtaccgttgtaactaccgaacgttcgtagttaaggcgtaacgtacgggtacggttaggacgtacttaagtacgtacgttaaccggtcgggggaacccgaaggggtaaccccgttgggtacccgtaacccgttccgtaccctcgaaccggttcccctacccggaaacccgtaccggggacccctagttacccgggttaccctttcccccggacgggcccttacccggtcacccgttaaccggacggtacgaccccgtacccgtaccgggaacgacccggaaccgacggacccgggtccgggtaccccgtcggggacgttccgaccggtttagggacctaaacgggtttaccttacggttcccgtacgttcgggaaccgttaccgggttacctacggggtaaccggttcgggacctttacggggacggaaaccgggttccgacccggtaaggtanacccgg

SEQ ID NO: 190298 - DNA, 727 bp, Homo sapiens
  misc_feature: GYAE6OF02GRDNA.2.77.G11.1.454.CMB.1.raw
tcagacgctcgacacacgaccggtgctcgatttagctagtcactcaagggaaagggtgagactctcctgtgcagcctctggattcatcttcagtgactactacatggactgggtccgccaggctccgagggagaggctggagtgggtctcacgtattaatagtgatgggagtagcaacaagctaacgcggactccgtggaacgggccgtattccaacctagtcctccaaggacacaacggccaaagacacgctgtactcgtgactaaatcgaactacgtctaggaacgacggcccggaaggccgaacggtacgtgttagtaacgtttccagttcgacgaaaggaagtatacgcaggaccacggtaccgtggtaaccgaccggtaacgttaccggtacgggggactaaccggggaacccgtttcgggtaaccctacccggttactttcccggacccgtaaccggtcccctaacccggaacccggaaaccgggtcccctacggttccccgggtttccccttacccccggtcgggtacccgtccccgtaccggtccgttaccggacgggaaccgtcccgacccgttaccggaccgacgacccgtaaccgaccggcccggtcccgcgggtctacccggtcgtacgacgtaacggtaccgttcgttaccgtcgacggtacgtccgtacggctccgggtacggcgtaccggacgaccggcgacggtacgcgtg

SEQ ID NO: 190299 - DNA, 682 bp, Homo sapiens
  misc_feature: GYAE6OF02IRHPW.2.77.G11.1.454.CMB.1.raw
  modified_base (259)..(259): a, c, t, g, unknown or other
  misc_feature (259)..(259): n is a, c, g, or t
  modified_base (655)..(655): a, c, t, g, unknown or other
  misc_feature (655)..(655): n is a, c, g, or t
tcagacgctcgacacacgaccggtgctcgatttagctagtcactcaagggaaagggtgagactctcctgtgcagcctctggattcatcttcagtgactactacatggactgggtccgccaggctccagggaagagctggagtggttggccgtattagaaatgagcaagagttacagcacagactacgccgcgtctgtgaaaggctagtattcacatctacaagagatgattacaaaagtactacactgtatctagccanactgaacacgacctaagaaaccgacggaacgaccgggaccgttagtactacgacgttgtagttagaacggtagtcgggtagttaggacgtactaaggtggacgttaacggtcgggggacccgaaacggggtaacccttgggaccctaccggtttcctacccgtccgaccgttcccgtaacccgtaaccgaaccgggacccgtacgtttacccggttacccctttcccccgtagggcccgtccccgttacgacccgttccccggaaggccggaacccgtacccgtacccggaagtaccgacgacccgtagggccccggtaccggtcggcccgtcgtcgtacgaacgtagtaaccttccgttacgtcgaccgtagtccgttcgtagggacgtccgggngtcggacggacggaccgacgagtgacg

SEQ ID NO: 190300 - DNA, 935 bp, Homo sapiens
  misc_feature: GYAE6OF02GAL0V.2.77.G11.1.454.CMB.1.raw
  modified_base (126)..(126): a, c, t, g, unknown or other
  misc_feature (126)..(126): n is a, c, g, or t
tcagacgctcgacacacgaccggtgctcgatttagctagtcactcaaggggaaggggtgagactctcctgtgcagcctcgtggacttcgatcttcaggtcgactactacatggacgtcggggtccnccgacggcctaccggaagggacgtagggcgtgggtaggtggggttacggaccgttaagttaagaaagtacggacgaccgtaaggtacgttaccgacggtacaacgtaacggtaccgtaccggccggtcgtacgtaggtaacggaaacggtcgtaacggtaccttacccgaacgtacttcctaaacgaaggtacggttataacgtaacgttaaaccgggaaacgttaccgtaaccttacggttacgttaccgtacgtacgactaacgtaacggtaaccgaacggtaaccggaaccggtaaaaccggaaccgggaccggtaccggtaccgggttacgtacgtacgttacgtacggtaggtacggtaggtacggtacgggttacggtacggtacgtacgtacggtacggtacgggtacgggtacgggaccgggtaccggtaaccggttccggtccgtaccgttcccgtcccgtaccgtacccgtacccgtacccggtacccgggtaccggtacccgttcccggttaccccggtcccggttccccggtccggtacccggtcccgtccggtacccgtaccggtaccgtaccggtaccgtaccggtaccggaccggtccgtacccggtaccgggtcccgggtacgggtcccggtaccgggtaccggtaccggtaccggttaccggtacggttacccgtacggttcccgttacgggttaccggtccggttaccggtacgggtccggggtaccgggttaccgggtcccgggtacggacccgggtacggtaccggaccggttcgtaccggtcgcgtcg

SEQ ID NO: 190301 - DNA, 218 bp, Homo sapiens
  misc_feature: GYAE6OF01BBP4R.48.37.D04.1.454.CMB.1.raw
  modified_base (218)..(218): a, c, t, g, unknown or other
  misc_feature (218)..(218): n is a, c, g, or t
tcagagtatacatacacgaccggtgctcgatttagtagcatactgttgggtttgggccaagggacaacggtcaccgtctcttcagcctccaccaagggcccatcggtcttccctggcgccctgctccaggagcacctccgagagcacagcggccctgggctgcctggtcaaggactacttcctatgtatactctgagcgggctggcaaggcgcatagn

SEQ ID NO: 190302 - DNA, 221 bp, Homo sapiens
  misc_feature: GYAE6OF01EJOT2.48.37.D04.1.454.CMB.1.raw
  modified_base (220)..(221): a, c, t, g, unknown or other
  misc_feature (220)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 190303 - DNA, 218 bp, Homo sapiens; identical to SEQ ID NO: 190301
  misc_feature: GYAE6OF01BVW19.48.37.D04.1.454.CMB.1.raw
  modified_base (218)..(218): a, c, t, g, unknown or other
  misc_feature (218)..(218): n is a, c, g, or t

SEQ ID NO: 190304 - DNA, 221 bp, Homo sapiens; identical to SEQ ID NO: 190302
  misc_feature: GYAE6OF01C8H9A.48.37.D04.1.454.CMB.1.raw
  modified_base (220)..(221): a, c, t, g, unknown or other
  misc_feature (220)..(221): n is a, c, g, or t

SEQ ID NO: 190305 - DNA, 220 bp, Homo sapiens
  misc_feature: GYAE6OF01AJREJ.48.37.D04.1.454.CMB.1.raw
  modified_base (219)..(220): a, c, t, g, unknown or other
  misc_feature (219)..(220): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 190306 - DNA, 220 bp, Homo sapiens
  misc_feature: GYAE6OF01CY89O.48.37.D04.1.454.CMB.1.raw
  modified_base (218)..(220): a, c, t, g, unknown or other
  misc_feature (218)..(220): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctcttcgactctgagcgggctggcaaggcgcatagnnn

SEQ ID NO: 190307 - DNA, 223 bp, Homo sapiens
  misc_feature: GYAE6OF01CMN8V.48.37.D04.1.454.CMB.1.raw
  modified_base (220)..(223): a, c, t, g, unknown or other
  misc_feature (220)..(223): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnn

SEQ ID NO: 190308 - DNA, 223 bp, Homo sapiens; identical to SEQ ID NO: 190307
  misc_feature: GYAE6OF01DV9X1.48.37.D04.1.454.CMB.1.raw
  modified_base (220)..(223): a, c, t, g, unknown or other
  misc_feature (220)..(223): n is a, c, g, or t

SEQ ID NO: 190309 - DNA, 306 bp, Homo sapiens
  misc_feature: GYAE6OF01CFNY0.48.37.D04.1.454.CMB.1.raw
  modified_base (229)..(230): a, c, t, g, unknown or other
  misc_feature (229)..(230): n is a, c, g, or t
  modified_base (232)..(232): a, c, t, g, unknown or other
  misc_feature (232)..(232): n is a, c, g, or t
  modified_base (234)..(306): a, c, t, g, unknown or other
  misc_feature (234)..(306): n is a, c, g, or t
tcagagtatacatacacgaccggtgctcgatttagtagcatactgttgggtttggggcccaagggacaacggtcaccggtctcttcagcctccaccgaagggcccatcggtcttccccctggcgccctgctccgaggagcacctccgagagcacacgcggccctgggcctgcctggtcaaggctacttcctctctcgactctgagtcgggctgggcaagggcgcatagnngngnnnnnnnnnnnnnnnnnnnnnnnnnnnnnnnnnnnnnnnnnnnnnnnnnnnnnnnnnnnnnnnnnnnnnnnnn

SEQ ID NO: 190310 - DNA, 257 bp, Homo sapiens
  misc_feature: GYAE6OF01D53WE.48.37.D04.1.454.CMB.1.raw
  modified_base (220)..(257): a, c, t, g, unknown or other
  misc_feature (220)..(257): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctgctccaggagcacctccgagagcacagcggccctgggctgcctggtcaaggctacttcctctctcgactctgagcgggctggcaaggcgcatagnnnnnnnnnnnnnnnnnnnnnnnnnnnnnnnnnnnnnn

SEQ ID NO: 190311 - DNA, 223 bp, Homo sapiens; identical to SEQ ID NO: 190307
  misc_feature: GYAE6OF01BTL07.48.37.D04.1.454.CMB.1.raw
  modified_base (220)..(223): a, c, t, g, unknown or other
  misc_feature (220)..(223): n is a, c, g, or t

SEQ ID NO: 190312 - DNA, 221 bp, Homo sapiens
  misc_feature: GYAE6OF01ESEYZ.48.37.D04.1.454.CMB.1.raw
  modified_base (219)..(221): a, c, t, g, unknown or other
  misc_feature (219)..(221): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnn

SEQ ID NO: 190313 - DNA, 220 bp, Homo sapiens; identical to SEQ ID NO: 190305
  misc_feature: GYAE6OF01B7ILD.48.37.D04.1.454.CMB.1.raw
  modified_base (219)..(220): a, c, t, g, unknown or other
  misc_feature (219)..(220): n is a, c, g, or t

SEQ ID NO: 190314 - DNA, 222 bp, Homo sapiens
  misc_feature: GYAE6OF01B9FW9.48.37.D04.1.454.CMB.1.raw
  modified_base (220)..(222): a, c, t, g, unknown or other
  misc_feature (220)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnn

SEQ ID NO: 190315 - DNA, 221 bp, Homo sapiens; identical to SEQ ID NO: 190302
  misc_feature: GYAE6OF01BNBB7.48.37.D04.1.454.CMB.1.raw
  modified_base (220)..(221): a, c, t, g, unknown or other
  misc_feature (220)..(221): n is a, c, g, or t

SEQ ID NO: 190316 - DNA, 223 bp, Homo sapiens; identical to SEQ ID NO: 190307
  misc_feature: GYAE6OF01DCTO7.48.37.D04.1.454.CMB.1.raw
  modified_base (220)..(223): a, c, t, g, unknown or other
  misc_feature (220)..(223): n is a, c, g, or t

SEQ ID NO: 190317 - DNA, 223 bp, Homo sapiens; identical to SEQ ID NO: 190307
  misc_feature: GYAE6OF01DP8Y6.48.37.D04.1.454.CMB.1.raw
  modified_base (220)..(223): a, c, t, g, unknown or other
  misc_feature (220)..(223): n is a, c, g, or t

SEQ ID NO: 190318 - DNA, 223 bp, Homo sapiens; identical to SEQ ID NO: 190307
  misc_feature: GYAE6OF01C1ZME.48.37.D04.1.454.CMB.1.raw
  modified_base (220)..(223): a, c, t, g, unknown or other
  misc_feature (220)..(223): n is a, c, g, or t

SEQ ID NO: 190319 - DNA, 154 bp, Homo sapiens
  misc_feature: GYAE6OF01A9BQU.48.37.D04.1.454.CMB.1.raw
  modified_base (154)..(154): a, c, t, g, unknown or other
  misc_feature (154)..(154): n is a, c, g, or t
tcagagtatacatacacgaccggtgctcgatttagtagcatactgttgggtttgggaccaaggtggaagtcaaacgaactgtggctgcaccatctgtcttcatcttcccgccatctgatatgtatactctgagcgggctggcaaggcgcatagn

SEQ ID NO: 190320 - DNA, 220 bp, Homo sapiens; identical to SEQ ID NO: 190305
  misc_feature: GYAE6OF01ENQMG.48.37.D04.1.454.CMB.1.raw
  modified_base (219)..(220): a, c, t, g, unknown or other
  misc_feature (219)..(220): n is a, c, g, or t

SEQ ID NO: 190321 - DNA, 220 bp, Homo sapiens
  misc_feature: GYAE6OF01DF4EM.48.37.D04.1.454.CMB.1.raw
  modified_base (220)..(220): a, c, t, g, unknown or other
  misc_feature (220)..(220): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagn

SEQ ID NO: 190322 - DNA, 232 bp, Homo sapiens
  misc_feature: GYAE6OF01C8W87.48.37.D04.1.454.CMB.1.raw
  modified_base (220)..(232): a, c, t, g, unknown or other
  misc_feature (220)..(232): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnn

SEQ ID NO: 190323 - DNA, 222 bp, Homo sapiens; identical to SEQ ID NO: 190314
  misc_feature: GYAE6OF01CXEW2.48.37.D04.1.454.CMB.1.raw
  modified_base (220)..(222): a, c, t, g, unknown or other
  misc_feature (220)..(222): n is a, c, g, or t

SEQ ID NO: 190324 - DNA, 221 bp, Homo sapiens; identical to SEQ ID NO: 190302
  misc_feature: GYAE6OF01DHMHW.48.37.D04.1.454.CMB.1.raw
  modified_base (220)..(221): a, c, t, g, unknown or other
  misc_feature (220)..(221): n is a, c, g, or t

SEQ ID NO: 190325 - DNA, 221 bp, Homo sapiens
  misc_feature: GYAE6OF01DKQT3.48.37.D04.1.454.CMB.1.raw
  modified_base (219)..(221): a, c, t, g, unknown or other
  misc_feature (219)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactatttcctctctcgactctgagcggctggcaaggcgcatagnnn

SEQ ID NO: 190326 - DNA, 221 bp, Homo sapiens; identical to SEQ ID NO: 190302
  misc_feature: GYAE6OF01BNBNT.48.37.D04.1.454.CMB.1.raw
  modified_base (220)..(221): a, c, t, g, unknown or other
  misc_feature (220)..(221): n is a, c, g, or t

SEQ ID NO: 190327 - DNA, 222 bp, Homo sapiens; identical to SEQ ID NO: 190314
  misc_feature: GYAE6OF01DKQTJ.48.37.D04.1.454.CMB.1.raw
  modified_base (220)..(222): a, c, t, g, unknown or other
  misc_feature (220)..(222): n is a, c, g, or t

SEQ ID NO: 190328 - DNA, 222 bp, Homo sapiens; identical to SEQ ID NO: 190314
  misc_feature: GYAE6OF01EQ9WV.48.37.D04.1.454.CMB.1.raw
  modified_base (220)..(222): a, c, t, g, unknown or other
  misc_feature (220)..(222): n is a, c, g, or t

SEQ ID NO: 190329 - DNA, 224 bp, Homo sapiens
  misc_feature: GYAE6OF01C3FHM.48.37.D04.1.454.CMB.1.raw
  modified_base (220)..(224): a, c, t, g, unknown or other
  misc_feature (220)..(224): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 190330 - DNA, 219 bp, Homo sapiens
  misc_feature: GYAE6OF01BR9U8.48.37.D04.1.454.CMB.1.raw
  modified_base (219)..(219): a, c, t, g, unknown or other
  misc_feature (219)..(219): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagn

SEQ ID NO: 190331 - DNA, 221 bp, Homo sapiens; identical to SEQ ID NO: 190302
  misc_feature: GYAE6OF01BQAX8.48.37.D04.1.454.CMB.1.raw
  modified_base (220)..(221): a, c, t, g, unknown or other
  misc_feature (220)..(221): n is a, c, g, or t

SEQ ID NO: 190332 - DNA, 220 bp, Homo sapiens; identical to SEQ ID NO: 190321
  misc_feature: GYAE6OF01EZ5C0.48.37.D04.1.454.CMB.1.raw
  modified_base (220)..(220): a, c, t, g, unknown or other
  misc_feature (220)..(220): n is a, c, g, or t

SEQ ID NO: 190333 - DNA, 154 bp, Homo sapiens; identical to SEQ ID NO: 190319
  misc_feature: GYAE6OF01DLTLK.48.37.D04.1.454.CMB.1.raw
  modified_base (154)..(154): a, c, t, g, unknown or other
  misc_feature (154)..(154): n is a, c, g, or t

SEQ ID NO: 190334 - DNA, 223 bp, Homo sapiens
  misc_feature: GYAE6OF01C0JRH.48.37.D04.1.454.CMB.1.raw
  modified_base (220)..(223): a, c, t, g, unknown or other
  misc_feature (220)..(223): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnn

SEQ ID NO: 190335 - DNA, 221 bp, Homo sapiens; identical to SEQ ID NO: 190302
  misc_feature: GYAE6OF01DWF7U.48.37.D04.1.454.CMB.1.raw
  modified_base (220)..(221): a, c, t, g, unknown or other
  misc_feature (220)..(221): n is a, c, g, or t

SEQ ID NO: 190336 - DNA, 221 bp, Homo sapiens; identical to SEQ ID NO: 190302
  misc_feature: GYAE6OF01B1NYI.48.37.D04.1.454.CMB.1.raw
  modified_base (220)..(221): a, c, t, g, unknown or other
  misc_feature (220)..(221): n is a, c, g, or t

SEQ ID NO: 190337 - DNA, 222 bp, Homo sapiens; identical to SEQ ID NO: 190314
  misc_feature: GYAE6OF01ANB6Q.48.37.D04.1.454.CMB.1.raw
  modified_base (220)..(222): a, c, t, g, unknown or other
  misc_feature (220)..(222): n is a, c, g, or t

SEQ ID NO: 190338 - DNA, 241 bp, Homo sapiens
  misc_feature: GYAE6OF01EKHXW.48.37.D04.1.454.CMB.1.raw
  modified_base (222)..(241): a, c, t, g, unknown or other
  misc_feature (222)..(241): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctcgctccaggagcacctccgagagcacagcggccctgggctgcctggtcaaggactacttcctatgtatactctgagcgggctggcaaggcgcatagnnnnnnnnnnnnnnnnnnnn

SEQ ID NO: 190339 - DNA, 222 bp, Homo sapiens; identical to SEQ ID NO: 190314
  misc_feature: GYAE6OF01AK8PM.48.37.D04.1.454.CMB.1.raw
  modified_base (220)..(222): a, c, t, g, unknown or other
  misc_feature (220)..(222): n is a, c, g, or t

SEQ ID NO: 190340 - DNA, 222 bp, Homo sapiens; identical to SEQ ID NO: 190314
  misc_feature: GYAE6OF01B1G2Z.48.37.D04.1.454.CMB.1.raw
  modified_base (220)..(222): a, c, t, g, unknown or other
  misc_feature (220)..(222): n is a, c, g, or t

SEQ ID NO: 190341 - DNA, 235 bp, Homo sapiens
  misc_feature: GYAE6OF01C0VTM.48.37.D04.1.454.CMB.1.raw
  modified_base (220)..(235): a, c, t, g, unknown or other
  misc_feature (220)..(235): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnnnnnnnnn

SEQ ID NO: 190342 - DNA, 223 bp, Homo sapiens; identical to SEQ ID NO: 190307
  misc_feature: GYAE6OF01DJ3QG.48.37.D04.1.454.CMB.1.raw
  modified_base (220)..(223): a, c, t, g, unknown or other
  misc_feature (220)..(223): n is a, c, g, or t

SEQ ID NO: 190343 - DNA, 222 bp, Homo sapiens; identical to SEQ ID NO: 190314
  misc_feature: GYAE6OF01ENQ3U.48.37.D04.1.454.CMB.1.raw
  modified_base (220)..(222): a, c, t, g, unknown or other
  misc_feature (220)..(222): n is a, c, g, or t

SEQ ID NO: 190344 - DNA, 219 bp, Homo sapiens
  misc_feature: GYAE6OF01EVWX7.48.37.D04.1.454.CMB.1.raw
  modified_base (218)..(219): a, c, t, g, unknown or other
  misc_feature (218)..(219): n is a, c, g, or t
tcagagtatacatacacgaccggtgctcgatttagtagcatactgttgggtttgggccaagggacaacggtcaccgtctcttcagcctccaccaagggcccatcggtcttccctggcgccctgctccaggagcacctccgagagcacagcggccctgggctgcctggtcaaggactacttcctatgtatactctgagcgggctggcaaggcgcatagnn

SEQ ID NO: 190345 - DNA, 220 bp, Homo sapiens
  misc_feature: GYAE6OF01DTGGO.48.37.D04.1.454.CMB.1.raw
  modified_base (219)..(220): a, c, t, g, unknown or other
  misc_feature (219)..(220): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnn

SEQ ID NO: 190346 - DNA, 222 bp, Homo sapiens; identical to SEQ ID NO: 190314
  misc_feature: GYAE6OF01D3B85.48.37.D04.1.454.CMB.1.raw
  modified_base (220)..(222): a, c, t, g, unknown or other
  misc_feature (220)..(222): n is a, c, g, or t

SEQ ID NO: 190347 - DNA, 275 bp, Homo sapiens
  misc_feature: GYAE6OF01BBN87.48.37.D04.1.454.CMB.1.raw
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (231)..(275): a, c, t, g, unknown or other
  misc_feature (231)..(275): n is a, c, g, or t
tcagagtatacatacacgaccggtgctcgatttagtagcatactgttgggtttgggggccaagggacaacggtcaccggtctcttcagcctccaccaagggccccatcggtcttcccctggcgccctgctccaggagcacctccgagagcacagcggccctgggctgcctggtcaaggactacttcctatgtatactctgagcgggctaggcaaggcgcgatagncngngnnnnnnnnnnnnnnnnnnnnnnnnnnnnnnnnnnnnnnnnnnnnn

SEQ ID NO: 190348 - DNA, 224 bp, Homo sapiens
  misc_feature: GYAE6OF01B6T3M.48.37.D04.1.454.CMB.1.raw
  modified_base (219)..(224): a, c, t, g, unknown or other
  misc_feature (219)..(224): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnn

SEQ ID NO: 190349 - DNA, 224 bp, Homo sapiens; identical to SEQ ID NO: 190329
  misc_feature: GYAE6OF01DPFJR.48.37.D04.1.454.CMB.1.raw
  modified_base (220)..(224): a, c, t, g, unknown or other
  misc_feature (220)..(224): n is a, c, g, or t

SEQ ID NO: 190350 - DNA, 222 bp, Homo sapiens
  misc_feature: GYAE6OF01ACSKZ.48.37.D04.1.454.CMB.1.raw
  modified_base (220)..(222): a, c, t, g, unknown or other
  misc_feature (220)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnn

SEQ ID NO: 190351 - DNA, 222 bp, Homo sapiens
  misc_feature: GYAE6OF01AC8T1.48.37.D04.1.454.CMB.1.raw
  modified_base (219)..(222): a, c, t, g, unknown or other
  misc_feature (219)..(222): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggtgcacctccgagagcacagcggccctgggctgcctggtcaaggactacttcctatgtatactctgagcgggctggcaaggcgcatagnnnn

SEQ ID NO: 190352 - DNA, 220 bp, Homo sapiens
  misc_feature: GYAE6OF01BX2PR.48.37.D04.1.454.CMB.1.raw
  modified_base (219)..(220): a, c, t, g, unknown or other
  misc_feature (219)..(220): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactactcctatgtatactctgagcgggctggcaaggcgcatagnn

SEQ ID NO: 190353 - DNA, 221 bp, Homo sapiens
  misc_feature: GYAE6OF01CB806.48.37.D04.1.454.CMB.1.raw
  modified_base (218)..(221): a, c, t, g, unknown or other
  misc_feature (218)..(221): n is a, c, g, or t
tcagagtatacatacacgaccggtgctcgatttagtagcatactgttgggtttgggccaagggacaacggtcaccgtctcttcagcctccaccaagggcccatcggtcttccctggcgccctgctccaggagcacctccgagagcacagcggccctgggctgcctggtcaaggactacttcctctctcgactctgagcgggctggcaaggcgcatagnnnn

SEQ ID NO: 190354 - DNA, 252 bp, Homo sapiens
  misc_feature: GYAE6OF01A2JNY.48.37.D04.1.454.CMB.1.raw
  modified_base (220)..(252): a, c, t, g, unknown or other
  misc_feature (220)..(252): n is a, c, g, or t
tcagagtatacatacacgaccggtgctcgatttagtagcatactgttgggtttgggccaagggacaacggtcaccgtctcgttcagcctccaccaagggcccatcggtcttcccctggcgccctgctccaggagcacctccgagagcacagcggccctggggctgcctggtcaaggctacttcctctctcgactctgagcgggctggcaaggcgcatagnnnnnnnnnnnnnnnnnnnnnnnnnnnnnnnnn

SEQ ID NO: 190355 - DNA, 221 bp, Homo sapiens
  misc_feature: GYAE6OF01A2SYE.48.37.D04.1.454.CMB.1.raw
  modified_base (220)..(221): a, c, t, g, unknown or other
  misc_feature (220)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnn

SEQ ID NO: 190356 - DNA, 154 bp, Homo sapiens; identical to SEQ ID NO: 190319
  misc_feature: GYAE6OF01A4BUV.48.37.D04.1.454.CMB.1.raw
  modified_base (154)..(154): a, c, t, g, unknown or other
  misc_feature (154)..(154): n is a, c, g, or t

SEQ ID NO: 190357 - DNA, 221 bp, Homo sapiens; identical to SEQ ID NO: 190302
  misc_feature: GYAE6OF01D3TNZ.48.37.D04.1.454.CMB.1.raw
  modified_base (220)..(221): a, c, t, g, unknown or other
  misc_feature (220)..(221): n is a, c, g, or t

SEQ ID NO: 190358 - DNA, 223 bp, Homo sapiens; identical to SEQ ID NO: 190307
  misc_feature: GYAE6OF01DZRYG.48.37.D04.1.454.CMB.1.raw
  modified_base (220)..(223): a, c, t, g, unknown or other
  misc_feature (220)..(223): n is a, c, g, or t

SEQ ID NO: 190359 - DNA, 220 bp, Homo sapiens; identical to SEQ ID NO: 190321
  misc_feature: GYAE6OF01AGDNE.48.37.D04.1.454.CMB.1.raw
  modified_base (220)..(220): a, c, t, g, unknown or other
  misc_feature (220)..(220): n is a, c, g, or t

SEQ ID NO: 190360 - DNA, 221 bp, Homo sapiens; identical to SEQ ID NO: 190302
  misc_feature: GYAE6OF01C90YW.48.37.D04.1.454.CMB.1.raw
  modified_base (220)..(221): a, c, t, g, unknown or other
  misc_feature (220)..(221): n is a, c, g, or t

SEQ ID NO: 190361 - DNA, 237 bp, Homo sapiens
  misc_feature: GYAE6OF01CLZ8B.48.37.D04.1.454.CMB.1.raw
  modified_base (222)..(237): a, c, t, g, unknown or other
  misc_feature (222)..(237): n is a, c, g, or t
tcagagtatacatacacgaccggtgctcgatttagtagcatactgttgggtttggggccggaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnn

SEQ ID NO: 190362 - DNA, 220 bp, Homo sapiens; identical to SEQ ID NO: 190305
  misc_feature: GYAE6OF01EHIU3.48.37.D04.1.454.CMB.1.raw
  modified_base (219)..(220): a, c, t, g, unknown or other
  misc_feature (219)..(220): n is a, c, g, or t

SEQ ID NO: 190363 - DNA, 223 bp, Homo sapiens; identical to SEQ ID NO: 190307
  misc_feature: GYAE6OF01AU68Z.48.37.D04.1.454.CMB.1.raw
  modified_base (220)..(223): a, c, t, g, unknown or other
  misc_feature (220)..(223): n is a, c, g, or t

SEQ ID NO: 190364 - DNA, 222 bp, Homo sapiens; identical to SEQ ID NO: 190314
  misc_feature: GYAE6OF01AO2ES.48.37.D04.1.454.CMB.1.raw
  modified_base (220)..(222): a, c, t, g, unknown or other
  misc_feature (220)..(222): n is a, c, g, or t

SEQ ID NO: 190365 - DNA, 221 bp, Homo sapiens; identical to SEQ ID NO: 190302
  misc_feature: GYAE6OF01ENTS2.48.37.D04.1.454.CMB.1.raw
  modified_base (220)..(221): a, c, t, g, unknown or other
  misc_feature (220)..(221): n is a, c, g, or t

SEQ ID NO: 190366 - DNA, 222 bp, Homo sapiens; identical to SEQ ID NO: 190314
  misc_feature: GYAE6OF01DGBG4.48.37.D04.1.454.CMB.1.raw
  modified_base (220)..(222): a, c, t, g, unknown or other
  misc_feature (220)..(222): n is a, c, g, or t

SEQ ID NO: 190367 - DNA, 222 bp, Homo sapiens
  misc_feature: GYAE6OF01BUFY6.48.37.D04.1.454.CMB.1.raw
  modified_base (220)..(222): a, c, t, g, unknown or other
  misc_feature (220)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctcctggagcacctccgagagcacagcggccctgggctgcctggtcaaggactacttcctatgtatactctgagcgggctggcaaggcgcatagnnn

SEQ ID NO: 190368 - DNA, 224 bp, Homo sapiens; identical to SEQ ID NO: 190329
  misc_feature: GYAE6OF01DB0CF.48.37.D04.1.454.CMB.1.raw
  modified_base (220)..(224): a, c, t, g, unknown or other
  misc_feature (220)..(224): n is a, c, g, or t

SEQ ID NO: 190369 - DNA, 221 bp, Homo sapiens; identical to SEQ ID NO: 190302
  misc_feature: GYAE6OF01AYV6H.48.37.D04.1.454.CMB.1.raw
  modified_base (220)..(221): a, c, t, g, unknown or other
  misc_feature (220)..(221): n is a, c, g, or t

SEQ ID NO: 190370 - DNA, 221 bp, Homo sapiens; identical to SEQ ID NO: 190355
  misc_feature: GYAE6OF01AEZ32.48.37.D04.1.454.CMB.1.raw
  modified_base (220)..(221): a, c, t, g, unknown or other
  misc_feature (220)..(221): n is a, c, g, or t

SEQ ID NO: 190371 - DNA, 224 bp, Homo sapiens; identical to SEQ ID NO: 190329
  misc_feature: GYAE6OF01CFZS9.48.37.D04.1.454.CMB.1.raw
  modified_base (220)..(224): a, c, t, g, unknown or other
  misc_feature (220)..(224): n is a, c, g, or t

SEQ ID NO: 190372 - DNA, 268 bp, Homo sapiens
  misc_feature: GYAE6OF01A1MYV.48.37.D04.1.454.CMB.1.raw
  modified_base (222)..(268): a, c, t, g, unknown or other
  misc_feature (222)..(268): n is a, c, g, or t
tcagagtatacatacacgaccggtgctcgatttagtagcatactgttgggtttggggccaagggacaacggtcaccgtctcgttcagcctccaccaagggcccatcggtcttcccctggcgccctgtctccaggagcacctccgagagcacagcgggccctgggctgcctggtcaaggctacttcctatgtatactctgagcgggctggcaaggcgcatagnnnnnnnnnnnnnnnnnnnnnnnnnnnnnnnnnnnnnnnnnnnnnnn

SEQ ID NO: 190373 - DNA, 220 bp, Homo sapiens; identical to SEQ ID NO: 190321
  misc_feature: GYAE6OF01AVRZM.48.37.D04.1.454.CMB.1.raw
  modified_base (220)..(220): a, c, t, g, unknown or other
  misc_feature (220)..(220): n is a, c, g, or t

SEQ ID NO: 190374 - DNA, 220 bp, Homo sapiens
  misc_feature: GYAE6OF01AK2PA.48.37.D04.1.454.CMB.1.raw
  modified_base (219)..(220): a, c, t, g, unknown or other
  misc_feature (219)..(220): n is a, c, g, or t
tcagagtatacatacacgaccggtgctcgatttagtagcatactgttgggtttggggccaagggacaacggtcaccgtctcttcagcctccaccaagggcccatcggtcttcccctggcaccctcctccaagagcacctctggggcacagcggccctgggctgcctggtcaaggactacttcctatgtatactctgagcgggctggcaaggcgcatagnn

SEQ ID NO: 190375 - DNA, 223 bp, Homo sapiens
  misc_feature: GYAE6OF01EL839.48.37.D04.1.454.CMB.1.raw
  modified_base (219)..(223): a, c, t, g, unknown or other
  misc_feature (219)..(223): n is a, c, g, or t
tcagagtatacatacacgaccggtgctcgatttagtagcatactgttgggttgggccaagggacaacggtcaccgtctcttcagcctccaccaagggccccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 190376 - DNA, 221 bp, Homo sapiens; identical to SEQ ID NO: 190302
  misc_feature: GYAE6OF01BOCKF.48.37.D04.1.454.CMB.1.raw
  modified_base (220)..(221): a, c, t, g, unknown or other
  misc_feature (220)..(221): n is a, c, g, or t

SEQ ID NO: 190377 - DNA, 223 bp, Homo sapiens; identical to SEQ ID NO: 190307
  misc_feature: GYAE6OF01C7M3I.48.37.D04.1.454.CMB.1.raw
  modified_base (220)..(223): a, c, t, g, unknown or other
  misc_feature (220)..(223): n is a, c, g, or t

SEQ ID NO: 190378 - DNA, 221 bp, Homo sapiens; identical to SEQ ID NO: 190302
  misc_feature: GYAE6OF01A1DNL.48.37.D04.1.454.CMB.1.raw
  modified_base (220)..(221): a, c, t, g, unknown or other
  misc_feature (220)..(221): n is a, c, g, or t

SEQ ID NO: 190379 - DNA, 221 bp, Homo sapiens
  misc_feature: GYAE6OF01CD6KV.48.37.D04.1.454.CMB.1.raw
  modified_base (219)..(221): a, c, t, g, unknown or other
  misc_feature (219)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatatctgagcgggctggcaaggcgcatagnnn

SEQ ID NO: 190380 - DNA, 220 bp, Homo sapiens; identical to SEQ ID NO: 190321
  misc_feature: GYAE6OF01BAY1E.48.37.D04.1.454.CMB.1.raw
  modified_base (220)..(220): a, c, t, g, unknown or other
  misc_feature (220)..(220): n is a, c, g, or t

SEQ ID NO: 190381 - DNA, 222 bp, Homo sapiens; identical to SEQ ID NO: 190350
  misc_feature: GYAE6OF01CF1Y2.48.37.D04.1.454.CMB.1.raw
  modified_base (220)..(222): a, c, t, g, unknown or other
  misc_feature (220)..(222): n is a, c, g, or t

SEQ ID NO: 190382 - DNA, 279 bp, Homo sapiens
  misc_feature: GYAE6OF01A7NZO.48.37.D04.1.454.CMB.1.raw
  modified_base (225)..(279): a, c, t, g, unknown or other
  misc_feature (225)..(279): n is a, c, g, or t
tcagagtatacatacacgaccggtgctcgatttagtagcatactgtttggggtttggggccaagggacaacggtcaccgtctcgttcagcctccaccaagggcccatcggtcttccccctgggccgccctgcctccaggagcacctccgagagcacagcggccctgggctgcctggtcaaggctacttcctctctcgactctgagcggctggcaaggcgcatagnnnnnnnnnnnnnnnnnnnnnnnnnnnnnnnnnnnnnnnnnnnnnnnnnnnnnnn

SEQ ID NO: 190383 - DNA, 238 bp, Homo sapiens
  misc_feature: GYAE6OF01ER5SO.48.37.D04.1.454.CMB.1.raw
  modified_base (221)..(238): a, c, t, g, unknown or other
  misc_feature (221)..(238): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagtagcacagcggtccctgggctgcctggttaagactacttcctactgtatactctgagcgggctggcaaggcgcatagnnnnnnnnnnnnnnnnnn

SEQ ID NO: 190384 - DNA, 221 bp, Homo sapiens; identical to SEQ ID NO: 190355
  misc_feature: GYAE6OF01CC534.48.37.D04.1.454.CMB.1.raw
  modified_base (220)..(221): a, c, t, g, unknown or other
  misc_feature (220)..(221): n is a, c, g, or t

SEQ ID NO: 190385 - DNA, 223 bp, Homo sapiens; identical to SEQ ID NO: 190334
  misc_feature: GYAE6OF01CN3KP.48.37.D04.1.454.CMB.1.raw
  modified_base (220)..(223): a, c, t, g, unknown or other
  misc_feature (220)..(223): n is a, c, g, or t

SEQ ID NO: 190386 - DNA, 224 bp, Homo sapiens
  misc_feature: GYAE6OF01DEDDZ.48.37.D04.1.454.CMB.1.raw
  modified_base (221)..(224): a, c, t, g, unknown or other
  misc_feature (221)..(224): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctcctcgactctgagcgggctggcaaggcgcatagnnnn

SEQ ID NO: 190387 - DNA, 237 bp, Homo sapiens
  misc_feature: GYAE6OF01BD9A4.48.37.D04.1.454.CMB.1.raw
  modified_base (220)..(237): a, c, t, g, unknown or other
  misc_feature (220)..(237): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnn

SEQ ID NO: 190388 - DNA, 221 bp, Homo sapiens; identical to SEQ ID NO: 190302
  misc_feature: GYAE6OF01BKFYG.48.37.D04.1.454.CMB.1.raw
  modified_base (220)..(221): a, c, t, g, unknown or other
  misc_feature (220)..(221): n is a, c, g, or t

SEQ ID NO: 190389 - DNA, 221 bp, Homo sapiens; identical to SEQ ID NO: 190355
  misc_feature: GYAE6OF01C7VO3.48.37.D04.1.454.CMB.1.raw
  modified_base (220)..(221): a, c, t, g, unknown or other
  misc_feature (220)..(221): n is a, c, g, or t

SEQ ID NO: 190390 - DNA, 238 bp, Homo sapiens
  misc_feature: GYAE6OF01BYAPT.48.37.D04.1.454.CMB.1.raw
  modified_base (219)..(238): a, c, t, g, unknown or other
  misc_feature (219)..(238): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnnnnnnnnnnnnn

SEQ ID NO: 190391 - DNA, 220 bp, Homo sapiens; identical to SEQ ID NO: 190321
  misc_feature: GYAE6OF01AYX3F.48.37.D04.1.454.CMB.1.raw
  modified_base (220)..(220): a, c, t, g, unknown or other
  misc_feature (220)..(220): n is a, c, g, or t

SEQ ID NO: 190392 - DNA, 221 bp, Homo sapiens; identical to SEQ ID NO: 190355
  misc_feature: GYAE6OF01CCSGR.48.37.D04.1.454.CMB.1.raw
  modified_base (220)..(221): a, c, t, g, unknown or other
  misc_feature (220)..(221): n is a, c, g, or t

SEQ ID NO: 190393 - DNA, 259 bp, Homo sapiens
  misc_feature: GYAE6OF01A9ZCD.48.37.D04.1.454.CMB.1.raw
  modified_base (222)..(259): a, c, t, g, unknown or other
  misc_feature (222)..(259): n is a, c, g, or t
tcagagtatacatacacgaccggtgctcgatttagtagcatactgttggggtttggggccaagggacaacggtcaccgtctcttcagcctccaccaaggcccatcggtcttcccctggcgccctgctccaggagcacctccgagagcacagcggccctgggctgcctggtcaaggactacttcctatgtatactctgagcgggctgggcaaggtcgcatagnnnnnnnnnnnnnnnnnnnnnnnnnnnnnnnnnnnnnn

SEQ ID NO: 190394 - DNA, 222 bp, Homo sapiens; identical to SEQ ID NO: 190314
  misc_feature: GYAE6OF01AMJSG.48.37.D04.1.454.CMB.1.raw
  modified_base (220)..(222): a, c, t, g, unknown or other
  misc_feature (220)..(222): n is a, c, g, or t

SEQ ID NO: 190395 - DNA, 221 bp, Homo sapiens; identical to SEQ ID NO: 190302
  misc_feature: GYAE6OF01D15IL.48.37.D04.1.454.CMB.1.raw
  modified_base (220)..(221): a, c, t, g, unknown or other
  misc_feature (220)..(221): n is a, c, g, or t

SEQ ID NO: 190396 - DNA, 289 bp, Homo sapiens
  misc_feature: GYAE6OF01CT4EA.48.37.D04.1.454.CMB.1.raw
  modified_base (136)..(136): a, c, t, g, unknown or other
  misc_feature (136)..(136): n is a, c, g, or t
  modified_base (225)..(226): a, c, t, g, unknown or other
  misc_feature (225)..(226): n is a, c, g, or t
  modified_base (230)..(289): a, c, t, g, unknown or other
  misc_feature (230)..(289): n is a, c, g, or t
tcagagtatacatacacgaccggtgctcgatttagtagcatactggttggggtttggggccaagggacaacggtcaccggtctcttcagcctccaccaagggcccatcggtcttcccctggcgccctgctccaggncacctcgagagcacagcggccctggggctgcctggtcaaaggctacttccatggtatactctgagcgggctgggcaaaggcgcataggnnctannnnnnnnnnnnnnnnnnnnnnnnnnnnnnnnnnnnnnnnnnnnnnnnnnnnnnnnnnnn

SEQ ID NO: 190397 - DNA, 221 bp, Homo sapiens; identical to SEQ ID NO: 190302
  misc_feature: GYAE6OF01DL93A.48.37.D04.1.454.CMB.1.raw
  modified_base (220)..(221): a, c, t, g, unknown or other
  misc_feature (220)..(221): n is a, c, g, or t

SEQ ID NO: 190398 - DNA, 222 bp, Homo sapiens; identical to SEQ ID NO: 190314
  misc_feature: GYAE6OF01EBJF8.48.37.D04.1.454.CMB.1.raw
  modified_base (220)..(222): a, c, t, g, unknown or other
  misc_feature (220)..(222): n is a, c, g, or t

SEQ ID NO: 190399 - DNA, 510 bp, Homo sapiens
  misc_feature: GYAE6OF01EAEP4.48.37.D04.1.454.CMB.1.raw
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (254)..(255): a, c, t, g, unknown or other
  misc_feature (254)..(255): n is a, c, g, or t
  modified_base (264)..(265): a, c, t, g, unknown or other
  misc_feature (264)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (289)..(290): a, c, t, g, unknown or other
  misc_feature (289)..(290): n is a, c, g, or t
  modified_base (292)..(293): a, c, t, g, unknown or other
  misc_feature (292)..(293): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
tcagagtatacatacacgaccggtgctcgatttagtagcatactgttggggtttgggggccaagggacaacggtcgaccgtctcttcagccgtccaccaaggggcccgactcggtcttcccctggccgcccgtgcctccaggagcaccgtccgagaggcacagcggcctgggctgcctggtcaaggacctacttcctatgtactacctctgagcgggactgggcaaggcgcatacgntcntgcgcagtganatnnctatatgannanananacagcgcacncnctantnncnncntctntgagagtcgcngtgtgtgngngngngtgagtgagagagtatctctctcacatatatatctgacgtagtagtagtagttactactactatatactacatataactatagtacgtacgtacgacgacgtacgtaactaacgtaactaacgtacgtagtcgtacgtacgtacgtactagtactctactactactcctacctactactcgtgtac

SEQ ID NO: 190400 - DNA, 220 bp, Homo sapiens
  misc_feature: GYAE6OF01AUCHW.48.37.D04.1.454.CMB.1.raw
  modified_base (220)..(220): a, c, t, g, unknown or other
  misc_feature (220)..(220): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagn

SEQ ID NO: 190401 - DNA, 221 bp, Homo sapiens; identical to SEQ ID NO: 190302
  misc_feature: GYAE6OF01ASVOJ.48.37.D04.1.454.CMB.1.raw
  modified_base (220)..(221): a, c, t, g, unknown or other
  misc_feature (220)..(221): n is a, c, g, or t

SEQ ID NO: 190402 - DNA, 221 bp, Homo sapiens; identical to SEQ ID NO: 190355
  misc_feature: GYAE6OF01EBJ9T.48.37.D04.1.454.CMB.1.raw
  modified_base (220)..(221): a, c, t, g, unknown or other
  misc_feature (220)..(221): n is a, c, g, or t

SEQ ID NO: 190403 - DNA, 246 bp, Homo sapiens
  misc_feature: GYAE6OF01BAXII.48.37.D04.1.454.CMB.1.raw
  modified_base (221)..(246): a, c, t, g, unknown or other
  misc_feature (221)..(246): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctgggcaaggcgcatagnnnnnnnnnnnnnnnnnnnnnnnnnn

SEQ ID NO: 190404 - DNA, 223 bp, Homo sapiens; identical to SEQ ID NO: 190307
  misc_feature: GYAE6OF01CQYRI.48.37.D04.1.454.CMB.1.raw
  modified_base (220)..(223): a, c, t, g, unknown or other
  misc_feature (220)..(223): n is a, c, g, or t

SEQ ID NO: 190405 - DNA, 231 bp, Homo sapiens
  misc_feature: GYAE6OF01EEPDG.48.37.D04.1.454.CMB.1.raw
  modified_base (220)..(231): a, c, t, g, unknown or other
  misc_feature (220)..(231): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagtcacctccgagagcacagcggccctgggctgcctggtcaaggactacttcctatgtatactctgagcgggctggcaaggcgcatagnnnnnnnnnnnn

SEQ ID NO: 190406 - DNA, 220 bp, Homo sapiens; identical to SEQ ID NO: 190321
  misc_feature: GYAE6OF01E2UQJ.48.37.D04.1.454.CMB.1.raw
  modified_base (220)..(220): a, c, t, g, unknown or other
  misc_feature (220)..(220): n is a, c, g, or t

SEQ ID NO: 190407 - DNA, 264 bp, Homo sapiens
  misc_feature: GYAE6OF01BCAXN.48.37.D04.1.454.CMB.1.raw
  modified_base (226)..(229): a, c, t, g, unknown or other
  misc_feature (226)..(229): n is a, c, g, or t
  modified_base (231)..(264): a, c, t, g, unknown or other
  misc_feature (231)..(264): n is a, c, g, or t
tcagagtatacatacacgaccggtgctcgatttagtagcatactgttagggtttgggccaaggggacaacggtcaccgtctcttcagcctccaccaagggcccatcggtcttcccctggcgcccgtgctccaggagcacctccggagacgcacagcggccctgggctgcctggtcaaggactacttcctctctcgactctgacgcgggctggcaaggccgcatagnnnngnnnnnnnnnnnnnnnnnnnnnnnnnnnnnnnnnn

SEQ ID NO: 190408 - DNA, 222 bp, Homo sapiens; identical to SEQ ID NO: 190314
  misc_feature: GYAE6OF01EQGTX.48.37.D04.1.454.CMB.1.raw
  modified_base (220)..(222): a, c, t, g, unknown or other
  misc_feature (220)..(222): n is a, c, g, or t

SEQ ID NO: 190409 - DNA, 221 bp, Homo sapiens; identical to SEQ ID NO: 190302
  misc_feature: GYAE6OF01CUYNT.48.37.D04.1.454.CMB.1.raw
  modified_base (220)..(221): a, c, t, g, unknown or other
  misc_feature (220)..(221): n is a, c, g, or t

SEQ ID NO: 190410 - DNA, 239 bp, Homo sapiens
  misc_feature: GYAE6OF01CFGSQ.48.37.D04.1.454.CMB.1.raw
  modified_base (219)..(239): a, c, t, g, unknown or other
  misc_feature (219)..(239): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggcaagggcgcatagnnnnnnnnnnnnnnnnnnnnn

SEQ ID NO: 190411 - DNA, 241 bp, Homo sapiens
  misc_feature: GYAE6OF01BMZ6C.48.37.D04.1.454.CMB.1.raw
  modified_base (220)..(241): a, c, t, g, unknown or other
  misc_feature (220)..(241): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnnnn

SEQ ID NO: 190412 - DNA, 223 bp, Homo sapiens; identical to SEQ ID NO: 190307
  misc_feature: GYAE6OF01D2W8H.48.37.D04.1.454.CMB.1.raw
  modified_base (220)..(223): a, c, t, g, unknown or other
  misc_feature (220)..(223): n is a, c, g, or t

SEQ ID NO: 190413 - DNA, 249 bp, Homo sapiens
  misc_feature: GYAE6OF01CVPOM.48.37.D04.1.454.CMB.1.raw
  modified_base (220)..(249): a, c, t, g, unknown or other
  misc_feature (220)..(249): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnnnnnnnnnnnn

SEQ ID NO: 190414 - DNA, 279 bp, Homo sapiens
  misc_feature: GYAE6OF01AIEOX.48.37.D04.1.454.CMB.1.raw
  modified_base (220)..(220): a, c, t, g, unknown or other
  misc_feature (220)..(220): n is a, c, g, or t
  modified_base (226)..(279): a, c, t, g, unknown or other
  misc_feature (226)..(279): n is a, c, g, or t
tcagagtatacatacacgaccggtgctcgatttagtagcatactgttgggtttggggggccaagggacaacggtcaccgtctcttcagcctccaccaagggcccatcggtcttcccctggcgccctgcctccaggacgcacctccgagagcacagcggcccgtgggctgcctggtcaaggactacttcctatgtatacctctgagcgggctggcaaggcncatagnnnnnnnnnnnnnnnnnnnnnnnnnnnnnnnnnnnnnnnnnnnnnnnnnnnnnn

SEQ ID NO: 190415 - DNA, 223 bp, Homo sapiens
  misc_feature: GYAE6OF01DB4EJ.48.37.D04.1.454.CMB.1.raw
  modified_base (219)..(223): a, c, t, g, unknown or other
  misc_feature (219)..(223): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 190416 - DNA, 219 bp, Homo sapiens; identical to SEQ ID NO: 190330
  misc_feature: GYAE6OF01BC23G.48.37.D04.1.454.CMB.1.raw
  modified_base (219)..(219): a, c, t, g, unknown or other
  misc_feature (219)..(219): n is a, c, g, or t

SEQ ID NO: 190417 - DNA, 222 bp, Homo sapiens
  misc_feature: GYAE6OF01CTIM5.48.37.D04.1.454.CMB.1.raw
  modified_base (219)..(222): a, c, t, g, unknown or other
  misc_feature (219)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttccttctcgactctgagcgggctggcaaggcgcatagnnnn

SEQ ID NO: 190418 - DNA, 222 bp, Homo sapiens; identical to SEQ ID NO: 190314
  misc_feature: GYAE6OF01BGNU4.48.37.D04.1.454.CMB.1.raw
  modified_base (220)..(222): a, c, t, g, unknown or other
  misc_feature (220)..(222): n is a, c, g, or t

SEQ ID NO: 190419 - DNA, 219 bp, Homo sapiens; identical to SEQ ID NO: 190330
  misc_feature: GYAE6OF01BJS8Q.48.37.D04.1.454.CMB.1.raw
  modified_base (219)..(219): a, c, t, g, unknown or other
  misc_feature (219)..(219): n is a, c, g, or t

SEQ ID NO: 190420 - DNA, 261 bp, Homo sapiens
  misc_feature: GYAE6OF01CJ8HQ.48.37.D04.1.454.CMB.1.raw
  modified_base (222)..(261): a, c, t, g, unknown or other
  misc_feature (222)..(261): n is a, c, g, or t
tcagagtatacatacacgaccggtgctcgatttagtagcatactgttgggtttgggggccaagggacaacggtcaccgtctcctcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnnnnnnnnnnnnnnnnnnnnnnnnnnnnnnnnnnn

SEQ ID NO: 190421 - DNA, 242 bp, Homo sapiens
  misc_feature: GYAE6OF01DV9W3.48.37.D04.1.454.CMB.1.raw
  modified_base (220)..(242): a, c, t, g, unknown or other
  misc_feature (220)..(242): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnnnnn

SEQ ID NO: 190422 - DNA, 221 bp, Homo sapiens; identical to SEQ ID NO: 190302
  misc_feature: GYAE6OF01EL9IX.48.37.D04.1.454.CMB.1.raw
  modified_base (220)..(221): a, c, t, g, unknown or other
  misc_feature (220)..(221): n is a, c, g, or t

SEQ ID NO: 190423 - DNA, 256 bp, Homo sapiens
  misc_feature: GYAE6OF01CE7EE.48.37.D04.1.454.CMB.1.raw
  modified_base (223)..(256): a, c, t, g, unknown or other
  misc_feature (223)..(256): n is a, c, g, or t
tcagagtatacatacacgaccggtgctcgatttagtagcatactgttggggtttgggccaagggacaacggtcaccgtctcttcagcctccgaccaagggcccatcggtcttcccctggccgccctgctccacggagcacctccgagagcacagcggccctgggctgcctggtcaaggactacttcctatgtatactctgagcgggctggcaaggcgcatagnnnnnnnnnnnnnnnnnnnnnnnnnnnnnnnnnn

SEQ ID NO: 190424 - DNA, 221 bp, Homo sapiens; identical to SEQ ID NO: 190355
  misc_feature: GYAE6OF01DLHET.48.37.D04.1.454.CMB.1.raw
  modified_base (220)..(221): a, c, t, g, unknown or other
  misc_feature (220)..(221): n is a, c, g, or t

SEQ ID NO: 190425 - DNA, 246 bp, Homo sapiens
  misc_feature: GYAE6OF01D4YBP.48.37.D04.1.454.CMB.1.raw
  modified_base (221)..(246): a, c, t, g, unknown or other
  misc_feature (221)..(246): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaagggcgcatagnnnnnnnnnnnnnnnnnnnnnnnnnn

SEQ ID NO: 190426 - DNA, 223 bp, Homo sapiens; identical to SEQ ID NO: 190307
  misc_feature: GYAE6OF01ERFMM.48.37.D04.1.454.CMB.1.raw
  modified_base (220)..(223): a, c, t, g, unknown or other
  misc_feature (220)..(223): n is a, c, g, or t

SEQ ID NO: 190427 - DNA, 564 bp, Homo sapiens
  misc_feature: GYAE6OF01DRXU6.48.37.D04.1.454.CMB.1.raw
  modified_base (277)..(277): a, c, t, g, unknown or other
  misc_feature (277)..(277): n is a, c, g, or t
tcagagtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccatctgtgtcggagtctccggggaagacggtgaccatctcctgcacccgcagcagtggcagcgttgccaaccaactatgtgcagtggtccagcagcgcccgggnagttcgcccatcactgtgatctatgaagaataatgagacgtaccctcgtcgggtccccagttcggttctcgtggcctccagtccgacacggttccctaccaacttctcgcccttctcctacacctattcctcgtcggtactgacagtacgtggacggacgaggtctagtaactttactactgtactagttcttagtgagttagtgactaaagttagtttgggtttgggttggtttcgggacgggtaaggaccgtaaggtcgtacggtacccggttcgtagggtaccg

SEQ ID NO: 190428 - DNA, 221 bp, Homo sapiens; identical to SEQ ID NO: 190302
  misc_feature: GYAE6OF01CQ7M7.48.37.D04.1.454.CMB.1.raw
  modified_base (220)..(221): a, c, t, g, unknown or other
  misc_feature (220)..(221): n is a, c, g, or t

SEQ ID NO: 190429 - DNA, 221 bp, Homo sapiens; identical to SEQ ID NO: 190302
  misc_feature: GYAE6OF01CCFQX.48.37.D04.1.454.CMB.1.raw
  modified_base (220)..(221): a, c, t, g, unknown or other
  misc_feature (220)..(221): n is a, c, g, or t

SEQ ID NO: 190430 - DNA, 224 bp, Homo sapiens; identical to SEQ ID NO: 190329
  misc_feature: GYAE6OF01BLSXU.48.37.D04.1.454.CMB.1.raw
  modified_base (220)..(224): a, c, t, g, unknown or other
  misc_feature (220)..(224): n is a, c, g, or t

SEQ ID NO: 190431 - DNA, 222 bp, Homo sapiens; identical to SEQ ID NO: 190314
  misc_feature: GYAE6OF01D0DK9.48.37.D04.1.454.CMB.1.raw
  modified_base (220)..(222): a, c, t, g, unknown or other
  misc_feature (220)..(222): n is a, c, g, or t

SEQ ID NO: 190432 - DNA, 220 bp, Homo sapiens; identical to SEQ ID NO: 190321
  misc_feature: GYAE6OF01A54Z4.48.37.D04.1.454.CMB.1.raw
  modified_base (220)..(220): a, c, t, g, unknown or other
  misc_feature (220)..(220): n is a, c, g, or t

SEQ ID NO: 190433 - DNA, 222 bp, Homo sapiens; identical to SEQ ID NO: 190314
  misc_feature: GYAE6OF01DDRHU.48.37.D04.1.454.CMB.1.raw
  modified_base (220)..(222): a, c, t, g, unknown or other
  misc_feature (220)..(222): n is a, c, g, or t

SEQ ID NO: 190434 - DNA, 222 bp, Homo sapiens; identical to SEQ ID NO: 190314
  misc_feature: GYAE6OF01A9B16.48.37.D04.1.454.CMB.1.raw
  modified_base (220)..(222): a, c, t, g, unknown or other
  misc_feature (220)..(222): n is a, c, g, or t

SEQ ID NO: 190435 - DNA, 222 bp, Homo sapiens
  misc_feature: GYAE6OF01ECQTE.48.37.D04.1.454.CMB.1.raw
  modified_base (221)..(222): a, c, t, g, unknown or other
  misc_feature (221)..(222): n is a, c, g, or t
tcagagtatacatacacgaccggtgctcgatttagtagcatactgttgggtttggtgccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnn

SEQ ID NO: 190436 - DNA, 220 bp, Homo sapiens; identical to SEQ ID NO: 190321
  misc_feature: GYAE6OF01BT048.48.37.D04.1.454.CMB.1.raw
  modified_base (220)..(220): a, c, t, g, unknown or other
  misc_feature (220)..(220): n is a, c, g, or t

SEQ ID NO: 190437 - DNA, 224 bp, Homo sapiens
  misc_feature: GYAE6OF01D193G.48.37.D04.1.454.CMB.1.raw
  modified_base (219)..(224): a, c, t, g, unknown or other
  misc_feature (219)..(224): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnn

SEQ ID NO: 190438 - DNA, 221 bp, Homo sapiens; identical to SEQ ID NO: 190302
  misc_feature: GYAE6OF01E4X8N.48.37.D04.1.454.CMB.1.raw
  modified_base (220)..(221): a, c, t, g, unknown or other
  misc_feature (220)..(221): n is a, c, g, or t

SEQ ID NO: 190439 - DNA, 223 bp, Homo sapiens
  misc_feature: GYAE6OF01B6ORT.48.37.D04.1.454.CMB.1.raw
  modified_base (220)..(223): a, c, t, g, unknown or other
  misc_feature (220)..(223): n is a, c, g, or t
tcagagtatacatacacgaccggtgctcgatttagtagcatactgttgggtttggggccaagggacaacggtcaccgtctcctcagcctccaccaagggcccatcggtcttcccctggcgccctgctccaggagcacctccgagagcacagcggccctgggctgcctggtcaaggactacttcctatgtatactctgagcgggctggcaaggcgcatagnnnn

SEQ ID NO: 190440 - DNA, 232 bp, Homo sapiens
  misc_feature: GYAE6OF01BFSXB.48.37.D04.1.454.CMB.1.raw
  modified_base (220)..(232): a, c, t, g, unknown or other
  misc_feature (220)..(232): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaagggcgcatagnnnnnnnnnnnnn

SEQ ID NO: 190441 - DNA, 527 bp, Homo sapiens
  misc_feature: GYAE6OF01AYTUP.48.37.D04.1.454.CMB.1.raw
tcagagtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctcgtcgggtccccgatcggttctctggctccatcgacaggtcctcaactctgcctctctcaccatctctggactgcagctgagcgaggctgattactactgtacagttcttagtacgattaggtggtataaattaagttggttttaggggttggtttgggacggggtagggacccgtaaggtcttaggacccgttccgtaggtaccg

SEQ ID NO: 190442 - DNA, 156 bp, Homo sapiens
  misc_feature: GYAE6OF01EDPZB.48.37.D04.1.454.CMB.1.raw
  modified_base (155)..(156): a, c, t, g, unknown or other
  misc_feature (155)..(156): n is a, c, g, or t
tcagagtatacatacacgaccggtgctcgatttagtagcatactggttgggtttgggaccaaggtggaagtcaaacgaactgtggctgcaccatctgtcttcatcttcccgccatctgatatgtatactctgagcgggctggcaaggcgcatagnn

SEQ ID NO: 190443 - DNA, 224 bp, Homo sapiens
  misc_feature: GYAE6OF01CFN2N.48.37.D04.1.454.CMB.1.raw
  modified_base (221)..(224): a, c, t, g, unknown or other
  misc_feature (221)..(224): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctctctcgactctgagcgggctggcaaggcgcatagnnnn

SEQ ID NO: 190444 - DNA, 222 bp, Homo sapiens; identical to SEQ ID NO: 190314
  misc_feature: GYAE6OF01AKVIZ.48.37.D04.1.454.CMB.1.raw
  modified_base (220)..(222): a, c, t, g, unknown or other
  misc_feature (220)..(222): n is a, c, g, or t

SEQ ID NO: 190445 - DNA, 221 bp, Homo sapiens; identical to SEQ ID NO: 190355
  misc_feature: GYAE6OF01EYB5M.48.37.D04.1.454.CMB.1.raw
  modified_base (220)..(221): a, c, t, g, unknown or other
  misc_feature (220)..(221): n is a, c, g, or t

SEQ ID NO: 190446 - DNA, 249 bp, Homo sapiens
  misc_feature: GYAE6OF01CD9XY.48.37.D04.1.454.CMB.1.raw
  modified_base (223)..(249): a, c, t, g, unknown or other
  misc_feature (223)..(249): n is a, c, g, or t
tcagagtatacatacacgaccggtgctcgatttagtagcatactgttgggtttggggccaaaggggacaacggtcaccgtctcttcagcctccaccaagggcccatcggtcttcccctggccgccctgctccaggaggcacctcagagagcacagcggccctgggctgcctggtcaaggctacttcctatgtatactctgagcgggctggcaaggcgcatagnnnnnnnnnnnnnnnnnnnnnnnnnnn

SEQ ID NO: 190447 - DNA, 222 bp, Homo sapiens; identical to SEQ ID NO: 190314
  misc_feature: GYAE6OF01DEGLW.48.37.D04.1.454.CMB.1.raw
  modified_base (220)..(222): a, c, t, g, unknown or other
  misc_feature (220)..(222): n is a, c, g, or t

SEQ ID NO: 190448 - DNA, 224 bp, Homo sapiens; identical to SEQ ID NO: 190329
  misc_feature: GYAE6OF01EHDSL.48.37.D04.1.454.CMB.1.raw
  modified_base (220)..(224): a, c, t, g, unknown or other
  misc_feature (220)..(224): n is a, c, g, or t

SEQ ID NO: 190449 - DNA, 223 bp, Homo sapiens; identical to SEQ ID NO: 190307
  misc_feature: GYAE6OF01A14UU.48.37.D04.1.454.CMB.1.raw
  modified_base (220)..(223): a, c, t, g, unknown or other
  misc_feature (220)..(223): n is a, c, g, or t

SEQ ID NO: 190450 - DNA, 262 bp, Homo sapiens
  misc_feature: GYAE6OF01BU0TZ.48.37.D04.1.454.CMB.1.raw
  modified_base (221)..(262): a, c, t, g, unknown or other
  misc_feature (221)..(262): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcagtagnnnnnnnnnnnnnnnnnnnnnnnnnnnnnnnnnnnnnnnnnn

SEQ ID NO: 190451 - DNA, 224 bp, Homo sapiens
  misc_feature: GYAE6OF01BQY5W.48.37.D04.1.454.CMB.1.raw
  modified_base (220)..(224): a, c, t, g, unknown or other
  misc_feature (220)..(224): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnn

SEQ ID NO: 190452 - DNA, 223 bp, Homo sapiens; identical to SEQ ID NO: 190307
  misc_feature: GYAE6OF01D7WWR.48.37.D04.1.454.CMB.1.raw
  modified_base (220)..(223): a, c, t, g, unknown or other
  misc_feature (220)..(223): n is a, c, g, or t

SEQ ID NO: 190453 - DNA, 155 bp, Homo sapiens
  misc_feature: GYAE6OF01BPK5K.48.37.D04.1.454.CMB.1.raw
  modified_base (154)..(155): a, c, t, g, unknown or other
  misc_feature (154)..(155): n is a, c, g, or t
tcagagtatacatacacgaccggtgctcgatttagtagcatactgttgggtttgggaccaaggtggaagtcaaacgaactgtggctgcaccatctgtcttcatcttcccgccatctgatatgtatactctgagcgggctggcaaggcgcatagnn

SEQ ID NO: 190454 - DNA, 223 bp, Homo sapiens; identical to SEQ ID NO: 190307
  misc_feature: GYAE6OF01D7RYG.48.37.D04.1.454.CMB.1.raw
  modified_base (220)..(223): a, c, t, g, unknown or other
  misc_feature (220)..(223): n is a, c, g, or t

SEQ ID NO: 190455 - DNA, 168 bp, Homo sapiens
  misc_feature: GYAE6OF01D64IW.48.37.D04.1.454.CMB.1.raw
  modified_base (149)..(149): a, c, t, g, unknown or other
  misc_feature (149)..(149): n is a, c, g, or t
  modified_base (155)..(168): a, c, t, g, unknown or other
  misc_feature (155)..(168): n is a, c, g, or t
tcagagtatacatacacgaccggtgctcgatttagtagcatactggttgggtttgggaccaaggtggaagtcaaacgaactgtggctgcaccatctgtcttcatcttcccgccatctgatatgtatactctgagcgggctggcaaggcncatagnnnnnnnnnnnnnn

SEQ ID NO: 190456 - DNA, 232 bp, Homo sapiens; identical to SEQ ID NO: 190322
  misc_feature: GYAE6OF01D39WX.48.37.D04.1.454.CMB.1.raw
  modified_base (220)..(232): a, c, t, g, unknown or other
  misc_feature (220)..(232): n is a, c, g, or t

SEQ ID NO: 190457 - DNA, 222 bp, Homo sapiens; identical to SEQ ID NO: 190350
  misc_feature: GYAE6OF01EL2QG.48.37.D04.1.454.CMB.1.raw
  modified_base (220)..(222): a, c, t, g, unknown or other
  misc_feature (220)..(222): n is a, c, g, or t

SEQ ID NO: 190458 - DNA, 238 bp, Homo sapiens
  misc_feature: GYAE6OF01CXO8S.48.37.D04.1.454.CMB.1.raw
  modified_base (221)..(238): a, c, t, g, unknown or other
  misc_feature (221)..(238): n is a, c, g, or t
tcagagtatacatacacgaccggtgctcgatttagtagcatactgttgggtttggggccaagggacaacggtcaccgtctcttcagcctccaccaagggcccatcggtccttcccctggcgccctgctccaggagcacctccgagagcacagcggccctgggctgcctggtcaaggactacttcctctctcgactctgagcgggctggcaaggcgcatagnnnnnnnnnnnnnnnnnn

SEQ ID NO: 190459 - DNA, 225 bp, Homo sapiens
  misc_feature: GYAE6OF01DM26H.48.37.D04.1.454.CMB.1.raw
  modified_base (220)..(225): a, c, t, g, unknown or other
  misc_feature (220)..(225): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnn

SEQ ID NO: 190460 - DNA, 286 bp, Homo sapiens
  misc_feature: GYAE6OF01B079O.48.37.D04.1.454.CMB.1.raw
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
  modified_base (219)..(286): a, c, t, g, unknown or other
  misc_feature (219)..(286): n is a, c, g, or t
tcagagtatacatacacgaccggtgctcgatttagtagcatactgttgggttggggccaagggacaacggtcaccgtctcttcagcctccaccaagggcccatcggtcttccccctggcgccctgctccaggagcacctccgagagcacagcggccctgggctgcctggtcaaggctatcctntntcgactctgagcgggctggcaaggtcncagtagnnnnnnnnnnnnnnnnnnnnnnnnnnnnnnnnnnnnnnnnnnnnnnnnnnnnnnnnnnnnnnnnnnnn

SEQ ID NO: 190461 - DNA, 219 bp, Homo sapiens
  misc_feature: GYAE6OF01AZTLX.48.37.D04.1.454.CMB.1.raw
  modified_base (219)..(219): a, c, t, g, unknown or other
  misc_feature (219)..(219): n is a, c, g, or t
tcagagtatacatacacgaccggtgctcgatttagtagcatactgttgggttgggccgaaggacaacggtcaccgtctcttcagcctccaccaagggcccatcggtcttcccctcggcgccctgctccaggagcacctccgagagcacagcggccctgggctgcctggtcaaggactacttcctatgtatactctgagcgggctggcaaggcgcatagn

SEQ ID NO: 190462 - DNA, 221 bp, Homo sapiens; identical to SEQ ID NO: 190302
  misc_feature: GYAE6OF01AW6DM.48.37.D04.1.454.CMB.1.raw
  modified_base (220)..(221): a, c, t, g, unknown or other
  misc_feature (220)..(221): n is a, c, g, or t

SEQ ID NO: 190463 - DNA, 229 bp, Homo sapiens
  misc_feature: GYAE6OF01A97BY.48.37.D04.1.454.CMB.1.raw
  modified_base (220)..(229): a, c, t, g, unknown or other
  misc_feature (220)..(229): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnn

SEQ ID NO: 190464 - DNA, 251 bp, Homo sapiens
  misc_feature: GYAE6OF01BC35R.48.37.D04.1.454.CMB.1.raw
  modified_base (214)..(214): a, c, t, g, unknown or other
  misc_feature (214)..(214): n is a, c, g, or t
  modified_base (220)..(229): a, c, t, g, unknown or other
  misc_feature (220)..(229): n is a, c, g, or t
  modified_base (231)..(251): a, c, t, g, unknown or other
  misc_feature (231)..(251): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggcaaggcncatagnnnnnnnnnnannnnnnnnnnnnnnnnnnnnn

SEQ ID NO: 190465 - DNA, 222 bp, Homo sapiens
  misc_feature: GYAE6OF01E0SJT.48.37.D04.1.454.CMB.1.raw
  modified_base (219)..(222): a, c, t, g, unknown or other
  misc_feature (219)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggatacttcctctctcgactctgagcgggctggcaaggcgcatagnnnn

SEQ ID NO: 190466 - DNA, 245 bp, Homo sapiens
  misc_feature: GYAE6OF01CV3CD.48.37.D04.1.454.CMB.1.raw
  modified_base (198)..(198): a, c, t, g, unknown or other
  misc_feature (198)..(198): n is a, c, g, or t
  modified_base (223)..(245): a, c, t, g, unknown or other
  misc_feature (223)..(245): n is a, c, g, or t
tcagagtatacatacacgaccggtgctcgatttagtagcatactggttgggtttggggccaaggggacaacggtcaccgtctcttcagcctccaccaagggcccatcggtcttcccctggcgccctgctccaggagcacctccgagagcacagcggccctgggctgcctggtcaaggactacttcctatgtatactcngagcgggctggcaaaggcgcatagnnnnnnnnnnnnnnnnnnnnnnn

SEQ ID NO: 190467 - DNA, 524 bp, Homo sapiens
  misc_feature: GYAE6OF01B5VOW.48.37.D04.1.454.CMB.1.raw
  modified_base (225)..(225): a, c, t, g, unknown or other
  misc_feature (225)..(225): n is a, c, g, or t
tcagagtatacatacacgaccggtgctcgatttagtagcatactgttgggtttggggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgnagcagtggcagcgttgccaccaactatgtgcagtggttccagcagcgcccggtcagttcgcccatcactgtgatctatgagaataatgagacgaccctcgtcggggtccccgattcggttctcgtggctccatcgacacggtcctccaactctgcctctctcaccatctctgactgcagactgaggacgaggtctagtacttactactgtcagttcttagtgataggtgtacaattaagtggtttgggttggtttgggacggtaacgggaccgtagtctaggaccgtcgtaggtacccg

SEQ ID NO: 190468 - DNA, 220 bp, Homo sapiens; identical to SEQ ID NO: 190400
  misc_feature: GYAE6OF01ERSH8.48.37.D04.1.454.CMB.1.raw
  modified_base (220)..(220): a, c, t, g, unknown or other
  misc_feature (220)..(220): n is a, c, g, or t

SEQ ID NO: 190469 - DNA, 222 bp, Homo sapiens; identical to SEQ ID NO: 190314
  misc_feature: GYAE6OF01BXXX9.48.37.D04.1.454.CMB.1.raw
  modified_base (220)..(222): a, c, t, g, unknown or other
  misc_feature (220)..(222): n is a, c, g, or t

SEQ ID NO: 190470 - DNA, 227 bp, Homo sapiens
  misc_feature: GYAE6OF01BVMF9.48.37.D04.1.454.CMB.1.raw
  modified_base (219)..(227): a, c, t, g, unknown or other
  misc_feature (219)..(227): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnn

SEQ ID NO: 190471 - DNA, 225 bp, Homo sapiens
  misc_feature: GYAE6OF01BO0UI.48.37.D04.1.454.CMB.1.raw
  modified_base (222)..(225): a, c, t, g, unknown or other
  misc_feature (222)..(225): n is a, c, g, or t
tcagagtatacatacacgaccggtgctcgatttagtagcatactgttgggtttgggccaagggacaacggtcaccgttctcttcagcctcgaaccgaagggcccatcggtcttcccctggccgccctgctccaggagcacctcgagaggcacagcggccctgggctgcctggtcaaggctacttcctatgtatactctgagcgggctggcaaggcgcatagnnnn

SEQ ID NO: 190472 - DNA, 756 bp, Homo sapiens
  misc_feature: GYAE6OF01EVQOJ.48.37.D04.1.454.CMB.1.raw
  modified_base (159)..(159): a, c, t, g, unknown or other
  misc_feature (159)..(159): n is a, c, g, or t
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
tcagagtatacatacacgaccggtgctcgatttagtagcatactgttgggtttgggggtggtagctcaggaagcagagcctggagcatctccactatggcctgggctccactacttctcaccctctcgctcactgcacaggttctgggcccattttacngctgactcagccccatctgtgtcggagtctccggggaanacggtgaccatctcctgcacccgnagcagtcggcagcgttgcccacaactagtgtgcagtgtccagcagcgccggnagtcnccatcactgtnatctatganaatangagacgtaccctgtacgggtccccagttcggttctcgtcggcctccagtccgacgtacggtccctaccgaacttcgtcgtcccttcgtcctacaccctagtccgtacgtcggtaacctcggacgtaacggtaccgttacgggaacgggtaaccggtacggtaccttaacgggtaaccttttaacccgtaccggttacgggttaacccgttaaccggtttaccggtttaacgttacgggtaaaccgtttaacgggttaccgggttaaacccgttaaaaggtttaaccggggtttttacggggtttttacgggggtttaccgggtttttacccgggggaacccggggggttaaacccggggttaaaacccccgtttaacggggttacccccggtttaaacccggggttaacccccccgggttttaccggtaaaccgggggtttaaaccccccgg

SEQ ID NO: 190473 - DNA, 220 bp, Homo sapiens; identical to SEQ ID NO: 190321
  misc_feature: GYAE6OF01EKR7Z.48.37.D04.1.454.CMB.1.raw
  modified_base (220)..(220): a, c, t, g, unknown or other
  misc_feature (220)..(220): n is a, c, g, or t

SEQ ID NO: 190474 - DNA, 231 bp, Homo sapiens
  misc_feature: GYAE6OF01CY8DW.48.37.D04.1.454.CMB.1.raw
  modified_base (222)..(231): a, c, t, g, unknown or other
  misc_feature (222)..(231): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgacgcgggctggcaaggcgcatagnnnnnnnnnn

SEQ ID NO: 190475 - DNA, 223 bp, Homo sapiens; identical to SEQ ID NO: 190307
  misc_feature: GYAE6OF01BJCT0.48.37.D04.1.454.CMB.1.raw
  modified_base (220)..(223): a, c, t, g, unknown or other
  misc_feature (220)..(223): n is a, c, g, or t

SEQ ID NO: 190476 - DNA, 229 bp, Homo sapiens
  misc_feature: GYAE6OF01ET50H.48.37.D04.1.454.CMB.1.raw
  modified_base (220)..(229): a, c, t, g, unknown or other
  misc_feature (220)..(229): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnnn

SEQ ID NO: 190477 - DNA, 219 bp, Homo sapiens
  misc_feature: GYAE6OF01AX7UD.48.37.D04.1.454.CMB.1.raw
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatag

SEQ ID NO: 190478 - DNA, 220 bp, Homo sapiens
  misc_feature: GYAE6OF01DB9A7.48.37.D04.1.454.CMB.1.raw
  modified_base (219)..(220): a, c, t, g, unknown or other
  misc_feature (219)..(220): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgacctgagcgggctggcaaggcgcatagnn

SEQ ID NO: 190479 - DNA, 223 bp, Homo sapiens; identical to SEQ ID NO: 190307
  misc_feature: GYAE6OF01EN3SI.48.37.D04.1.454.CMB.1.raw
  modified_base (220)..(223): a, c, t, g, unknown or other
  misc_feature (220)..(223): n is a, c, g, or t

SEQ ID NO: 190480 - DNA, 224 bp, Homo sapiens; identical to SEQ ID NO: 190329
  misc_feature: GYAE6OF01B2ILL.48.37.D04.1.454.CMB.1.raw
  modified_base (220)..(224): a, c, t, g, unknown or other
  misc_feature (220)..(224): n is a, c, g, or t

SEQ ID NO: 190481 - DNA, 221 bp, Homo sapiens
  misc_feature: GYAE6OF01DDWTI.48.37.D04.1.454.CMB.1.raw
  modified_base (220)..(221): a, c, t, g, unknown or other
  misc_feature (220)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcaccctgctccaggagcacctccgagagcacagcggccctgggctgcctggtcaaggactacttcctatgtatactctgagcgggctggcaaggcgcatagnn

SEQ ID NO: 190482 - DNA, 222 bp, Homo sapiens; identical to SEQ ID NO: 190314
  misc_feature: GYAE6OF01ATXLD.48.37.D04.1.454.CMB.1.raw
  modified_base (220)..(222): a, c, t, g, unknown or other
  misc_feature (220)..(222): n is a, c, g, or t

SEQ ID NO: 190483 - DNA, 263 bp, Homo sapiens
  misc_feature: GYAE6OF01CXRZP.48.37.D04.1.454.CMB.1.raw
  modified_base (224)..(263): a, c, t, g, unknown or other
  misc_feature (224)..(263): n is a, c, g, or t
tcagagtatacatacacgaccggtgctcgatttagtagcatactgttgggtttggggccaaagggacaacggtcaccgtctcgttcagcctccaccaagggcccatcggtcttccccctggcgccctgtctccaggagcacctccgagagcacagcggccctgggctgcctggtcaaggactacttcctatgtatactctgagcgggctggcaaggcgcatagnnnnnnnnnnnnnnnnnnnnnnnnnnnnnnnnnnnnnnnn

SEQ ID NO: 190484 - DNA, 242 bp, Homo sapiens
  misc_feature: GYAE6OF01E3QAH.48.37.D04.1.454.CMB.1.raw
  modified_base (222)..(242): a, c, t, g, unknown or other
  misc_feature (222)..(242): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgcttccaggagcacctccgagagcacagcggccctgggctgcctggtcaaggactacttcctatgtatactctgagcgggctggcaaggcgcatagnnnnnnnnnnnnnnnnnnnnn

SEQ ID NO: 190485 - DNA, 221 bp, Homo sapiens; identical to SEQ ID NO: 190355
  misc_feature: GYAE6OF01A3BK3.48.37.D04.1.454.CMB.1.raw
  modified_base (220)..(221): a, c, t, g, unknown or other
  misc_feature (220)..(221): n is a, c, g, or t

SEQ ID NO: 190486 - DNA, 223 bp, Homo sapiens; identical to SEQ ID NO: 190334
  misc_feature: GYAE6OF01COZMO.48.37.D04.1.454.CMB.1.raw
  modified_base (220)..(223): a, c, t, g, unknown or other
  misc_feature (220)..(223): n is a, c, g, or t

SEQ ID NO: 190487 - DNA, 232 bp, Homo sapiens
  misc_feature: GYAE6OF01AZ9FY.48.37.D04.1.454.CMB.1.raw
  modified_base (219)..(232): a, c, t, g, unknown or other
  misc_feature (219)..(232): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctctctcgactctgagcgggctggcaaggcgcatagnnnnnnnnnnnnnn

SEQ ID NO: 190488 - DNA, 219 bp, Homo sapiens
  misc_feature: GYAE6OF01CAQV7.48.37.D04.1.454.CMB.1.raw
  modified_base (219)..(219): a, c, t, g, unknown or other
  misc_feature (219)..(219): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttccatgtatactctgagcgggctggcaaggcgcatagn

SEQ ID NO: 190489 - DNA, 228 bp, Homo sapiens
  misc_feature: GYAE6OF01D3NA5.48.37.D04.1.454.CMB.1.raw
  modified_base (220)..(228): a, c, t, g, unknown or other
  misc_feature (220)..(228): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnn

SEQ ID NO: 190490 - DNA, 223 bp, Homo sapiens; identical to SEQ ID NO: 190307
  misc_feature: GYAE6OF01CQUW4.48.37.D04.1.454.CMB.1.raw
  modified_base (220)..(223): a, c, t, g, unknown or other
  misc_feature (220)..(223): n is a, c, g, or t

SEQ ID NO: 190491 - DNA, 243 bp, Homo sapiens
  misc_feature: GYAE6OF01EO1K8.48.37.D04.1.454.CMB.1.raw
  modified_base (136)..(136): a, c, t, g, unknown or other
  misc_feature (136)..(136): n is a, c, g, or t
  modified_base (222)..(243): a, c, t, g, unknown or other
  misc_feature (222)..(243): n is a, c, g, or t
tcagagtatacatacacgaccggtgctcgatttagtagcatactggttgggtttggggccaagggacaacggtcgaccgtctcttcagcctccaccaagggcccatcggtcttcccctggcgccctgctccaggancacctccgagagcacagcggccctgggctgcctggtcaaggactacttcctctctcgactctgagcgggctggcaaggcgcatagnnnnnnnnnnnnnnnnnnnnnn

SEQ ID NO: 190492 - DNA, 222 bp, Homo sapiens; identical to SEQ ID NO: 190314
  misc_feature: GYAE6OF01BNCRO.48.37.D04.1.454.CMB.1.raw
  modified_base (220)..(222): a, c, t, g, unknown or other
  misc_feature (220)..(222): n is a, c, g, or t

SEQ ID NO: 190493 - DNA, 228 bp, Homo sapiens
  misc_feature: GYAE6OF01CTQFQ.48.37.D04.1.454.CMB.1.raw
  modified_base (222)..(228): a, c, t, g, unknown or other
  misc_feature (222)..(228): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaagggcgcatagnnnnnnn

SEQ ID NO: 190494 - DNA, 223 bp, Homo sapiens; identical to SEQ ID NO: 190334
  misc_feature: GYAE6OF01ADN68.48.37.D04.1.454.CMB.1.raw
  modified_base (220)..(223): a, c, t, g, unknown or other
  misc_feature (220)..(223): n is a, c, g, or t

SEQ ID NO: 190495 - DNA, 222 bp, Homo sapiens; identical to SEQ ID NO: 190350
  misc_feature: GYAE6OF01A9QAR.48.37.D04.1.454.CMB.1.raw
  modified_base (220)..(222): a, c, t, g, unknown or other
  misc_feature (220)..(222): n is a, c, g, or t

SEQ ID NO: 190496 - DNA, 223 bp, Homo sapiens; identical to SEQ ID NO: 190307
  misc_feature: GYAE6OF01APGE3.48.37.D04.1.454.CMB.1.raw
  modified_base (220)..(223): a, c, t, g, unknown or other
  misc_feature (220)..(223): n is a, c, g, or t

SEQ ID NO: 190497 - DNA, 616 bp, Homo sapiens
  misc_feature: GYAE6OF01EIWQC.48.37.D04.1.454.CMB.1.raw
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
tcagagtatacatacacgaccggtgctcgatttagtagcatactgttgggtttggggggtggtagctcaggaagcagagcctggagcatctccactatggcctgggctccactacttctcaccctcctcgctcactgcacaggttcttgggccctattttatgctgactcacgccccactctgtgtcggagtcgtccggggaagcggtgaccatctcctgccacccgnagcagtggcagtcgttcgccaccaactatgtgctagtcggttccagcaggccggccccggntacgttccgcccatccacgtgtgactctatagaagtaatatgaagacgacccgtcggtccgggtccccgtagttcggttctcgtcggcccttccgagtccgacgtacggtccctaccaacttctcgtcccttcgtcctccacctatcctcgtcggacctgaccgtagcgtagggacggtacgacggtctagtaactttactacgttcgtacgtagttcttaagtgtaagtggtacgtaactaaagtttaggtttgggttttaggggttaggtttcggggaccgggtaggtaaccgtagtcgtaccggtaccgttcgtacggtacccg

SEQ ID NO: 190498 - DNA, 227 bp, Homo sapiens
  misc_feature: GYAE6OF01BKNNJ.48.37.D04.1.454.CMB.1.raw
  modified_base (218)..(227): a, c, t, g, unknown or other
  misc_feature (218)..(227): n is a, c, g, or t
tcagagtatacatacacgaccggtgctcgatttagtagcatactgttgggtttgggccaagggacaacggtcaccgtctcttcagcctccaccaaggcccatcggtcttcccctggcgccctgctccaggagcacctccgagagcacagcggccctgggctgcctggtcaaggactacttcctatgtatactctgagcgggctggcaaggcgcatagnnnnnnnnnn

SEQ ID NO: 190499 - DNA, 228 bp, Homo sapiens
  misc_feature: GYAE6OF01AMSR9.48.37.D04.1.454.CMB.1.raw
  modified_base (221)..(228): a, c, t, g, unknown or other
  misc_feature (221)..(228): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctgggcaaggcgcatagnnnnnnnn

SEQ ID NO: 190500 - DNA, 229 bp, Homo sapiens
  misc_feature: GYAE6OF01CCBLE.48.37.D04.1.454.CMB.1.raw
  modified_base (220)..(229): a, c, t, g, unknown or other
  misc_feature (220)..(229): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggacaaggcgcaatagnnnnnnnnnn

SEQ ID NO: 190501 - DNA, 250 bp, Homo sapiens
  misc_feature: GYAE6OF01ECHAM.48.37.D04.1.454.CMB.1.raw
  modified_base (134)..(134): a, c, t, g, unknown or other
  misc_feature (134)..(134): n is a, c, g, or t
  modified_base (212)..(212): a, c, t, g, unknown or other
  misc_feature (212)..(212): n is a, c, g, or t
  modified_base (217)..(250): a, c, t, g, unknown or other
  misc_feature (217)..(250): n is a, c, g, or t
tcagagtatacatacacgaccggtgctcgatttagtagcatactgttggggtttgggccaagggacaacggtcaccgtctcctcagcctccaccaagggcccatccggtcttcccctggcgccctgctccaggncacctcgagagcacagcggccctgggctgcctggcaaggctacttctatgtactctctgagcgggctggcaagggcanatagnnnnnnnnnnnnnnnnnnnnnnnnnnnnnnnnnn

SEQ ID NO: 190502 - DNA, 299 bp, Homo sapiens
  misc_feature: GYAE6OF01AC48P.48.37.D04.1.454.CMB.1.raw
  modified_base (223)..(227): a, c, t, g, unknown or other
  misc_feature (223)..(227): n is a, c, g, or t
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (234)..(235): a, c, t, g, unknown or other
  misc_feature (234)..(235): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (246)..(247): a, c, t, g, unknown or other
  misc_feature (246)..(247): n is a, c, g, or t
  modified_base (250)..(299): a, c, t, g, unknown or other
  misc_feature (250)..(299): n is a, c, g, or t
tcagagtatacatacacgaccggtgctcgatttagtagcatactgttgggtttgggggccaagggacaacggtcaccgtctcttcagcctccaccaagggcccatcggtcttcccctggcgccctgctccaggagcacctccgagagcacagcggccctgggctgcctggtcaaggactacttcctatgtatactctggagcgggctggcaaggcgcagtagnnnnngntgncnncngntngcnanngcnnnnnnnnnnnnnnnnnnnnnnnnnnnnnnnnnnnnnnnnnnnnnnnnnn

SEQ ID NO: 190503 - DNA, 221 bp, Homo sapiens; identical to SEQ ID NO: 190302
  misc_feature: GYAE6OF01AYNCD.48.37.D04.1.454.CMB.1.raw
  modified_base (220)..(221): a, c, t, g, unknown or other
  misc_feature (220)..(221): n is a, c, g, or t

SEQ ID NO: 190504 - DNA, 224 bp, Homo sapiens; identical to SEQ ID NO: 190451
  misc_feature: GYAE6OF01BF527.48.37.D04.1.454.CMB.1.raw
  modified_base (220)..(224): a, c, t, g, unknown or other
  misc_feature (220)..(224): n is a, c, g, or t

SEQ ID NO: 190505 - DNA, 226 bp, Homo sapiens
  misc_feature: GYAE6OF01A2T6D.48.37.D04.1.454.CMB.1.raw
  modified_base (220)..(226): a, c, t, g, unknown or other
  misc_feature (220)..(226): n is a, c, g, or t
tcagagtatacatacacgaccggtgctcgatttagtagcatactgttgggtttgggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnn

SEQ ID NO: 190506 - DNA, 232 bp, Homo sapiens
  misc_feature: GYAE6OF01C9BMK.48.37.D04.1.454.CMB.1.raw
  modified_base (222)..(232): a, c, t, g, unknown or other
  misc_feature (222)..(232): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgaggcgggctggacaaggcgcatagnnnnnnnnnnn

SEQ ID NO: 190507 - DNA, 221 bp, Homo sapiens; identical to SEQ ID NO: 190302
  misc_feature: GYAE6OF01CABPE.48.37.D04.1.454.CMB.1.raw
  modified_base (220)..(221): a, c, t, g, unknown or other
  misc_feature (220)..(221): n is a, c, g, or t

SEQ ID NO: 190508 - DNA, 822 bp, Homo sapiens
  misc_feature: GYAE6OF01DARBF.48.37.D04.1.454.CMB.1.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagagtatacatacacgaccggtgctcgatttagtagcatactgttgggtttggggggtggtagctcaggaagcagagcctggagcatctccactatggcctgggctccactacttctcaccctcctcgctcactgcacaggttcttgggcccattttatgctgactcagccccatctgtgtcggagtcgtccggggaanacggtgaccatctcctgccacccgcagcaggtggcagtcgtgccaccaactagtgtgcagtcgttccagcagccggcccggnacgttccgacccaatcactgtcgatcgtatgaagtaataagtggaacgtacgtaccgttcggtccggggttaccccgtagttccggttccgttcgtacgggtccctaccgtaaccgtccggtaacgtaacggttccccttaccctaaccgttccgtaccgtccccttccttaccttcccaaccctaccgttcctacggtacggtaccgttacgaccgtaacggtaccgtagggtaaccgggaacgtacgggtaccttaacgggttaaccttttaacccgtaacgtttacggttaccgttaacggttttacgtttaaacggttggtaaaacggtttacggggttaaacgggtaaaccgttaaaaggttttaaacgggtttttggggggtttttaaccgggggtttttgggggtttttaaaccgggggggaacccggggggtttaaaaccggggaaaccccggttaaaacgggttacccggttaaccccggggtttaaacccccgggttacccggtttaaacccggggttaaacccccggg

SEQ ID NO: 190509 - DNA, 225 bp, Homo sapiens; identical to SEQ ID NO: 190459
  misc_feature: GYAE6OF01BL46U.48.37.D04.1.454.CMB.1.raw
  modified_base (220)..(225): a, c, t, g, unknown or other
  misc_feature (220)..(225): n is a, c, g, or t

SEQ ID NO: 190510 - DNA, 229 bp, Homo sapiens
  misc_feature: GYAE6OF01EAJNY.48.37.D04.1.454.CMB.1.raw
  modified_base (223)..(229): a, c, t, g, unknown or other
  misc_feature (223)..(229): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctgctccaggagcacctccgagagcacagccggccctgggctgcctggtcaaggcttacttcctatgtatactctgagcgggctggcgaaggcgcatagnnnnnnn

SEQ ID NO: 190511 - DNA, 226 bp, Homo sapiens
  misc_feature: GYAE6OF01DEMU1.48.37.D04.1.454.CMB.1.raw
  modified_base (220)..(226): a, c, t, g, unknown or other
  misc_feature (220)..(226): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnn

SEQ ID NO: 190512 - DNA, 303 bp, Homo sapiens
  misc_feature: GYAE6OF01DUHIH.48.37.D04.1.454.CMB.1.raw
  modified_base (126)..(126): a, c, t, g, unknown or other
  misc_feature (126)..(126): n is a, c, g, or t
  modified_base (140)..(140): a, c, t, g, unknown or other
  misc_feature (140)..(140): n is a, c, g, or t
  modified_base (233)..(303): a, c, t, g, unknown or other
  misc_feature (233)..(303): n is a, c, g, or t
tcagagtatacatacacgaccggtgctcgatttagtagcatactgttgggtttgggggccgaagggacaacggtcaccgtctcttcgagcctccaccaagggccccatcggtcttccccctggccnccctcgctccaggncacctccgagagcacagcggccctgggctgccctggtcaaaggactacttccctatgtatactctgacgcgggctgggccaaggcgcatacgnnnnnnnnnnnnnnnnnnnnnnnnnnnnnnnnnnnnnnnnnnnnnnnnnnnnnnnnnnnnnnnnnnnnnnn

SEQ ID NO: 190513 - DNA, 228 bp, Homo sapiens; identical to SEQ ID NO: 190489
  misc_feature: GYAE6OF01BCQJA.48.37.D04.1.454.CMB.1.raw
  modified_base (220)..(228): a, c, t, g, unknown or other
  misc_feature (220)..(228): n is a, c, g, or t

SEQ ID NO: 190514 - DNA, 233 bp, Homo sapiens
  misc_feature: GYAE6OF01BXDHI.48.37.D04.1.454.CMB.1.raw
  modified_base (221)..(233): a, c, t, g, unknown or other
  misc_feature (221)..(233): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggcaaggactacttcctatgtatactctgagcgggctgggcaaggcgcaatagnnnnnnnnnnnnn

SEQ ID NO: 190515 - DNA, 222 bp, Homo sapiens; identical to SEQ ID NO: 190314
  misc_feature: GYAE6OF01EWNXM.48.37.D04.1.454.CMB.1.raw
  modified_base (220)..(222): a, c, t, g, unknown or other
  misc_feature (220)..(222): n is a, c, g, or t

SEQ ID NO: 190516 - DNA, 259 bp, Homo sapiens
  misc_feature: GYAE6OF01E5TLZ.48.37.D04.1.454.CMB.1.raw
  modified_base (223)..(223): a, c, t, g, unknown or other
  misc_feature (223)..(223): n is a, c, g, or t
  modified_base (228)..(259): a, c, t, g, unknown or other
  misc_feature (228)..(259): n is a, c, g, or t
tcagagtatacatacacgaccggtgctcgatttagtagcatactgttgggttttgggggccaagggacaacggtcaccgtctcttcagcctccaccaagggcccgactcggtcttccccctggcgcccgtgcctccaggagcacctcccgagagcacagcggccctgggctgcctggtcaaggactacttcctctctcgactctgagcgggctggcaaggcgnatagnnnnnnnnnnnnnnnnnnnnnnnnnnnnnnnn

SEQ ID NO: 190517 - DNA, 223 bp, Homo sapiens
  misc_feature: GYAE6OF01CJJTU.48.37.D04.1.454.CMB.1.raw
  modified_base (219)..(223): a, c, t, g, unknown or other
  misc_feature (219)..(223): n is a, c, g, or t
tcagagtatacatacacgaccggtgctcgatttagtagcatactgttgggtttggggccaagggacaacggtcaccgtctcttcagcctccaccaaggcccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 190518 - DNA, 235 bp, Homo sapiens
  misc_feature: GYAE6OF01BR5MA.48.37.D04.1.454.CMB.1.raw
  modified_base (215)..(215): a, c, t, g, unknown or other
  misc_feature (215)..(215): n is a, c, g, or t
  modified_base (221)..(235): a, c, t, g, unknown or other
  misc_feature (221)..(235): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgcctccaggagcacctccgagagcacagcggccctgggctgcctggtcaaggactacttcctatgtatactctgagcgggctggcaaggcncatagnnnnnnnnnnnnnnn

SEQ ID NO: 190519 - DNA, 223 bp, Homo sapiens
  misc_feature: GYAE6OF01A4752.48.37.D04.1.454.CMB.1.raw
  modified_base (214)..(214): a, c, t, g, unknown or other
  misc_feature (214)..(214): n is a, c, g, or t
  modified_base (219)..(223): a, c, t, g, unknown or other
  misc_feature (219)..(223): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcncatgnnnnn

SEQ ID NO: 190520 - DNA, 223 bp, Homo sapiens; identical to SEQ ID NO: 190307
  misc_feature: GYAE6OF01EPITC.48.37.D04.1.454.CMB.1.raw
  modified_base (220)..(223): a, c, t, g, unknown or other
  misc_feature (220)..(223): n is a, c, g, or t

SEQ ID NO: 190521 - DNA, 240 bp, Homo sapiens
  misc_feature: GYAE6OF01AHM8R.48.37.D04.1.454.CMB.1.raw
  modified_base (215)..(215): a, c, t, g, unknown or other
  misc_feature (215)..(215): n is a, c, g, or t
  modified_base (220)..(240): a, c, t, g, unknown or other
  misc_feature (220)..(240): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgnatagnnnnnnnnnnnnnnnnnnnnn

SEQ ID NO: 190522 - DNA, 237 bp, Homo sapiens
  misc_feature: GYAE6OF01EQZ0N.48.37.D04.1.454.CMB.1.raw
  modified_base (222)..(237): a, c, t, g, unknown or other
  misc_feature (222)..(237): n is a, c, g, or t
tcagagtatacatacacgaccggtgctcgatttagtagcatactgttgggtttggggccaaaggggacaacggtcaccgtctcttcagcctccaccaagggcccatcggtcttcccctggcgccctgctccaggagccacctccgagagcacagcggccctgggctgcctggtcaaggctacttcctatgtatactctgagcgggctggcaaggcgcatagnnnnnnnnnnnnnnnn

SEQ ID NO: 190523 - DNA, 234 bp, Homo sapiens
  misc_feature: GYAE6OF01EFK0U.48.37.D04.1.454.CMB.1.raw
  modified_base (222)..(234): a, c, t, g, unknown or other
  misc_feature (222)..(234): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctgggcaaggcgcatagnnnnnnnnnnnnn

SEQ ID NO: 190524 - DNA, 222 bp, Homo sapiens; identical to SEQ ID NO: 190314
  misc_feature: GYAE6OF01DZS2V.48.37.D04.1.454.CMB.1.raw
  modified_base (220)..(222): a, c, t, g, unknown or other
  misc_feature (220)..(222): n is a, c, g, or t

SEQ ID NO: 190525 - DNA, 227 bp, Homo sapiens
  misc_feature: GYAE6OF01D4IB2.48.37.D04.1.454.CMB.1.raw
  modified_base (220)..(227): a, c, t, g, unknown or other
  misc_feature (220)..(227): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnn

SEQ ID NO: 190526 - DNA, 222 bp, Homo sapiens; identical to SEQ ID NO: 190314
  misc_feature: GYAE6OF01AQ6EP.48.37.D04.1.454.CMB.1.raw
  modified_base (220)..(222): a, c, t, g, unknown or other
  misc_feature (220)..(222): n is a, c, g, or t

SEQ ID NO: 190527 - DNA, 226 bp, Homo sapiens
  misc_feature: GYAE6OF01ACV6X.48.37.D04.1.454.CMB.1.raw
  modified_base (215)..(215): a, c, t, g, unknown or other
  misc_feature (215)..(215): n is a, c, g, or t
  modified_base (221)..(226): a, c, t, g, unknown or other
  misc_feature (221)..(226): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcncatagnnnnnn

SEQ ID NO: 190528 - DNA, 224 bp, Homo sapiens; identical to SEQ ID NO: 190329
  misc_feature: GYAE6OF01ED3WH.48.37.D04.1.454.CMB.1.raw
  modified_base (220)..(224): a, c, t, g, unknown or other
  misc_feature (220)..(224): n is a, c, g, or t

SEQ ID NO: 190529 - DNA, 227 bp, Homo sapiens
  misc_feature: GYAE6OF01AUY47.48.37.D04.1.454.CMB.1.raw
  modified_base (220)..(227): a, c, t, g, unknown or other
  misc_feature (220)..(227): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnn

SEQ ID NO: 190530 - DNA, 229 bp, Homo sapiens
  misc_feature: GYAE6OF01BZRCZ.48.37.D04.1.454.CMB.1.raw
  modified_base (222)..(229): a, c, t, g, unknown or other
  misc_feature (222)..(229): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcgatagnnnnnnnn

SEQ ID NO: 190531 - DNA, 221 bp, Homo sapiens; identical to SEQ ID NO: 190302
  misc_feature: GYAE6OF01B8U6N.48.37.D04.1.454.CMB.1.raw
  modified_base (220)..(221): a, c, t, g, unknown or other
  misc_feature (220)..(221): n is a, c, g, or t

SEQ ID NO: 190532 - DNA, 237 bp, Homo sapiens
  misc_feature: GYAE6OF01DMTPB.48.37.D04.1.454.CMB.1.raw
  modified_base (216)..(216): a, c, t, g, unknown or other
  misc_feature (216)..(216): n is a, c, g, or t
  modified_base (223)..(237): a, c, t, g, unknown or other
  misc_feature (223)..(237): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagccggccctgggctgcctggtcaaggactacttcctatgtatactctgagcgggctggcaaggcncagtagnnnnnnnnnnnnnnn

SEQ ID NO: 190533 - DNA, 230 bp, Homo sapiens
  misc_feature: GYAE6OF01CASCT.48.37.D04.1.454.CMB.1.raw
  modified_base (220)..(230): a, c, t, g, unknown or other
  misc_feature (220)..(230): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnn

SEQ ID NO: 190534 - DNA, 227 bp, Homo sapiens
  misc_feature: GYAE6OF01A5BDS.48.37.D04.1.454.CMB.1.raw
  modified_base (221)..(227): a, c, t, g, unknown or other
  misc_feature (221)..(227): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctgggcaaggcgcatagnnnnnnn

SEQ ID NO: 190535 - DNA, 201 bp, Homo sapiens
  misc_feature: GYAE6OF01D4MKI.48.37.D04.1.454.CMB.1.raw
  modified_base (149)..(149): a, c, t, g, unknown or other
  misc_feature (149)..(149): n is a, c, g, or t
  modified_base (156)..(201): a, c, t, g, unknown or other
  misc_feature (156)..(201): n is a, c, g, or t
tcagagtatacatacacgaccggtgctcgatttagtagcatactgttggggtttgggaccaaggtggaagtcaaacgaactgtggctgcaccatctgtcttcatcttccgcatctgatatgtatactctgagcgggctggcaagggtcnctatagnnnnnnnnnnnnnnnnnnnnnnnnnnnnnnnnnnnnnnnnnnnnnn

SEQ ID NO: 190536 - DNA, 226 bp, Homo sapiens
  misc_feature: GYAE6OF01B17M9.48.37.D04.1.454.CMB.1.raw
  modified_base (214)..(214): a, c, t, g, unknown or other
  misc_feature (214)..(214): n is a, c, g, or t
  modified_base (220)..(226): a, c, t, g, unknown or other
  misc_feature (220)..(226): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggctacttcctctctcgactctgagcgggctggcaaggcncatagnnnnnnn

SEQ ID NO: 190537 - DNA, 226 bp, Homo sapiens; identical to SEQ ID NO: 190511
  misc_feature: GYAE6OF01D0KZX.48.37.D04.1.454.CMB.1.raw
  modified_base (220)..(226): a, c, t, g, unknown or other
  misc_feature (220)..(226): n is a, c, g, or t

SEQ ID NO: 190538 - DNA, 220 bp, Homo sapiens; identical to SEQ ID NO: 190321
  misc_feature: GYAE6OF01BF8T6.48.37.D04.1.454.CMB.1.raw
  modified_base (220)..(220): a, c, t, g, unknown or other
  misc_feature (220)..(220): n is a, c, g, or t

SEQ ID NO: 190539 - DNA, 251 bp, Homo sapiens
  misc_feature: GYAE6OF01EY2SH.48.37.D04.1.454.CMB.1.raw
  modified_base (223)..(251): a, c, t, g, unknown or other
  misc_feature (223)..(251): n is a, c, g, or t
tcagagtatacatacacgaccggtgctcgatttagtagcatactgttgggtttgggggccaagggacaacggtcaccgtctcttcagcctccaccaagggcccatcggtcttcccctggcgccctgctccaggagcacctccgagagcacagccggccctgggctgcctggtcaaggactacttcctatgtactactctgagcgggctggcaaggcgcatagnnnnnnnnnnnnnnnnnnnnnnnnnnnnn

SEQ ID NO: 190540 - DNA, 577 bp, Homo sapiens
  misc_feature: GYAE6OF01AZFQF.48.37.D04.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
tcagagtatacatacacgaccggtgctcgatttagtagcatactgttgggtttggggggtggtagctcaggaagcagagcctggagcatctccactatggcctgggctccactacttctcaccctcctcgctcactgcacaggttcttgggccctattttatgctgactcagccccactctgtgtcggagtccgtccggggaagcggtgaccatctctgcaccgnagcagtgcagcgtnccaccaactatgtgntagtggtccagcagcgccggcagtccgccatccactgtgactctatagagaatangagacnccgtgtcggccctagtcggtctcgcgctacntcgacacggtctaccaactcncgtcctctcctacactactctccgtgtacctgacacgtacgtagggaacgaacggagtaccgttagtaacgttaacctacgtacggtacttaacgttcgttagtagtaacgttggtacgtaaagttaacgttagtttcgggttagggtttaggttacgggacgggaaggtacccgtaagtaccgtacggtacccggttcgtggtaacccg

SEQ ID NO: 190541 - DNA, 775 bp, Homo sapiens
  misc_feature: GYAE6OF01CZCL7.48.37.D04.1.454.CMB.1.raw
  modified_base (226)..(226): a, c, t, g, unknown or other
  misc_feature (226)..(226): n is a, c, g, or t
tcagagtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcacgccccactctgtgtcggagtctccggggaagacggtgaccatctcctgccacccgnagcagtggcagcgtgccaccaatatgtcgctagttcggtccagcacgccggcccgggctacggttccgcccatacgacgtgtgatactagtaggaagtaaataagtaggaacgtacgtacccgttccggtaccggggtcccccgtaagtttcccgggttcttccggtcggtccctacctacgtccgacgtaccggttaccctaccaacccgttctccgtcccttccgttcctaccaaccctacttccgttaccgtacgggtaccttacggccgtaaacggtaccggtaagggaaccgggtaacggtacgggtaccgtttaggtaaaccttttaccgtaacgtttacggttaccgttacggtttaccttaatacggttaacgttaacggttaacgggtaaaccttaaagtttaacgggttttacggggtttttagggggttaacggggttttaccgggggtaaccgggggtaaccgggttaaaccggtaacccggtaacggttacccgggtaaaccccgggtttacccggtaaccggggttaaaccccgg

SEQ ID NO: 190542 - DNA, 225 bp, Homo sapiens
  misc_feature: GYAE6OF01EB485.48.37.D04.1.454.CMB.1.raw
  modified_base (220)..(225): a, c, t, g, unknown or other
  misc_feature (220)..(225): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnn

SEQ ID NO: 190543 - DNA, 223 bp, Homo sapiens
  misc_feature: GYAE6OF01D5OCP.48.37.D04.1.454.CMB.1.raw
  modified_base (215)..(215): a, c, t, g, unknown or other
  misc_feature (215)..(215): n is a, c, g, or t
  modified_base (219)..(223): a, c, t, g, unknown or other
  misc_feature (219)..(223): n is a, c, g, or t
tcagagtatacatacacgaccggtgctcgatttagtagcatactgttgggtttggggccaagggacaacggtcaccgtctcttcagcctccaccaaggcccatcggtcttcccctggcgccctgcctccaggagcacctccgagagcacagcggccctgggctgcctggtcaaggctacttcctatgtatactctgagcgggctggcgaaggcgnatgnnnnn

SEQ ID NO: 190544 - DNA, 231 bp, Homo sapiens
  misc_feature: GYAE6OF01CZF2E.48.37.D04.1.454.CMB.1.raw
  modified_base (219)..(231): a, c, t, g, unknown or other
  misc_feature (219)..(231): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctcgagagcacagcggccctgggctgcctggtcaaggactacttctctctcgactctgagcgggctggcaaggcgacatagnnnnnnnnnnnnn

SEQ ID NO: 190545 - DNA, 223 bp, Homo sapiens
  misc_feature: GYAE6OF01B01GY.48.37.D04.1.454.CMB.1.raw
  modified_base (212)..(212): a, c, t, g, unknown or other
  misc_feature (212)..(212): n is a, c, g, or t
  modified_base (217)..(223): a, c, t, g, unknown or other
  misc_feature (217)..(223): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggcaggcnatagnnnnnnn

SEQ ID NO: 190546 - DNA, 238 bp, Homo sapiens
  misc_feature: GYAE6OF01AXPFD.48.37.D04.1.454.CMB.1.raw
  modified_base (220)..(238): a, c, t, g, unknown or other
  misc_feature (220)..(238): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcgccctgggctgcctggtcaaggactacttcctatgtatactctgagcgggctgggcaaggcgcatagnnnnnnnnnnnnnnnnnnn

SEQ ID NO: 190547 - DNA, 243 bp, Homo sapiens
  misc_feature: GYAE6OF01D2FPZ.48.37.D04.1.454.CMB.1.raw
  modified_base (223)..(243): a, c, t, g, unknown or other
  misc_feature (223)..(243): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctcgagagcacagccggccctgggctgcctggtacaaggactacttcctatgtatactctgaggcggctggacaaggcgacatagnnnnnnnnnnnnnnnnnnnnn

SEQ ID NO: 190548 - DNA, 235 bp, Homo sapiens
  misc_feature: GYAE6OF01A04SV.48.37.D04.1.454.CMB.1.raw
  modified_base (135)..(135): a, c, t, g, unknown or other
  misc_feature (135)..(135): n is a, c, g, or t
  modified_base (216)..(216): a, c, t, g, unknown or other
  misc_feature (216)..(216): n is a, c, g, or t
  modified_base (222)..(235): a, c, t, g, unknown or other
  misc_feature (222)..(235): n is a, c, g, or t
tcagagtatacatacacgaccggtgctcgatttagtagcatactgttgggtttggggccaagggacaacggtcgaccgtctcttcagcctccaccaagggcccatcggtcttcccctggcgccctgctccaggancacctccgagagcacagcggccctggggctgcctggtcaaggactacttcctctctcgactctgagcgggctggcaaggcncatagnnnnnnnnnnnnnn

SEQ ID NO: 190549 - DNA, 228 bp, Homo sapiens; identical to SEQ ID NO: 190489
  misc_feature: GYAE6OF01BP5D2.48.37.D04.1.454.CMB.1.raw
  modified_base (220)..(228): a, c, t, g, unknown or other
  misc_feature (220)..(228): n is a, c, g, or t

SEQ ID NO: 190550 - DNA, 232 bp, Homo sapiens
  misc_feature: GYAE6OF01DAHLD.48.37.D04.1.454.CMB.1.raw
  modified_base (222)..(232): a, c, t, g, unknown or other
  misc_feature (222)..(232): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggacctacttcctatgtatactctgaggcgggctggcaaggcgcatagnnnnnnnnnnn

SEQ ID NO: 190551 - DNA, 245 bp, Homo sapiens
  misc_feature: GYAE6OF01EB1J8.48.37.D04.1.454.CMB.1.raw
  modified_base (219)..(219): a, c, t, g, unknown or other
  misc_feature (219)..(219): n is a, c, g, or t
  modified_base (226)..(245): a, c, t, g, unknown or other
  misc_feature (226)..(245): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagccggccctgggctgcctggtcaaggacttacttctatgtatactctgaggcggctggacaaggccgnagtagcnnnnnnnnnnnnnnnnnnnn

SEQ ID NO: 190552 - DNA, 289 bp, Homo sapiens
  misc_feature: GYAE6OF01EPJS0.48.37.D04.1.454.CMB.1.raw
  modified_base (255)..(289): a, c, t, g, unknown or other
  misc_feature (255)..(289): n is a, c, g, or t
tcagagtatacatacacgaccggtgctcgatttagtagcatactggttgggtttgggggccaagggacaacggtcaccgtctcttcagcctccaccaagggcccatcggtccttcccctggccgccctgcctccgaggacgccaccctccgagagcacaggccggcccgtgggctcgccgtggtaccaaggtaccttctttccctctcctcgaccttcgtaggcggccgggtctgggaccgaagggccactatgnnnnnnnnnnnnnnnnnnnnnnnnnnnnnnnnnnn

SEQ ID NO: 190553 - DNA, 235 bp, Homo sapiens; identical to SEQ ID NO: 190341
  misc_feature: GYAE6OF01ERMD3.48.37.D04.1.454.CMB.1.raw
  modified_base (220)..(235): a, c, t, g, unknown or other
  misc_feature (220)..(235): n is a, c, g, or t

SEQ ID NO: 190554 - DNA, 240 bp, Homo sapiens
  misc_feature: GYAE6OF01CXNJC.48.37.D04.1.454.CMB.1.raw
  modified_base (218)..(218): a, c, t, g, unknown or other
  misc_feature (218)..(218): n is a, c, g, or t
  modified_base (225)..(240): a, c, t, g, unknown or other
  misc_feature (225)..(240): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctatgtatactcgtgacggcgggctggacaagggcncgatagnnnnnnnnnnnnnnnn

SEQ ID NO: 190555 - DNA, 227 bp, Homo sapiens
  misc_feature: GYAE6OF01D0J2F.48.37.D04.1.454.CMB.1.raw
  modified_base (221)..(227): a, c, t, g, unknown or other
  misc_feature (221)..(227): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagccggccctgggctgcctggtcaaggactacttcctatgtatactctgagcgggctggcaaggcgcatagnnnnnnn

SEQ ID NO: 190556 - DNA, 749 bp, Homo sapiens
  misc_feature: GYAE6OF01CP6ES.48.37.D04.1.454.CMB.1.raw
tcagagtatacatacacgaccggtgctcgatttagtagcatactgttgggtttggggggtggtagctcaggaagcagagcctggagcatctccactatggcctgggcctccactacttctccaccctcctcgctcactcgcactaggttcgttcgggccctattttatgctcgactcaccgcccctactctgtcggtcggtacgtccggtaccggggaagacggtcgacctattcctcctcgccacccgcgagcgacggtggcgtacgtccggttaccgaccctaaaccacttagtggtcgtcggtaggtcggtaccgacggccgaccggcccgggtcccggtacgtaccggtacccgtacctactccgtacgtgtactaccgtatagtagaaataagtagacggacgtaccgtccggttccggtaccggtcccgtagttccggtcgtcgtccgtcctacgtcgtaccgacgtaccgtacctaccctacgttcctaccgtcccttacgtcctacctactacgttccgacgtacgtcacgactcggtacggtaaggaccggtaagtcggtacttacttaaaccttcggtcgttaacgtccgtttagttctagtaggttaatacgggttaactaaacgtttagggttttaagggttcggggttttaagggggttcgtaaacgggggtaacgtacccgggtaccgttacgggtcccttaaccggttcccgggtacggtaacccgtacccggg

SEQ ID NO: 190557 - DNA, 232 bp, Homo sapiens
  misc_feature: GYAE6OF01DOPEQ.48.37.D04.1.454.CMB.1.raw
  modified_base (214)..(214): a, c, t, g, unknown or other
  misc_feature (214)..(214): n is a, c, g, or t
  modified_base (220)..(232): a, c, t, g, unknown or other
  misc_feature (220)..(232): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcggctggacaaggcncatagnnnnnnnnnnnnn

SEQ ID NO: 190558 - DNA, 227 bp, Homo sapiens
  misc_feature: GYAE6OF01CVJ9W.48.37.D04.1.454.CMB.1.raw
  modified_base (215)..(215): a, c, t, g, unknown or other
  misc_feature (215)..(215): n is a, c, g, or t
  modified_base (221)..(227): a, c, t, g, unknown or other
  misc_feature (221)..(227): n is a, c, g, or t
tcagagtatacatacacgaccggtgctcgatttagtagcatactgttgggtttggggccaaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcncatagnnnnnnn

SEQ ID NO: 190559 - DNA, 234 bp, Homo sapiens
  misc_feature: GYAE6OF01DXZV3.48.37.D04.1.454.CMB.1.raw
  modified_base (221)..(234): a, c, t, g, unknown or other
  misc_feature (221)..(234): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcagtagnnnnnnnnnnnnnn

SEQ ID NO: 190560 - DNA, 226 bp, Homo sapiens
  misc_feature: GYAE6OF01BOWOL.48.37.D04.1.454.CMB.1.raw
  modified_base (220)..(226): a, c, t, g, unknown or other
  misc_feature (220)..(226): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcggctggcaaggcgcatagnnnnnnn

SEQ ID NO: 190561 - DNA, 230 bp, Homo sapiens
  misc_feature: GYAE6OF01C13FL.48.37.D04.1.454.CMB.1.raw
  modified_base (212)..(212): a, c, t, g, unknown or other
  misc_feature (212)..(212): n is a, c, g, or t
  modified_base (219)..(230): a, c, t, g, unknown or other
  misc_feature (219)..(230): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctcgagagcacagcggccctgggctgcctggtcaaggactacttctatgtatactctgagcgggctggcaaggcncagtagnnnnnnnnnnnn

SEQ ID NO: 190562 - DNA, 812 bp, Homo sapiens
  misc_feature: GYAE6OF01BB2OP.48.37.D04.1.454.CMB.1.raw
  modified_base (244)..(244): a, c, t, g, unknown or other
  misc_feature (244)..(244): n is a, c, g, or t
  modified_base (355)..(355): a, c, t, g, unknown or other
  misc_feature (355)..(355): n is a, c, g, or t
tcagagtatacatacacgaccggtgctcgatttagtagcatactgttgggtttgggggtggtagctcaggaagcagagcctggagcatctccactatggcctgggctccactacttctccaccctcctcgctcactgcacgaggtttcgttcgggccctattttatgctgactcacgccccatctgtgtcggagtccggtaccggggaacgacggtcgacctatcctccgtcgaccgaccccgnacgcaggtcggcacggtcgttccgacccaaccaacttagtggtcgactagggtttccgttaccacggccaccggccggcccgggtctacgtcccgaccctatccacgttgngtactactagtagaataactaagcgacgtaccgtacccgtcgggtacccggtaccctaggtttccgttctcggtcctaccgtactacgtacccggacggttacccgtaccctacccgacgttcgttaccgtccctttccctaccgtacctaccttccgttacccgttcggaccggttaccgttacaccgggttaacgaccggttacgggaaccgggtaacggttacgggaccgttaacgttaaacgttttcccgttaaacggttccgttaacccgtttaaggtttaaccgttaggttaacgggttacttaacggggttaacgtaaacgtttaaaccgggtttttaacgggttttcggggtttttagggtacggggttttaccgggggaaccggttaaacggacgttaacgggtaccccgtaccggtaacccggttccgggtttaccgaaaccccggg

SEQ ID NO: 190563 - DNA, 296 bp, Homo sapiens
  misc_feature: GYAE6OF01C5C8Z.48.37.D04.1.454.CMB.1.raw
  modified_base (120)..(120): a, c, t, g, unknown or other
  misc_feature (120)..(120): n is a, c, g, or t
  modified_base (247)..(296): a, c, t, g, unknown or other
  misc_feature (247)..(296): n is a, c, g, or t
tcagagtatacatacacgaccggtgctcgatttagtagcatactgttgggtttggggccaagggacaacggtcaccgtctcttcagcctccaccaagggcccatcggtcttcccctggcncccctgcctccaggacgccacctccgagagcacagcggccctgggctgccgtggtacaaggtaccttacttcctagtgtaacttcctcgtggacggtccgggctacggacgaagggcgactagtagnnnnnnnnnnnnnnnnnnnnnnnnnnnnnnnnnnnnnnnnnnnnnnnnnn

SEQ ID NO: 190564 - DNA, 626 bp, Homo sapiens
  misc_feature: GYAE6OF01AKI59.48.37.D04.1.454.CMB.1.raw
  modified_base (145)..(145): a, c, t, g, unknown or other
  misc_feature (145)..(145): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctgctccaggagcacctccganagcacagcggccctgggctgcctggtcaaggacttacttcctattgtatactacgtgaggcggctgggccaaagggccacaagtagcantgatgnacgttcgctggcatacgtngctaagcgtgccttggngttaccaggntttacgcttaagggntacnggtacncgtacncacgtanacgtgactacngcgtaanccgngcgttcgcgtccgactaagcgcgacgcgtcgtcgtacgtacgtactacgtacgtacgtacgtcgtacgtacgtacgtacgtctacgcgtacgtcgtaccgtcgtaccggtaccgtccgtacgtacgtacgtaccgtaccgtacctccggtccgtacgtacgtaccgtacggtaccgtaccgttacgtacgtaccgtacgtaccggtaccgtacgtacgtacgtaccggtaccgtaccgtaccgtacgtacgtaccgtaccgtccgttccgtacccgtacg

SEQ ID NO: 190565 - DNA, 302 bp, Homo sapiens
  misc_feature: GYAE6OF01BTCQZ.48.37.D04.1.454.CMB.1.raw
  modified_base (136)..(136): a, c, t, g, unknown or other
  misc_feature (136)..(136): n is a, c, g, or t
  modified_base (147)..(147): a, c, t, g, unknown or other
  misc_feature (147)..(147): n is a, c, g, or t
  modified_base (151)..(151): a, c, t, g, unknown or other
  misc_feature (151)..(151): n is a, c, g, or t
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (238)..(302): a, c, t, g, unknown or other
  misc_feature (238)..(302): n is a, c, g, or t
tcagagtatacatacacgaccggtgctcgatttagtagcatactgttgggtttggggccaagggacaacggtcaccgtctcttcagcctccaccaagggcccagtcggtcttccccctggcgccctgctccaggancacctcgagancacngcggccctagggctgcctggtacaaggacttacttccgtaatgtaactctcgtgnggaccgtgtagcgaaggcatanagntncgacnnnnnnnnnnnnnnnnnnnnnnnnnnnnnnnnnnnnnnnnnnnnnnnnnnnnnnnnnnnnnnnnn

SEQ ID NO: 190566 - DNA, 270 bp, Homo sapiens
  misc_feature: GYAE6OF01E4SHN.48.37.D04.1.454.CMB.1.raw
  modified_base (223)..(270): a, c, t, g, unknown or other
  misc_feature (223)..(270): n is a, c, g, or t
tcagagtatacatacacgaccggtgctcgatttagtagcatactgttgggtttgggggccaagggacaacggtcaccgtctcttcagcctccaccaagggcccatcggtcttcccctggcgccctgctccaggagcacctccgagagcacagcggccctgggctgcctggtcaaaggactacttcctatgtatactctggagcgggctggcaaggcgcatagnnnnnnnnnnnnnnnnnnnnnnnnnnnnnnnnnnnnnnnnnnnnnnnn

SEQ ID NO: 190567 - DNA, 245 bp, Homo sapiens
  misc_feature: GYAE6OF01CSEF2.48.37.D04.1.454.CMB.1.raw
  modified_base (137)..(137): a, c, t, g, unknown or other
  misc_feature (137)..(137): n is a, c, g, or t
  modified_base (146)..(146): a, c, t, g, unknown or other
  misc_feature (146)..(146): n is a, c, g, or t
  modified_base (152)..(152): a, c, t, g, unknown or other
  misc_feature (152)..(152): n is a, c, g, or t
  modified_base (215)..(215): a, c, t, g, unknown or other
  misc_feature (215)..(215): n is a, c, g, or t
  modified_base (221)..(245): a, c, t, g, unknown or other
  misc_feature (221)..(245): n is a, c, g, or t
tcagagtatacatacacgaccggtgctcgatttagtagcatactgttgggtttggggccaagggacaacggtcaccgtctcttcagcctccaccaagggcccatccggtccttccccgtggcgccctgctccaggancacctcganagcacngcgccctgggctgcctggcaaggctacttcctatgtatactctggagcgggctggacaaggcncatagnnnnnnnnnnnnnnnnnnnnnnnnn

SEQ ID NO: 190568 - DNA, 152 bp, Homo sapiens
  misc_feature: GYAE6OF02F9MNK.48.37.D04.1.454.CMB.1.raw
  modified_base (150)..(152): a, c, t, g, unknown or other
  misc_feature (150)..(152): n is a, c, g, or t
tcagagtatacatacacgaccggtgctcgatttagtagcatactgttgggttggaccaaggtggaagtcaacgaactgtggctgcaccatctgtcttcatcttccgccatctgatatgtatactctgagcgggctggcaaggcgcatagnnn

SEQ ID NO: 190569 - DNA, 152 bp, Homo sapiens
  misc_feature: GYAE6OF02HKX2W.48.37.D04.1.454.CMB.1.raw
  modified_base (150)..(152): a, c, t, g, unknown or other
  misc_feature (150)..(152): n is a, c, g, or t
tcagagtatacatacacgaccggtgctcgatttagtagcatactgttggttggaccaaggtggaagtcaacgaactgtggctgcaccatctgtcttcatcttcccgccatctgatatgtatactctgagcgggctggcaaggcgcatagnnn

SEQ ID NO: 190570 - DNA, 237 bp, Homo sapiens
  misc_feature: GYAE6OF02GD1QP.48.37.D04.1.454.CMB.1.raw
  modified_base (220)..(237): a, c, t, g, unknown or other
  misc_feature (220)..(237): n is a, c, g, or t
tcagagtatacatacacgaccggtgctcgatttagtagcatactgttgggtttggggccaagggacgaacggtcaccgtctcttcagcctccaccaagggccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnn

SEQ ID NO: 190571 - DNA, 216 bp, Homo sapiens
  misc_feature: GYAE6OF02HKYCP.48.37.D04.1.454.CMB.1.raw
  modified_base (216)..(216): a, c, t, g, unknown or other
  misc_feature (216)..(216): n is a, c, g, or t
tcagagtatacatacacgaccggtgctcgatttagtagcatactgttggttgggccaagggacaacggtcaccgtctcttcagcctccaccaagggcccatcggtcttccctggcgccctgctccaggagcacctccgagagcacagcggccctgggctgcctggtcaaggactacttcctatgtatactctgagcgggctggcaaggcgcatagn

SEQ ID NO: 190572 - DNA, 239 bp, Homo sapiens
  misc_feature: GYAE6OF02F98Q9.48.37.D04.1.454.CMB.1.raw
  modified_base (220)..(239): a, c, t, g, unknown or other
  misc_feature (220)..(239): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnnnnnnnnnnnnn

SEQ ID NO: 190573 - DNA, 229 bp, Homo sapiens
  misc_feature: GYAE6OF02GLLSY.48.37.D04.1.454.CMB.1.raw
  modified_base (219)..(229): a, c, t, g, unknown or other
  misc_feature (219)..(229): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnn

SEQ ID NO: 190574 - DNA, 219 bp, Homo sapiens; identical to SEQ ID NO: 190330
  misc_feature: GYAE6OF02IM612.48.37.D04.1.454.CMB.1.raw
  modified_base (219)..(219): a, c, t, g, unknown or other
  misc_feature (219)..(219): n is a, c, g, or t

SEQ ID NO: 190575 - DNA, 221 bp, Homo sapiens; identical to SEQ ID NO: 190312
  misc_feature: GYAE6OF02IBRH1.48.37.D04.1.454.CMB.1.raw
  modified_base (219)..(221): a, c, t, g, unknown or other
  misc_feature (219)..(221): n is a, c, g, or t

SEQ ID NO: 190576 - DNA, 220 bp, Homo sapiens; identical to SEQ ID NO: 190305
  misc_feature: GYAE6OF02IO1YN.48.37.D04.1.454.CMB.1.raw
  modified_base (219)..(220): a, c, t, g, unknown or other
  misc_feature (219)..(220): n is a, c, g, or t

SEQ ID NO: 190577 - DNA, 218 bp, Homo sapiens
  misc_feature: GYAE6OF02INTU8.48.37.D04.1.454.CMB.1.raw
  modified_base (217)..(218): a, c, t, g, unknown or other
  misc_feature (217)..(218): n is a, c, g, or t
tcagagtatacatacacgaccggtgctcgatttagtagcatactgttgggttgggccaagggacaacggtcaccgtctcttcagcctccaccaagggcccatcggtcttccctggcgccctgctccaggagcacctccgagagcacagcggccctgggctgcctggtcaaggactacttcctatgtatactctgagcgggctggcaaggcgcatagnn

SEQ ID NO: 190578 - DNA, 263 bp, Homo sapiens
  misc_feature: GYAE6OF02H56D1.48.37.D04.1.454.CMB.1.raw
  modified_base (222)..(225): a, c, t, g, unknown or other
  misc_feature (222)..(225): n is a, c, g, or t
  modified_base (227)..(263): a, c, t, g, unknown or other
  misc_feature (227)..(263): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggcctgcctggtcaaggactacttcctatgtatactctgagcgggctggcaaggcgcagtagnnnncnnnnnnnnnnnnnnnnnnnnnnnnnnnnnnnnnnnnn

SEQ ID NO: 190579 - DNA, 283 bp, Homo sapiens
  misc_feature: GYAE6OF02HU4JW.48.37.D04.1.454.CMB.1.raw
  modified_base (185)..(185): a, c, t, g, unknown or other
  misc_feature (185)..(185): n is a, c, g, or t
  modified_base (219)..(221): a, c, t, g, unknown or other
  misc_feature (219)..(221): n is a, c, g, or t
  modified_base (223)..(283): a, c, t, g, unknown or other
  misc_feature (223)..(283): n is a, c, g, or t
tcagagtatacatacacgaccggtgctcgatttagtagcatactgttgggtttggggccaagggacaacggtcaccgtctcgttcagcctccaccaagggcccatcggtcttcccctggcgccctgctccaggagcacctccgagagcgacagcggccctgggctgcctggtcaaggctatcctntctgactctgagcgggctggcaaggcgcagtagnnntnnnnnnnnnnnnnnnnnnnnnnnnnnnnnnnnnnnnnnnnnnnnnnnnnnnnnnnnnnnnn

SEQ ID NO: 190580 - DNA, 220 bp, Homo sapiens
  misc_feature: GYAE6OF02G1Q29.48.37.D04.1.454.CMB.1.raw
  modified_base (218)..(220): a, c, t, g, unknown or other
  misc_feature (218)..(220): n is a, c, g, or t
tcagagtatacatacacgaccggtgctcgatttagtagcatactgttgggtttgggccaagggacaacggtcaccgtctcttcagcctccaccaagggcccatcggtcttccctggcgccctgctccaggagcacctccgagagcacagcggccctgggctgcctggtcaaggactacttcctatgtatactctgagcgggctggcaaggcgcatagnnn

SEQ ID NO: 190581 - DNA, 220 bp, Homo sapiens; identical to SEQ ID NO: 190321
  misc_feature: GYAE6OF02HYGNJ.48.37.D04.1.454.CMB.1.raw
  modified_base (220)..(220): a, c, t, g, unknown or other
  misc_feature (220)..(220): n is a, c, g, or t

SEQ ID NO: 190582 - DNA, 220 bp, Homo sapiens; identical to SEQ ID NO: 190345
  misc_feature: GYAE6OF02I5PSB.48.37.D04.1.454.CMB.1.raw
  modified_base (219)..(220): a, c, t, g, unknown or other
  misc_feature (219)..(220): n is a, c, g, or t

SEQ ID NO: 190583 - DNA, 238 bp, Homo sapiens
  misc_feature: GYAE6OF02GHAVO.48.37.D04.1.454.CMB.1.raw
  modified_base (221)..(238): a, c, t, g, unknown or other
  misc_feature (221)..(238): n is a, c, g, or t
tcagagtatacatacacgaccggtgctcgatttagtagcatactggttggggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnn

SEQ ID NO: 190584 - DNA, 220 bp, Homo sapiens; identical to SEQ ID NO: 190321
  misc_feature: GYAE6OF02GKLZG.48.37.D04.1.454.CMB.1.raw
  modified_base (220)..(220): a, c, t, g, unknown or other
  misc_feature (220)..(220): n is a, c, g, or t

SEQ ID NO: 190585 - DNA, 220 bp, Homo sapiens; identical to SEQ ID NO: 190345
  misc_feature: GYAE6OF02HH4H1.48.37.D04.1.454.CMB.1.raw
  modified_base (219)..(220): a, c, t, g, unknown or other
  misc_feature (219)..(220): n is a, c, g, or t

SEQ ID NO: 190586 - DNA, 248 bp, Homo sapiens
  misc_feature: GYAE6OF02IDL3Q.48.37.D04.1.454.CMB.1.raw
  modified_base (220)..(248): a, c, t, g, unknown or other
  misc_feature (220)..(248): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnnnnnnnnnnn

SEQ ID NO: 190587 - DNA, 222 bp, Homo sapiens; identical to SEQ ID NO: 190314
  misc_feature: GYAE6OF02GGSKV.48.37.D04.1.454.CMB.1.raw
  modified_base (220)..(222): a, c, t, g, unknown or other
  misc_feature (220)..(222): n is a, c, g, or t

SEQ ID NO: 190588 - DNA, 220 bp, Homo sapiens; identical to SEQ ID NO: 190305
  misc_feature: GYAE6OF02JHN71.48.37.D04.1.454.CMB.1.raw
  modified_base (219)..(220): a, c, t, g, unknown or other
  misc_feature (219)..(220): n is a, c, g, or t

SEQ ID NO: 190589 - DNA, 221 bp, Homo sapiens; identical to SEQ ID NO: 190302
  misc_feature: GYAE6OF02G6SRO.48.37.D04.1.454.CMB.1.raw
  modified_base (220)..(221): a, c, t, g, unknown or other
  misc_feature (220)..(221): n is a, c, g, or t

SEQ ID NO: 190590 - DNA, 233 bp, Homo sapiens
  misc_feature: GYAE6OF02GNP4K.48.37.D04.1.454.CMB.1.raw
  modified_base (219)..(233): a, c, t, g, unknown or other
  misc_feature (219)..(233): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnn

SEQ ID NO: 190591 - DNA, 222 bp, Homo sapiens
  misc_feature: GYAE6OF02H5T0I.48.37.D04.1.454.CMB.1.raw
  modified_base (221)..(222): a, c, t, g, unknown or other
  misc_feature (221)..(222): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnn

SEQ ID NO: 190592 - DNA, 224 bp, Homo sapiens; identical to SEQ ID NO: 190329
  misc_feature: GYAE6OF02HJZ1T.48.37.D04.1.454.CMB.1.raw
  modified_base (220)..(224): a, c, t, g, unknown or other
  misc_feature (220)..(224): n is a, c, g, or t

SEQ ID NO: 190593 - DNA, 219 bp, Homo sapiens; identical to SEQ ID NO: 190330
  misc_feature: GYAE6OF02F1SBH.48.37.D04.1.454.CMB.1.raw
  modified_base (219)..(219): a, c, t, g, unknown or other
  misc_feature (219)..(219): n is a, c, g, or t

SEQ ID NO: 190594 - DNA, 222 bp, Homo sapiens; identical to SEQ ID NO: 190314
  misc_feature: GYAE6OF02IUAWL.48.37.D04.1.454.CMB.1.raw
  modified_base (220)..(222): a, c, t, g, unknown or other
  misc_feature (220)..(222): n is a, c, g, or t

SEQ ID NO: 190595 - DNA, 223 bp, Homo sapiens
  misc_feature: GYAE6OF02I686S.48.37.D04.1.454.CMB.1.raw
  modified_base (219)..(223): a, c, t, g, unknown or other
  misc_feature (219)..(223): n is a, c, g, or t
tcagagtatacatacacgaccggtgctcgatttagtagcatactgttgggtttgggccgaagggacaacggtcaccgtctcttcagcctccaccaaggcccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 190596 - DNA, 263 bp, Homo sapiens
  misc_feature: GYAE6OF02JCKZH.48.37.D04.1.454.CMB.1.raw
  modified_base (226)..(227): a, c, t, g, unknown or other
  misc_feature (226)..(227): n is a, c, g, or t
  modified_base (229)..(263): a, c, t, g, unknown or other
  misc_feature (229)..(263): n is a, c, g, or t
tcagagtatacatacacgaccggtgctcgatttagtagcatactggttgggtttggggccaagggacaaccggtcacccgtctcttcagcctccaccaagggcccatcggtcttcccctggcgccctgctccaggagcacctccgagagcacagcggccctgggctgcctggtcaaggtactacttcctatgtatactctgaggcgggctggcaagggcgcatagnngnnnnnnnnnnnnnnnnnnnnnnnnnnnnnnnnnnn

SEQ ID NO: 190597 - DNA, 221 bp, Homo sapiens; identical to SEQ ID NO: 190302
  misc_feature: GYAE6OF02G403G.48.37.D04.1.454.CMB.1.raw
  modified_base (220)..(221): a, c, t, g, unknown or other
  misc_feature (220)..(221): n is a, c, g, or t

SEQ ID NO: 190598 - DNA, 224 bp, Homo sapiens; identical to SEQ ID NO: 190451
  misc_feature: GYAE6OF02GJLDR.48.37.D04.1.454.CMB.1.raw
  modified_base (220)..(224): a, c, t, g, unknown or other
  misc_feature (220)..(224): n is a, c, g, or t

SEQ ID NO: 190599 - DNA, 234 bp, Homo sapiens
  misc_feature: GYAE6OF02FUO48.48.37.D04.1.454.CMB.1.raw
  modified_base (220)..(234): a, c, t, g, unknown or other
  misc_feature (220)..(234): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnn

SEQ ID NO: 190600 - DNA, 225 bp, Homo sapiens
  misc_feature: GYAE6OF02IRYDN.48.37.D04.1.454.CMB.1.raw
  modified_base (218)..(225): a, c, t, g, unknown or other
  misc_feature (218)..(225): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcggctggcaaggcgcatagnnnnnnnn

SEQ ID NO: 190601 - DNA, 231 bp, Homo sapiens
  misc_feature: GYAE6OF02GORAT.48.37.D04.1.454.CMB.1.raw
  modified_base (221)..(231): a, c, t, g, unknown or other
  misc_feature (221)..(231): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagccacctccgagagcacagcggccctgggctgcctggtcaaggactacttcctatgtatactctgagcgggctggcaaggcgcatagnnnnnnnnnnn

SEQ ID NO: 190602 - DNA, 221 bp, Homo sapiens; identical to SEQ ID NO: 190302
  misc_feature: GYAE6OF02H4HV4.48.37.D04.1.454.CMB.1.raw
  modified_base (220)..(221): a, c, t, g, unknown or other
  misc_feature (220)..(221): n is a, c, g, or t

SEQ ID NO: 190603 - DNA, 226 bp, Homo sapiens
  misc_feature: GYAE6OF02I3D8H.48.37.D04.1.454.CMB.1.raw
  modified_base (221)..(226): a, c, t, g, unknown or other
  misc_feature (221)..(226): n is a, c, g, or t
tcagagtatacatacacgaccggtgctcgatttagtagcatactgttgggtttgggtccgaagggacaacggtcgaccgtctcttcagcctccaccaaggccatcggtcttcccctcggcgccctgctccaggagcacctccgagagcacagcggccctgggctgcctggtcaaggactacttcctatgtatactctgagcgggctggcaaggcgcatagnnnnnn

SEQ ID NO: 190604 - DNA, 221 bp, Homo sapiens; identical to SEQ ID NO: 190302
  misc_feature: GYAE6OF02H14DA.48.37.D04.1.454.CMB.1.raw
  modified_base (220)..(221): a, c, t, g, unknown or other
  misc_feature (220)..(221): n is a, c, g, or t

SEQ ID NO: 190605 - DNA, 221 bp, Homo sapiens; identical to SEQ ID NO: 190302
  misc_feature: GYAE6OF02G5D4G.48.37.D04.1.454.CMB.1.raw
  modified_base (220)..(221): a, c, t, g, unknown or other
  misc_feature (220)..(221): n is a, c, g, or t

SEQ ID NO: 190606 - DNA, 221 bp, Homo sapiens; identical to SEQ ID NO: 190355
  misc_feature: GYAE6OF02FH02B.48.37.D04.1.454.CMB.1.raw
  modified_base (220)..(221): a, c, t, g, unknown or other
  misc_feature (220)..(221): n is a, c, g, or t

SEQ ID NO: 190607 - DNA, 222 bp, Homo sapiens; identical to SEQ ID NO: 190350
  misc_feature: GYAE6OF02JHBMA.48.37.D04.1.454.CMB.1.raw
  modified_base (220)..(222): a, c, t, g, unknown or other
  misc_feature (220)..(222): n is a, c, g, or t

SEQ ID NO: 190608 - DNA, 222 bp, Homo sapiens; identical to SEQ ID NO: 190314
  misc_feature: GYAE6OF02JFZ3N.48.37.D04.1.454.CMB.1.raw
  modified_base (220)..(222): a, c, t, g, unknown or other
  misc_feature (220)..(222): n is a, c, g, or t

SEQ ID NO: 190609 - DNA, 220 bp, Homo sapiens; identical to SEQ ID NO: 190321
  misc_feature: GYAE6OF02F2CC4.48.37.D04.1.454.CMB.1.raw
  modified_base (220)..(220): a, c, t, g, unknown or other
  misc_feature (220)..(220): n is a, c, g, or t

SEQ ID NO: 190610 - DNA, 223 bp, Homo sapiens; identical to SEQ ID NO: 190415
  misc_feature: GYAE6OF02GJHSZ.48.37.D04.1.454.CMB.1.raw
  modified_base (219)..(223): a, c, t, g, unknown or other
  misc_feature (219)..(223): n is a, c, g, or t

SEQ ID NO: 190611 - DNA, 220 bp, Homo sapiens; identical to SEQ ID NO: 190400
  misc_feature: GYAE6OF02HV8X5.48.37.D04.1.454.CMB.1.raw
  modified_base (220)..(220): a, c, t, g, unknown or other
  misc_feature (220)..(220): n is a, c, g, or t

SEQ ID NO: 190612 - DNA, 221 bp, Homo sapiens; identical to SEQ ID NO: 190302
  misc_feature: GYAE6OF02HMKDO.48.37.D04.1.454.CMB.1.raw
  modified_base (220)..(221): a, c, t, g, unknown or other
  misc_feature (220)..(221): n is a, c, g, or t

SEQ ID NO: 190613 - DNA, 222 bp, Homo sapiens; identical to SEQ ID NO: 190314
  misc_feature: GYAE6OF02H24GO.48.37.D04.1.454.CMB.1.raw
  modified_base (220)..(222): a, c, t, g, unknown or other
  misc_feature (220)..(222): n is a, c, g, or t

SEQ ID NO: 190614 - DNA, 221 bp, Homo sapiens
  misc_feature: GYAE6OF02F5UA1.48.37.D04.1.454.CMB.1.raw
  modified_base (219)..(221): a, c, t, g, unknown or other
  misc_feature (219)..(221): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnn

SEQ ID NO: 190615 - DNA, 223 bp, Homo sapiens; identical to SEQ ID NO: 190334
  misc_feature: GYAE6OF02FWCIY.48.37.D04.1.454.CMB.1.raw
  modified_base (220)..(223): a, c, t, g, unknown or other
  misc_feature (220)..(223): n is a, c, g, or t

SEQ ID NO: 190616 - DNA, 225 bp, Homo sapiens
  misc_feature: GYAE6OF02IZAG4.48.37.D04.1.454.CMB.1.raw
  modified_base (219)..(225): a, c, t, g, unknown or other
  misc_feature (219)..(225): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnn

SEQ ID NO: 190617 - DNA, 229 bp, Homo sapiens; identical to SEQ ID NO: 190476
  misc_feature: GYAE6OF02H6RZT.48.37.D04.1.454.CMB.1.raw
  modified_base (220)..(229): a, c, t, g, unknown or other
  misc_feature (220)..(229): n is a, c, g, or t

SEQ ID NO: 190618 - DNA, 156 bp, Homo sapiens
  misc_feature: GYAE6OF02IMGMI.48.37.D04.1.454.CMB.1.raw
  modified_base (154)..(156): a, c, t, g, unknown or other
  misc_feature (154)..(156): n is a, c, g, or t
tcagagtatacatacacgaccggtgctcgatttagtagcatactgttgggtttgggaccaaggtggaagtcaaacgaactgtggctgcaccatctgtcttcatcttcccgccatctgatatgtatactctgagcgggctggcaaggcgcatagnnn

SEQ ID NO: 190619 - DNA, 252 bp, Homo sapiens
  misc_feature: GYAE6OF02G1TZ7.48.37.D04.1.454.CMB.1.raw
  modified_base (223)..(252): a, c, t, g, unknown or other
  misc_feature (223)..(252): n is a, c, g, or t
tcagagtatacatacacgaccggtgctcgatttagtagcatactgttgggtttggggccgaagggacaacggtcaccgtctcttcagcctccaccaagggcccactcggtcttcccctggcgccctgcctccaggagcacctccgagagcacagcggccctgggctgcctggtcaaggactacttcctatgtatactctgagcgggctggcaaggcgcatagnnnnnnnnnnnnnnnnnnnnnnnnnnnnnn

SEQ ID NO: 190620 - DNA, 223 bp, Homo sapiens; identical to SEQ ID NO: 190334
  misc_feature: GYAE6OF02HZ92A.48.37.D04.1.454.CMB.1.raw
  modified_base (220)..(223): a, c, t, g, unknown or other
  misc_feature (220)..(223): n is a, c, g, or t

SEQ ID NO: 190621 - DNA, 222 bp, Homo sapiens; identical to SEQ ID NO: 190314
  misc_feature: GYAE6OF02HWU04.48.37.D04.1.454.CMB.1.raw
  modified_base (220)..(222): a, c, t, g, unknown or other
  misc_feature (220)..(222): n is a, c, g, or t

SEQ ID NO: 190622 - DNA, 222 bp, Homo sapiens; identical to SEQ ID NO: 190314
  misc_feature: GYAE6OF02HATFW.48.37.D04.1.454.CMB.1.raw
  modified_base (220)..(222): a, c, t, g, unknown or other
  misc_feature (220)..(222): n is a, c, g, or t

SEQ ID NO: 190623 - DNA, 153 bp, Homo sapiens
  misc_feature: GYAE6OF02HD3P8.48.37.D04.1.454.CMB.1.raw
tcagagtatacatacacgaccggtgctcgatttagtagcatactgttgggtttgggaccaaggtggaagtcaaacgaactgtggctgcaccatctgtcttcatcttcccgccatctgatatgtatactctgagcgggctggcaaggcgcatag

SEQ ID NO: 190624 - DNA, 245 bp, Homo sapiens
  misc_feature: GYAE6OF02IRNEQ.48.37.D04.1.454.CMB.1.raw
  modified_base (221)..(245): a, c, t, g, unknown or other
  misc_feature (221)..(245): n is a, c, g, or t
tcagagtatacatacacgaccggtgctcgatttagtagcatactgttgggtttggggccaagggacaacggtcaccgtctcttcagcctaccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnnnnnnn

SEQ ID NO: 190625 - DNA, 250 bp, Homo sapiens
  misc_feature: GYAE6OF02GKD0Y.48.37.D04.1.454.CMB.1.raw
  modified_base (222)..(250): a, c, t, g, unknown or other
  misc_feature (222)..(250): n is a, c, g, or t
tcagagtatacatacacgaccggtgctcgatttagtagcatactgggttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnnnnnnnnnnn

SEQ ID NO: 190626 - DNA, 225 bp, Homo sapiens; identical to SEQ ID NO: 190459
  misc_feature: GYAE6OF02HMRJ2.48.37.D04.1.454.CMB.1.raw
  modified_base (220)..(225): a, c, t, g, unknown or other
  misc_feature (220)..(225): n is a, c, g, or t

SEQ ID NO: 190627 - DNA, 221 bp, Homo sapiens; identical to SEQ ID NO: 190302
  misc_feature: GYAE6OF02IJ0IH.48.37.D04.1.454.CMB.1.raw
  modified_base (220)..(221): a, c, t, g, unknown or other
  misc_feature (220)..(221): n is a, c, g, or t

SEQ ID NO: 190628 - DNA, 221 bp, Homo sapiens; identical to SEQ ID NO: 190302
  misc_feature: GYAE6OF02F9XH2.48.37.D04.1.454.CMB.1.raw
  modified_base (220)..(221): a, c, t, g, unknown or other
  misc_feature (220)..(221): n is a, c, g, or t

SEQ ID NO: 190629 - DNA, 224 bp, Homo sapiens; identical to SEQ ID NO: 190329
  misc_feature: GYAE6OF02GB1KY.48.37.D04.1.454.CMB.1.raw
  modified_base (220)..(224): a, c, t, g, unknown or other
  misc_feature (220)..(224): n is a, c, g, or t

SEQ ID NO: 190630 - DNA, 221 bp, Homo sapiens
  misc_feature: GYAE6OF02HNS64.48.37.D04.1.454.CMB.1.raw
  modified_base (219)..(221): a, c, t, g, unknown or other
  misc_feature (219)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggatacttcctctctcgactctgagcgggctggcaaggcgcatagnnn

SEQ ID NO: 190631 - DNA, 223 bp, Homo sapiens; identical to SEQ ID NO: 190307
  misc_feature: GYAE6OF02JAFMK.48.37.D04.1.454.CMB.1.raw
  modified_base (220)..(223): a, c, t, g, unknown or other
  misc_feature (220)..(223): n is a, c, g, or t

SEQ ID NO: 190632 - DNA, 154 bp, Homo sapiens; identical to SEQ ID NO: 190319
  misc_feature: GYAE6OF02FR8MV.48.37.D04.1.454.CMB.1.raw
  modified_base (154)..(154): a, c, t, g, unknown or other
  misc_feature (154)..(154): n is a, c, g, or t

SEQ ID NO: 190633 - DNA, 262 bp, Homo sapiens
  misc_feature: GYAE6OF02HC75G.48.37.D04.1.454.CMB.1.raw
  modified_base (224)..(262): a, c, t, g, unknown or other
  misc_feature (224)..(262): n is a, c, g, or t
tcagagtatacatacacgaccggtgctcgatttagtagcatactgttgggtttggggcctaagggacaacggtcaccgtctcttcagcctccaccaagggcccatcggtcttcccctggccgccctgctccaggagcgacctccgagagcacagcggccctgggctgcctggtcaaggactacttcctatgtatactctgagcgggctggccaaggcgcatagnnnnnnnnnnnnnnnnnnnnnnnnnnnnnnnnnnnnnnn

SEQ ID NO: 190634 - DNA, 267 bp, Homo sapiens
  misc_feature: GYAE6OF02GCBY9.48.37.D04.1.454.CMB.1.raw
  modified_base (228)..(267): a, c, t, g, unknown or other
  misc_feature (228)..(267): n is a, c, g, or t
tcagagtatacatacacgaccggtgctcgatttagtagcatactgttgggtttaggggccaagggacaacggtcaccgtctcttcagcctccaccaagggcccatcggtcttcccctggcgccctgctccaaggagcacctccgagagcacagcggccctgggcctagcctggtcctaaggctacttcctatgtatactctaggagcgggctggcaaggcgtcatagnnnnnnnnnnnnnnnnnnnnnnnnnnnnnnnnnnnnnnnn

SEQ ID NO: 190635 - DNA, 221 bp, Homo sapiens
  misc_feature: GYAE6OF02HT5V3.48.37.D04.1.454.CMB.1.raw
  modified_base (221)..(221): a, c, t, g, unknown or other
  misc_feature (221)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaaggcgcatagn

SEQ ID NO: 190636 - DNA, 221 bp, Homo sapiens; identical to SEQ ID NO: 190302
  misc_feature: GYAE6OF02I2QKB.48.37.D04.1.454.CMB.1.raw
  modified_base (220)..(221): a, c, t, g, unknown or other
  misc_feature (220)..(221): n is a, c, g, or t

SEQ ID NO: 190637 - DNA, 222 bp, Homo sapiens; identical to SEQ ID NO: 190314
  misc_feature: GYAE6OF02G569D.48.37.D04.1.454.CMB.1.raw
  modified_base (220)..(222): a, c, t, g, unknown or other
  misc_feature (220)..(222): n is a, c, g, or t

SEQ ID NO: 190638 - DNA, 222 bp, Homo sapiens; identical to SEQ ID NO: 190314
  misc_feature: GYAE6OF02FH6WW.48.37.D04.1.454.CMB.1.raw
  modified_base (220)..(222): a, c, t, g, unknown or other
  misc_feature (220)..(222): n is a, c, g, or t

SEQ ID NO: 190639 - DNA, 222 bp, Homo sapiens; identical to SEQ ID NO: 190350
  misc_feature: GYAE6OF02GXWTN.48.37.D04.1.454.CMB.1.raw
  modified_base (220)..(222): a, c, t, g, unknown or other
  misc_feature (220)..(222): n is a, c, g, or t

SEQ ID NO: 190640 - DNA, 153 bp, Homo sapiens; identical to SEQ ID NO: 190623
  misc_feature: GYAE6OF02GD0V9.48.37.D04.1.454.CMB.1.raw

SEQ ID NO: 190641 - DNA, 233 bp, Homo sapiens
  misc_feature: GYAE6OF02F3C3D.48.37.D04.1.454.CMB.1.raw
  modified_base (220)..(233): a, c, t, g, unknown or other
  misc_feature (220)..(233): n is a, c, g, or t
tcagagtatacatacacgaccggtgctcgatttagtagcatactgttgggtttgggccaaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnn

SEQ ID NO: 190642 - DNA, 224 bp, Homo sapiens; identical to SEQ ID NO: 190329
  misc_feature: GYAE6OF02H0M35.48.37.D04.1.454.CMB.1.raw
  modified_base (220)..(224): a, c, t, g, unknown or other
  misc_feature (220)..(224): n is a, c, g, or t

SEQ ID NO: 190643 - DNA, 221 bp, Homo sapiens; identical to SEQ ID NO: 190302
  misc_feature: GYAE6OF02FMPCL.48.37.D04.1.454.CMB.1.raw
  modified_base (220)..(221): a, c, t, g, unknown or other
  misc_feature (220)..(221): n is a, c, g, or t

SEQ ID NO: 190644 - DNA, 223 bp, Homo sapiens; identical to SEQ ID NO: 190415
  misc_feature: GYAE6OF02F2BGD.48.37.D04.1.454.CMB.1.raw
  modified_base (219)..(223): a, c, t, g, unknown or other
  misc_feature (219)..(223): n is a, c, g, or t

SEQ ID NO: 190645 - DNA, 222 bp, Homo sapiens; identical to SEQ ID NO: 190350
  misc_feature: GYAE6OF02IZGYL.48.37.D04.1.454.CMB.1.raw
  modified_base (220)..(222): a, c, t, g, unknown or other
  misc_feature (220)..(222): n is a, c, g, or t

SEQ ID NO: 190646 - DNA, 222 bp, Homo sapiens
  misc_feature: GYAE6OF02GOCZ2.48.37.D04.1.454.CMB.1.raw
  modified_base (220)..(222): a, c, t, g, unknown or other
  misc_feature (220)..(222): n is a, c, g, or t
tcagagtatacatacacgaccggtgctcgatttagtagcatactgttgggtttggggccaagggacaacggtcaccgtctcttcagcctccaccaagggcccatctgtcttcccctggcgccctgctccaggagcacctccgagagcacagcggccctgggctgcctggtcaaggactacttcctctctcgactctgagcgggctggcaaggcgcatagnnn

SEQ ID NO: 190647 - DNA, 222 bp, Homo sapiens; identical to SEQ ID NO: 190350
  misc_feature: GYAE6OF02IDQMH.48.37.D04.1.454.CMB.1.raw
  modified_base (220)..(222): a, c, t, g, unknown or other
  misc_feature (220)..(222): n is a, c, g, or t

SEQ ID NO: 190648 - DNA, 240 bp, Homo sapiens
  misc_feature: GYAE6OF02FMPTH.48.37.D04.1.454.CMB.1.raw
  modified_base (221)..(240): a, c, t, g, unknown or other
  misc_feature (221)..(240): n is a, c, g, or t
tcagagtatacatacacgaccggtgctcgatttagtagcatactgttgggtttgggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnnn

SEQ ID NO: 190649 - DNA, 222 bp, Homo sapiens; identical to SEQ ID NO: 190314
  misc_feature: GYAE6OF02FLAFP.48.37.D04.1.454.CMB.1.raw
  modified_base (220)..(222): a, c, t, g, unknown or other
  misc_feature (220)..(222): n is a, c, g, or t

SEQ ID NO: 190650 - DNA, 222 bp, Homo sapiens; identical to SEQ ID NO: 190314
  misc_feature: GYAE6OF02IUAS6.48.37.D04.1.454.CMB.1.raw
  modified_base (220)..(222): a, c, t, g, unknown or other
  misc_feature (220)..(222): n is a, c, g, or t

SEQ ID NO: 190651 - DNA, 220 bp, Homo sapiens; identical to SEQ ID NO: 190321
  misc_feature: GYAE6OF02FOU9K.48.37.D04.1.454.CMB.1.raw
  modified_base (220)..(220): a, c, t, g, unknown or other
  misc_feature (220)..(220): n is a, c, g, or t

SEQ ID NO: 190652 - DNA, 221 bp, Homo sapiens; identical to SEQ ID NO: 190302
  misc_feature: GYAE6OF02HD2FR.48.37.D04.1.454.CMB.1.raw
  modified_base (220)..(221): a, c, t, g, unknown or other
  misc_feature (220)..(221): n is a, c, g, or t

SEQ ID NO: 190653 - DNA, 221 bp, Homo sapiens; identical to SEQ ID NO: 190302
  misc_feature: GYAE6OF02GVI7J.48.37.D04.1.454.CMB.1.raw
  modified_base (220)..(221): a, c, t, g, unknown or other
  misc_feature (220)..(221): n is a, c, g, or t

SEQ ID NO: 190654 - DNA, 221 bp, Homo sapiens; identical to SEQ ID NO: 190302
  misc_feature: GYAE6OF02I7TVX.48.37.D04.1.454.CMB.1.raw
  modified_base (220)..(221): a, c, t, g, unknown or other
  misc_feature (220)..(221): n is a, c, g, or t

SEQ ID NO: 190655 - DNA, 223 bp, Homo sapiens; identical to SEQ ID NO: 190334
  misc_feature: GYAE6OF02G5QEB.48.37.D04.1.454.CMB.1.raw
  modified_base (220)..(223): a, c, t, g, unknown or other
  misc_feature (220)..(223): n is a, c, g, or t

SEQ ID NO: 190656 - DNA, 221 bp, Homo sapiens; identical to SEQ ID NO: 190302
  misc_feature: GYAE6OF02HFK42.48.37.D04.1.454.CMB.1.raw
  modified_base (220)..(221): a, c, t, g, unknown or other
  misc_feature (220)..(221): n is a, c, g, or t

SEQ ID NO: 190657 - DNA, 221 bp, Homo sapiens; identical to SEQ ID NO: 190302
  misc_feature: GYAE6OF02G1RST.48.37.D04.1.454.CMB.1.raw
  modified_base (220)..(221): a, c, t, g, unknown or other
  misc_feature (220)..(221): n is a, c, g, or t

SEQ ID NO: 190658 - DNA, 221 bp, Homo sapiens; identical to SEQ ID NO: 190302
  misc_feature: GYAE6OF02HPNPQ.48.37.D04.1.454.CMB.1.raw
  modified_base (220)..(221): a, c, t, g, unknown or other
  misc_feature (220)..(221): n is a, c, g, or t

SEQ ID NO: 190659 - DNA, 225 bp, Homo sapiens; identical to SEQ ID NO: 190542
  misc_feature: GYAE6OF02F2NWL.48.37.D04.1.454.CMB.1.raw
  modified_base (220)..(225): a, c, t, g, unknown or other
  misc_feature (220)..(225): n is a, c, g, or t

SEQ ID NO: 190660 - DNA, 221 bp, Homo sapiens; identical to SEQ ID NO: 190302
  misc_feature: GYAE6OF02IIMSK.48.37.D04.1.454.CMB.1.raw
  modified_base (220)..(221): a, c, t, g, unknown or other
  misc_feature (220)..(221): n is a, c, g, or t

SEQ ID NO: 190661 - DNA, 222 bp, Homo sapiens
  misc_feature: GYAE6OF02JA42D.48.37.D04.1.454.CMB.1.raw
  modified_base (220)..(222): a, c, t, g, unknown or other
  misc_feature (220)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcaccctgctccaggagcacctccgagagcacagcggccctgggctgcctggtcaaggactacttcctatgtatactctgagcgggctggcaaggcgcatagnnn

SEQ ID NO: 190662 - DNA, 223 bp, Homo sapiens; identical to SEQ ID NO: 190307
  misc_feature: GYAE6OF02I6A3N.48.37.D04.1.454.CMB.1.raw
  modified_base (220)..(223): a, c, t, g, unknown or other
  misc_feature (220)..(223): n is a, c, g, or t

SEQ ID NO: 190663 - DNA, 261 bp, Homo sapiens
  misc_feature: GYAE6OF02GVQ09.48.37.D04.1.454.CMB.1.raw
  modified_base (223)..(261): a, c, t, g, unknown or other
  misc_feature (223)..(261): n is a, c, g, or t
tcagagtatacatacacgaccggtgctcgatttagtagcatactgttgggtttggggccaagggacaacggtcaccgtctcttcagcctccaccaagggcccatcggtcttcccctggccgccctgctccaggagcgacctccgagagcacagcggccctgggctgcctggtcaaggactacttcctctctcgactctgtagcgggctggcaaggcgcatagnnnnnnnnnnnnnnnnnnnnnnnnnnnnnnnnnnnnnnn

SEQ ID NO: 190664 - DNA, 220 bp, Homo sapiens; identical to SEQ ID NO: 190321
  misc_feature: GYAE6OF02HSPK8.48.37.D04.1.454.CMB.1.raw
  modified_base (220)..(220): a, c, t, g, unknown or other
  misc_feature (220)..(220): n is a, c, g, or t

SEQ ID NO: 190665 - DNA, 222 bp, Homo sapiens; identical to SEQ ID NO: 190350
  misc_feature: GYAE6OF02G5ZGR.48.37.D04.1.454.CMB.1.raw
  modified_base (220)..(222): a, c, t, g, unknown or other
  misc_feature (220)..(222): n is a, c, g, or t

SEQ ID NO: 190666 - DNA, 257 bp, Homo sapiens
  misc_feature: GYAE6OF02GDIUJ.48.37.D04.1.454.CMB.1.raw
  modified_base (224)..(225): a, c, t, g, unknown or other
  misc_feature (224)..(225): n is a, c, g, or t
  modified_base (227)..(257): a, c, t, g, unknown or other
  misc_feature (227)..(257): n is a, c, g, or t
tcagagtatacatacacgaccggtgctcgatttagtagcatactgttgggtttggggccaagggacaacggtccaccgtctcttcagcctccaccaagggcccatccggtcttcccctggcgccctgctccaggagcacctccgagagcacagcggccctgggctgcctggtcaaggactacttcctatgtatactctgagcgggctggcaagggcgcagtagnngnnnnnnnnnnnnnnnnnnnnnnnnnnnnnnn

SEQ ID NO: 190667 - DNA, 222 bp, Homo sapiens; identical to SEQ ID NO: 190314
  misc_feature: GYAE6OF02FSK75.48.37.D04.1.454.CMB.1.raw
  modified_base (220)..(222): a, c, t, g, unknown or other
  misc_feature (220)..(222): n is a, c, g, or t

SEQ ID NO: 190668 - DNA, 222 bp, Homo sapiens; identical to SEQ ID NO: 190350
  misc_feature: GYAE6OF02FJBU7.48.37.D04.1.454.CMB.1.raw
  modified_base (220)..(222): a, c, t, g, unknown or other
  misc_feature (220)..(222): n is a, c, g, or t

SEQ ID NO: 190669 - DNA, 153 bp, Homo sapiens; identical to SEQ ID NO: 190623
  misc_feature: GYAE6OF02IRUAU.48.37.D04.1.454.CMB.1.raw

SEQ ID NO: 190670 - DNA, 224 bp, Homo sapiens; identical to SEQ ID NO: 190329
  misc_feature: GYAE6OF02G13A4.48.37.D04.1.454.CMB.1.raw
  modified_base (220)..(224): a, c, t, g, unknown or other
  misc_feature (220)..(224): n is a, c, g, or t

SEQ ID NO: 190671 - DNA, 222 bp, Homo sapiens; identical to SEQ ID NO: 190314
  misc_feature: GYAE6OF02I1TTF.48.37.D04.1.454.CMB.1.raw
  modified_base (220)..(222): a, c, t, g, unknown or other
  misc_feature (220)..(222): n is a, c, g, or t

SEQ ID NO: 190672 - DNA, 227 bp, Homo sapiens
  misc_feature: GYAE6OF02GJYSI.48.37.D04.1.454.CMB.1.raw
  modified_base (221)..(227): a, c, t, g, unknown or other
  misc_feature (221)..(227): n is a, c, g, or t
tcagagtatacatacacgaccggtgctcgatttagtagcatactgttgggtttggggccgaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnn

SEQ ID NO: 190673 - DNA, 221 bp, Homo sapiens; identical to SEQ ID NO: 190302
  misc_feature: GYAE6OF02FRHJX.48.37.D04.1.454.CMB.1.raw
  modified_base (220)..(221): a, c, t, g, unknown or other
  misc_feature (220)..(221): n is a, c, g, or t

SEQ ID NO: 190674 - DNA, 222 bp, Homo sapiens; identical to SEQ ID NO: 190314
  misc_feature: GYAE6OF02ICWI0.48.37.D04.1.454.CMB.1.raw
  modified_base (220)..(222): a, c, t, g, unknown or other
  misc_feature (220)..(222): n is a, c, g, or t

SEQ ID NO: 190675 - DNA, 222 bp, Homo sapiens; identical to SEQ ID NO: 190314
  misc_feature: GYAE6OF02IR9GK.48.37.D04.1.454.CMB.1.raw
  modified_base (220)..(222): a, c, t, g, unknown or other
  misc_feature (220)..(222): n is a, c, g, or t

SEQ ID NO: 190676 - DNA, 294 bp, Homo sapiens
  misc_feature: GYAE6OF02IDW11.48.37.D04.1.454.CMB.1.raw
  modified_base (231)..(236): a, c, t, g, unknown or other
  misc_feature (231)..(236): n is a, c, g, or t
  modified_base (238)..(241): a, c, t, g, unknown or other
  misc_feature (238)..(241): n is a, c, g, or t
  modified_base (244)..(294): a, c, t, g, unknown or other
  misc_feature (244)..(294): n is a, c, g, or t
tcagagtatacatacacgaccggtgctcgatttagtagcatactgttggggtttggggccgaagggacaacggtcaccgtctcttcagcctccaccaagggcccatcgggtcttccccgtcggcgccctgcctccaggagcacctccgagagcacaggcggccctgggctgcctggtcaaggacttacttcctctctcgactctgagcgggcttggctaaggcgctatagnnnnnncnnnncannnnnnnnnnnnnnnnnnnnnnnnnnnnnnnnnnnnnnnnnnnnnnnnnnn

SEQ ID NO: 190677 - DNA, 224 bp, Homo sapiens; identical to SEQ ID NO: 190451
  misc_feature: GYAE6OF02GLH8B.48.37.D04.1.454.CMB.1.raw
  modified_base (220)..(224): a, c, t, g, unknown or other
  misc_feature (220)..(224): n is a, c, g, or t

SEQ ID NO: 190678 - DNA, 222 bp, Homo sapiens
  misc_feature: GYAE6OF02FFN3R.48.37.D04.1.454.CMB.1.raw
  modified_base (218)..(222): a, c, t, g, unknown or other
  misc_feature (218)..(222): n is a, c, g, or t
tcagagtatacatacacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaggcgcatagnnnnn

SEQ ID NO: 190679 - DNA, 226 bp, Homo sapiens
  misc_feature: GYAE6OF02I32Y4.48.37.D04.1.454.CMB.1.raw
  modified_base (219)..(226): a, c, t, g, unknown or other
  misc_feature (219)..(226): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggcctgggctgcctggtcaaggactacttcctatgtatactctgagcgggctggcaaggcgcatagnnnnnnnn

SEQ ID NO: 190680 - DNA, 221 bp, Homo sapiens
  misc_feature: GYAE6OF02INZGE.48.37.D04.1.454.CMB.1.raw
  modified_base (219)..(221): a, c, t, g, unknown or other
  misc_feature (219)..(221): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcggctggcaaggcgcatagnnn

SEQ ID NO: 190681 - DNA, 221 bp, Homo sapiens
  misc_feature: GYAE6OF02HYZEJ.48.37.D04.1.454.CMB.1.raw
  modified_base (220)..(221): a, c, t, g, unknown or other
  misc_feature (220)..(221): n is a, c, g, or t
tcagagtatacatacacgaccggtgctcgatttagtagcatactgttgggtttggggccagggaaccctggtcaccgtctcctcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 190682 - DNA, 230 bp, Homo sapiens
  misc_feature: GYAE6OF02G0TN5.48.37.D04.1.454.CMB.1.raw
  modified_base (222)..(230): a, c, t, g, unknown or other
  misc_feature (222)..(230): n is a, c, g, or t
tcagagtatacatacacgaccggtgctcgatttagtagcatactgttgggtttggggccaagggacaaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnnnn

SEQ ID NO: 190683 - DNA, 220 bp, Homo sapiens
  misc_feature: GYAE6OF02GRYE7.48.37.D04.1.454.CMB.1.raw
  modified_base (219)..(220): a, c, t, g, unknown or other
  misc_feature (219)..(220): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcggctggcaaggcgcatagnn

SEQ ID NO: 190684 - DNA, 223 bp, Homo sapiens; identical to SEQ ID NO: 190307
  misc_feature: GYAE6OF02HWRGZ.48.37.D04.1.454.CMB.1.raw
  modified_base (220)..(223): a, c, t, g, unknown or other
  misc_feature (220)..(223): n is a, c, g, or t

SEQ ID NO: 190685 - DNA, 154 bp, Homo sapiens; identical to SEQ ID NO: 190319
  misc_feature: GYAE6OF02G9A54.48.37.D04.1.454.CMB.1.raw
  modified_base (154)..(154): a, c, t, g, unknown or other
  misc_feature (154)..(154): n is a, c, g, or t

SEQ ID NO: 190686 - DNA, 221 bp, Homo sapiens; identical to SEQ ID NO: 190355
  misc_feature: GYAE6OF02GOFS3.48.37.D04.1.454.CMB.1.raw
  modified_base (220)..(221): a, c, t, g, unknown or other
  misc_feature (220)..(221): n is a, c, g, or t

SEQ ID NO: 190687 - DNA, 224 bp, Homo sapiens; identical to SEQ ID NO: 190329
  misc_feature: GYAE6OF02G3DMV.48.37.D04.1.454.CMB.1.raw
  modified_base (220)..(224): a, c, t, g, unknown or other
  misc_feature (220)..(224): n is a, c, g, or t

SEQ ID NO: 190688 - DNA, 223 bp, Homo sapiens; identical to SEQ ID NO: 190307
  misc_feature: GYAE6OF02GVAI1.48.37.D04.1.454.CMB.1.raw
  modified_base (220)..(223): a, c, t, g, unknown or other
  misc_feature (220)..(223): n is a, c, g, or t

SEQ ID NO: 190689 - DNA, 228 bp, Homo sapiens
  misc_feature: GYAE6OF02IGGCU.48.37.D04.1.454.CMB.1.raw
  modified_base (221)..(228): a, c, t, g, unknown or other
  misc_feature (221)..(228): n is a, c, g, or t
tcagagtatacatacacgaccggtgctcgatttagtagcatactgttggggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnn

SEQ ID NO: 190690 - DNA, 222 bp, Homo sapiens; identical to SEQ ID NO: 190314
  misc_feature: GYAE6OF02HSYOV.48.37.D04.1.454.CMB.1.raw
  modified_base (220)..(222): a, c, t, g, unknown or other
  misc_feature (220)..(222): n is a, c, g, or t

SEQ ID NO: 190691 - DNA, 221 bp, Homo sapiens; identical to SEQ ID NO: 190355
  misc_feature: GYAE6OF02FQG48.48.37.D04.1.454.CMB.1.raw
  modified_base (220)..(221): a, c, t, g, unknown or other
  misc_feature (220)..(221): n is a, c, g, or t

SEQ ID NO: 190692 - DNA, 289 bp, Homo sapiens
  misc_feature: GYAE6OF02GUBJ3.48.37.D04.1.454.CMB.1.raw
  modified_base (139)..(139): a, c, t, g, unknown or other
  misc_feature (139)..(139): n is a, c, g, or t
  modified_base (226)..(236): a, c, t, g, unknown or other
  misc_feature (226)..(236): n is a, c, g, or t
  modified_base (238)..(289): a, c, t, g, unknown or other
  misc_feature (238)..(289): n is a, c, g, or t
tcagagtatacatacacgaccggtgctcgatttagtagcatactggttgggtttggggccgaagggacaacggtcaccgtctcttcgagcctccaccaagggcccatcggtcttccccctggcgccctcgctccaggancacctccgagagcacagcggccctgggctgcctggtcaaggactacttcctatgtatactctgagcgggctggcaagggcgcatagnnnnnnnnnnnannnnnnnnnnnnnnnnnnnnnnnnnnnnnnnnnnnnnnnnnnnnnnnnnnnn

SEQ ID NO: 190693 - DNA, 227 bp, Homo sapiens; identical to SEQ ID NO: 190529
  misc_feature: GYAE6OF02GGG77.48.37.D04.1.454.CMB.1.raw
  modified_base (220)..(227): a, c, t, g, unknown or other
  misc_feature (220)..(227): n is a, c, g, or t

SEQ ID NO: 190694 - DNA, 224 bp, Homo sapiens; identical to SEQ ID NO: 190329
  misc_feature: GYAE6OF02IRHHN.48.37.D04.1.454.CMB.1.raw
  modified_base (220)..(224): a, c, t, g, unknown or other
  misc_feature (220)..(224): n is a, c, g, or t

SEQ ID NO: 190695 - DNA, 222 bp, Homo sapiens; identical to SEQ ID NO: 190350
  misc_feature: GYAE6OF02I9OND.48.37.D04.1.454.CMB.1.raw
  modified_base (220)..(222): a, c, t, g, unknown or other
  misc_feature (220)..(222): n is a, c, g, or t

SEQ ID NO: 190696 - DNA, 241 bp, Homo sapiens; identical to SEQ ID NO: 190411
  misc_feature: GYAE6OF02GR73T.48.37.D04.1.454.CMB.1.raw
  modified_base (220)..(241): a, c, t, g, unknown or other
  misc_feature (220)..(241): n is a, c, g, or t

SEQ ID NO: 190697 - DNA, 245 bp, Homo sapiens
  misc_feature: GYAE6OF02HPWNM.48.37.D04.1.454.CMB.1.raw
  modified_base (221)..(245): a, c, t, g, unknown or other
  misc_feature (221)..(245): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgcgtccaggagcacctccgagagcacagcggccctgggctgcctggtcaaggactacttcctatgtatactctgagcgggctggcaaggcgcatagnnnnnnnnnnnnnnnnnnnnnnnnn

SEQ ID NO: 190698 - DNA, 155 bp, Homo sapiens; identical to SEQ ID NO: 190453
  misc_feature: GYAE6OF02HIKLB.48.37.D04.1.454.CMB.1.raw
  modified_base (154)..(155): a, c, t, g, unknown or other
  misc_feature (154)..(155): n is a, c, g, or t

SEQ ID NO: 190699 - DNA, 221 bp, Homo sapiens; identical to SEQ ID NO: 190302
  misc_feature: GYAE6OF02GXG0E.48.37.D04.1.454.CMB.1.raw
  modified_base (220)..(221): a, c, t, g, unknown or other
  misc_feature (220)..(221): n is a, c, g, or t

SEQ ID NO: 190700 - DNA, 223 bp, Homo sapiens; identical to SEQ ID NO: 190307
  misc_feature: GYAE6OF02HHBPA.48.37.D04.1.454.CMB.1.raw
  modified_base (220)..(223): a, c, t, g, unknown or other
  misc_feature (220)..(223): n is a, c, g, or t

SEQ ID NO: 190701 - DNA, 230 bp, Homo sapiens
  misc_feature: GYAE6OF02FQQKS.48.37.D04.1.454.CMB.1.raw
  modified_base (221)..(230): a, c, t, g, unknown or other
  misc_feature (221)..(230): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagtcgggctggcaaggcgcatagnnnnnnnnnn

SEQ ID NO: 190702 - DNA, 220 bp, Homo sapiens; identical to SEQ ID NO: 190321
  misc_feature: GYAE6OF02GZYRS.48.37.D04.1.454.CMB.1.raw
  modified_base (220)..(220): a, c, t, g, unknown or other
  misc_feature (220)..(220): n is a, c, g, or t

SEQ ID NO: 190703 - DNA, 233 bp, Homo sapiens
  misc_feature: GYAE6OF02FJ01X.48.37.D04.1.454.CMB.1.raw
  modified_base (221)..(233): a, c, t, g, unknown or other
  misc_feature (221)..(233): n is a, c, g, or t
tcagagtatacatacacgaccggtgctcgatttagtagcatactggttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnn

SEQ ID NO: 190704 - DNA, 221 bp, Homo sapiens; identical to SEQ ID NO: 190302
  misc_feature: GYAE6OF02IWRBB.48.37.D04.1.454.CMB.1.raw
  modified_base (220)..(221): a, c, t, g, unknown or other
  misc_feature (220)..(221): n is a, c, g, or t

SEQ ID NO: 190705 - DNA, 220 bp, Homo sapiens
  misc_feature: GYAE6OF02JNN6M.48.37.D04.1.454.CMB.1.raw
  modified_base (216)..(220): a, c, t, g, unknown or other
  misc_feature (216)..(220): n is a, c, g, or t
tcagagtatacatacacgaccggtgctcgatttagtagcatactgttggtttgggccaagggacaacggtcaccgtctcttcagcctcaccaaggcccatcggtcttcccctggcgccctgctccaggagcacctccgagagcacagcggccctgggctgcctggtcaaggactacttcctatcgtatactctgagcgggctggcaaggcgcatgnnnnn

SEQ ID NO: 190706 - DNA, 221 bp, Homo sapiens; identical to SEQ ID NO: 190302
  misc_feature: GYAE6OF02I2WD7.48.37.D04.1.454.CMB.1.raw
  modified_base (220)..(221): a, c, t, g, unknown or other
  misc_feature (220)..(221): n is a, c, g, or t

SEQ ID NO: 190707 - DNA, 270 bp, Homo sapiens
  misc_feature: GYAE6OF02JKIBR.48.37.D04.1.454.CMB.1.raw
  modified_base (236)..(270): a, c, t, g, unknown or other
  misc_feature (236)..(270): n is a, c, g, or t
tcagagtatacatacacgaccggtgctcgatttagtagcatactgttggggtttgggggccgaagggacaacggtcaccgtctcttcagcctccaccaagggcccatcggtcttccccctcggccgccctcgctccgaggagcacctccgagagcacagcggcccgtgggcgtcgccgtggtcgaacggactacttcctactgtatactctgagcggcgtggcgaaggcgcatagnnnnnnnnnnnnnnnnnnnnnnnnnnnnnnnnnnn

SEQ ID NO: 190708 - DNA, 226 bp, Homo sapiens
  misc_feature: GYAE6OF02IA43V.48.37.D04.1.454.CMB.1.raw
  modified_base (199)..(199): a, c, t, g, unknown or other
  misc_feature (199)..(199): n is a, c, g, or t
  modified_base (220)..(226): a, c, t, g, unknown or other
  misc_feature (220)..(226): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgancgggctggcaaggcgcatagnnnnnnn

SEQ ID NO: 190709 - DNA, 222 bp, Homo sapiens; identical to SEQ ID NO: 190314
  misc_feature: GYAE6OF02I0YPJ.48.37.D04.1.454.CMB.1.raw
  modified_base (220)..(222): a, c, t, g, unknown or other
  misc_feature (220)..(222): n is a, c, g, or t

SEQ ID NO: 190710 - DNA, 534 bp, Homo sapiens
  misc_feature: GYAE6OF02GL5MI.48.37.D04.1.454.CMB.1.raw
tcagagtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctcgtcggggtccccgatccgggttctctggctccatcgacacggtccctccaactctcgcctctctcacctatctctggactgcagactggacggacgaggctggtattacctacgtgtacagttcttagtcgtatagtggactaagtaagttggtttagggtggtttgggcggtagggtaccaaggtcgtacggaccgttaccgtaggtaccg

SEQ ID NO: 190711 - DNA, 220 bp, Homo sapiens; identical to SEQ ID NO: 190321
  misc_feature: GYAE6OF02FV0Y2.48.37.D04.1.454.CMB.1.raw
  modified_base (220)..(220): a, c, t, g, unknown or other
  misc_feature (220)..(220): n is a, c, g, or t

SEQ ID NO: 190712 - DNA, 223 bp, Homo sapiens; identical to SEQ ID NO: 190307
  misc_feature: GYAE6OF02IU3UC.48.37.D04.1.454.CMB.1.raw
  modified_base (220)..(223): a, c, t, g, unknown or other
  misc_feature (220)..(223): n is a, c, g, or t

SEQ ID NO: 190713 - DNA, 222 bp, Homo sapiens; identical to SEQ ID NO: 190314
  misc_feature: GYAE6OF02GAHT4.48.37.D04.1.454.CMB.1.raw
  modified_base (220)..(222): a, c, t, g, unknown or other
  misc_feature (220)..(222): n is a, c, g, or t

SEQ ID NO: 190714 - DNA, 229 bp, Homo sapiens; identical to SEQ ID NO: 190476
  misc_feature: GYAE6OF02F9ASY.48.37.D04.1.454.CMB.1.raw
  modified_base (220)..(229): a, c, t, g, unknown or other
  misc_feature (220)..(229): n is a, c, g, or t

SEQ ID NO: 190715 - DNA, 222 bp, Homo sapiens; identical to SEQ ID NO: 190314
  misc_feature: GYAE6OF02I8S0F.48.37.D04.1.454.CMB.1.raw
  modified_base (220)..(222): a, c, t, g, unknown or other
  misc_feature (220)..(222): n is a, c, g, or t

SEQ ID NO: 190716 - DNA, 229 bp, Homo sapiens
  misc_feature: GYAE6OF02G9W21.48.37.D04.1.454.CMB.1.raw
  modified_base (221)..(229): a, c, t, g, unknown or other
  misc_feature (221)..(229): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaagggcgcatagnnnnnnnnn

SEQ ID NO: 190717 - DNA, 222 bp, Homo sapiens; identical to SEQ ID NO: 190314
  misc_feature: GYAE6OF02IO1H8.48.37.D04.1.454.CMB.1.raw
  modified_base (220)..(222): a, c, t, g, unknown or other
  misc_feature (220)..(222): n is a, c, g, or t

SEQ ID NO: 190718 - DNA, 236 bp, Homo sapiens
  misc_feature: GYAE6OF02H4EPN.48.37.D04.1.454.CMB.1.raw
  modified_base (221)..(236): a, c, t, g, unknown or other
  misc_feature (221)..(236): n is a, c, g, or t
tcagagtatacatacacgaccggtgctcgatttagtagcatactgttgggtttggggccaagggacaacggtcaccgtctcttcagcctccaccaagggcccatcggtcttcccactggcgccctgctccaggagcacctccgagagcacagcggccctgggctgcctggtcaaggactacttcctctctcgactctgagcgggctggcaaggcgcatagnnnnnnnnnnnnnnnn

SEQ ID NO: 190719 - DNA, 563 bp, Homo sapiens
  misc_feature: GYAE6OF02IA9SG.48.37.D04.1.454.CMB.1.raw
tcagagtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccatctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctcgtcggggtcccccgattcgggttctcgtggctccatcgacacggtcctccaactctgccctctctcaccatctctgactgcagactggaggacgaggctagacttactacgttcgtactagttactttaatgtaataggtggactaaagttaacgttggtttttaggggttggtttggggtaccgggtaaggggacctaaacggtccgttacggacccggtttcccggtagggttaacccgg

SEQ ID NO: 190720 - DNA, 156 bp, Homo sapiens; identical to SEQ ID NO: 190618
  misc_feature: GYAE6OF02IWKBZ.48.37.D04.1.454.CMB.1.raw
  modified_base (154)..(156): a, c, t, g, unknown or other
  misc_feature (154)..(156): n is a, c, g, or t

SEQ ID NO: 190721 - DNA, 229 bp, Homo sapiens; identical to SEQ ID NO: 190463
  misc_feature: GYAE6OF02G5QWW.48.37.D04.1.454.CMB.1.raw
  modified_base (220)..(229): a, c, t, g, unknown or other
  misc_feature (220)..(229): n is a, c, g, or t

SEQ ID NO: 190722 - DNA, 245 bp, Homo sapiens
  misc_feature: GYAE6OF02GPBO7.48.37.D04.1.454.CMB.1.raw
  modified_base (220)..(245): a, c, t, g, unknown or other
  misc_feature (220)..(245): n is a, c, g, or t
tcagagtatacatacacgaccggtgctcgatttagtagcatactgttggggtttggggccaagggacaacggtcaccgtctcctcagcctccaccaagggcccatcggtcttcccctggcgccctgcgtccaggagcacctccgagagcacagcggcctgggctgcctggtcaaggactacttcctatgtatactctgagcggctggcaaggcgcatagnnnnnnnnnnnnnnnnnnnnnnnnnn

SEQ ID NO: 190723 - DNA, 225 bp, Homo sapiens; identical to SEQ ID NO: 190459
  misc_feature: GYAE6OF02GGOU3.48.37.D04.1.454.CMB.1.raw
  modified_base (220)..(225): a, c, t, g, unknown or other
  misc_feature (220)..(225): n is a, c, g, or t

SEQ ID NO: 190724 - DNA, 226 bp, Homo sapiens; identical to SEQ ID NO: 190511
  misc_feature: GYAE6OF02JFWBG.48.37.D04.1.454.CMB.1.raw
  modified_base (220)..(226): a, c, t, g, unknown or other
  misc_feature (220)..(226): n is a, c, g, or t

SEQ ID NO: 190725 - DNA, 245 bp, Homo sapiens
  misc_feature: GYAE6OF02JGH66.48.37.D04.1.454.CMB.1.raw
  modified_base (223)..(245): a, c, t, g, unknown or other
  misc_feature (223)..(245): n is a, c, g, or t
tcagagtatacatacacgaccggtgctcgatttagtagcatactgttgggtttggggccaagggacaaacggtcaccgtctcttcagcctccacccaagggcccatcggtcttccccctggcgccctgctccaggagcacctccgagagcacagcggccctgggctgcctggtcaaggactacttcctatgtatactctgagcgggctggcaaggcgcatagnnnnnnnnnnnnnnnnnnnnnnn

SEQ ID NO: 190726 - DNA, 225 bp, Homo sapiens; identical to SEQ ID NO: 190459
  misc_feature: GYAE6OF02HRXSR.48.37.D04.1.454.CMB.1.raw
  modified_base (220)..(225): a, c, t, g, unknown or other
  misc_feature (220)..(225): n is a, c, g, or t

SEQ ID NO: 190727 - DNA, 222 bp, Homo sapiens; identical to SEQ ID NO: 190314
  misc_feature: GYAE6OF02IHRSJ.48.37.D04.1.454.CMB.1.raw
  modified_base (220)..(222): a, c, t, g, unknown or other
  misc_feature (220)..(222): n is a, c, g, or t

SEQ ID NO: 190728 - DNA, 227 bp, Homo sapiens; identical to SEQ ID NO: 190525
  misc_feature: GYAE6OF02HYK6D.48.37.D04.1.454.CMB.1.raw
  modified_base (220)..(227): a, c, t, g, unknown or other
  misc_feature (220)..(227): n is a, c, g, or t

SEQ ID NO: 190729 - DNA, 155 bp, Homo sapiens; identical to SEQ ID NO: 190453
  misc_feature: GYAE6OF02G9Q3X.48.37.D04.1.454.CMB.1.raw
  modified_base (154)..(155): a, c, t, g, unknown or other
  misc_feature (154)..(155): n is a, c, g, or t

SEQ ID NO: 190730 - DNA, 222 bp, Homo sapiens; identical to SEQ ID NO: 190314
  misc_feature: GYAE6OF02GI56M.48.37.D04.1.454.CMB.1.raw
  modified_base (220)..(222): a, c, t, g, unknown or other
  misc_feature (220)..(222): n is a, c, g, or t

SEQ ID NO: 190731 - DNA, 223 bp, Homo sapiens; identical to SEQ ID NO: 190334
  misc_feature: GYAE6OF02JBOPA.48.37.D04.1.454.CMB.1.raw
  modified_base (220)..(223): a, c, t, g, unknown or other
  misc_feature (220)..(223): n is a, c, g, or t

SEQ ID NO: 190732 - DNA, 227 bp, Homo sapiens; identical to SEQ ID NO: 190529
  misc_feature: GYAE6OF02HANEV.48.37.D04.1.454.CMB.1.raw
  modified_base (220)..(227): a, c, t, g, unknown or other
  misc_feature (220)..(227): n is a, c, g, or t

SEQ ID NO: 190733 - DNA, 239 bp, Homo sapiens
  misc_feature: GYAE6OF02G83KM.48.37.D04.1.454.CMB.1.raw
  modified_base (221)..(239): a, c, t, g, unknown or other
  misc_feature (221)..(239): n is a, c, g, or t
tcagagtatacatacacgaccggtgctcgatttagtagcatactgttgggtttgggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnnnnnnn

SEQ ID NO: 190734 - DNA, 223 bp, Homo sapiens; identical to SEQ ID NO: 190334
  misc_feature: GYAE6OF02FGVS1.48.37.D04.1.454.CMB.1.raw
  modified_base (220)..(223): a, c, t, g, unknown or other
  misc_feature (220)..(223): n is a, c, g, or t

SEQ ID NO: 190735 - DNA, 222 bp, Homo sapiens; identical to SEQ ID NO: 190314
  misc_feature: GYAE6OF02HQAJ0.48.37.D04.1.454.CMB.1.raw
  modified_base (220)..(222): a, c, t, g, unknown or other
  misc_feature (220)..(222): n is a, c, g, or t

SEQ ID NO: 190736 - DNA, 221 bp, Homo sapiens; identical to SEQ ID NO: 190355
  misc_feature: GYAE6OF02G3YE4.48.37.D04.1.454.CMB.1.raw
  modified_base (220)..(221): a, c, t, g, unknown or other
  misc_feature (220)..(221): n is a, c, g, or t

SEQ ID NO: 190737 - DNA, 226 bp, Homo sapiens; identical to SEQ ID NO: 190511
  misc_feature: GYAE6OF02IWFZ4.48.37.D04.1.454.CMB.1.raw
  modified_base (220)..(226): a, c, t, g, unknown or other
  misc_feature (220)..(226): n is a, c, g, or t

SEQ ID NO: 190738 - DNA, 224 bp, Homo sapiens; identical to SEQ ID NO: 190329
  misc_feature: GYAE6OF02G26ZS.48.37.D04.1.454.CMB.1.raw
  modified_base (220)..(224): a, c, t, g, unknown or other
  misc_feature (220)..(224): n is a, c, g, or t

SEQ ID NO: 190739 - DNA, 512 bp, Homo sapiens
  misc_feature: GYAE6OF02GVIL9.48.37.D04.1.454.CMB.1.raw
  modified_base (436)..(436): a, c, t, g, unknown or other
  misc_feature (436)..(436): n is a, c, g, or t
tcagagtatacatacacgaccggtgctcgatttagtagcatactgttgggtttggggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctcggggtccccgatcggttctctggctccatcgacaggtcctccaactctgcctctctcaccatctctcggactgcagactgaggacgaggctgattactactgtcagtcctntgatgcagcgctaggttgtccgttcgggaccgggagggtacccacgaccgtcggtacccgtttagccggttacccg

SEQ ID NO: 190740 - DNA, 219 bp, Homo sapiens
  misc_feature: GYAE6OF02F12LR.48.37.D04.1.454.CMB.1.raw
  modified_base (218)..(219): a, c, t, g, unknown or other
  misc_feature (218)..(219): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatatcgagcgggctggcaaggcgcatagnn

SEQ ID NO: 190741 - DNA, 223 bp, Homo sapiens; identical to SEQ ID NO: 190307
  misc_feature: GYAE6OF02FYISE.48.37.D04.1.454.CMB.1.raw
  modified_base (220)..(223): a, c, t, g, unknown or other
  misc_feature (220)..(223): n is a, c, g, or t

SEQ ID NO: 190742 - DNA, 235 bp, Homo sapiens
  misc_feature: GYAE6OF02HDLAY.48.37.D04.1.454.CMB.1.raw
  modified_base (132)..(132): a, c, t, g, unknown or other
  misc_feature (132)..(132): n is a, c, g, or t
  modified_base (213)..(213): a, c, t, g, unknown or other
  misc_feature (213)..(213): n is a, c, g, or t
  modified_base (219)..(235): a, c, t, g, unknown or other
  misc_feature (219)..(235): n is a, c, g, or t
tcagagtatacatacacgaccggtgctcgatttagtagcatactgttgggtttggggccaagggacaacggtcaccgtctcttcagcctccaccaaggcccatcggtcttcccctggcgccctgctccaggngcacctccgagagcacagcggccctgggctgcctggtcaaggactacttcctatgtatactctgagcggctggcaagggcncatagnnnnnnnnnnnnnnnnn

SEQ ID NO: 190743 - DNA, 701 bp, Homo sapiens
  misc_feature: GYAE6OF02JU71A.48.37.D04.1.454.CMB.1.raw
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
tcagagtatacatacacgaccggtgctcgatttagtagcatactgttgggtttggggggtggtagctcaggaagctagagcctggagcatcgtccactatggcctgggctccactacttctcaccctctcgctcactggccacaggttcttcgggccctagtttttactcgctgactcagccccactctggtgtcggagtctccggggaagcggtnaccatctcctcgcacccgcagctagtggcagtcgttcgccaaccaactatgtcgactaacggttcggttaccaggccaggccggcccgggntacgttccgacccatcctacgttggcgtattactagtagaaacgtaaataacgtcggaaacggaccgtaccccgttggccggggttacccctagttccggttctcgttacggcccttcaacttccggaacttaccgggttaccctaccgtaaacgttcccgtccgtcccttaccgttacctacccgtaacctcgttcctacggtacggtaccttcggacttacggacttagggaccgtacggactcgttaactacgttaacgtccgtgtacttacgttactaacgtcgtaagttacggtcgtaacttacgtttaagggtttggttttacgggttagtttacgggaccgggtaagtaccgttagtccgttacggtaccgttccggtacgtaccgg

SEQ ID NO: 190744 - DNA, 223 bp, Homo sapiens; identical to SEQ ID NO: 190307
  misc_feature: GYAE6OF02GEUPK.48.37.D04.1.454.CMB.1.raw
  modified_base (220)..(223): a, c, t, g, unknown or other
  misc_feature (220)..(223): n is a, c, g, or t

SEQ ID NO: 190745 - DNA, 222 bp, Homo sapiens
  misc_feature: GYAE6OF02ICDU2.48.37.D04.1.454.CMB.1.raw
  modified_base (214)..(214): a, c, t, g, unknown or other
  misc_feature (214)..(214): n is a, c, g, or t
  modified_base (220)..(222): a, c, t, g, unknown or other
  misc_feature (220)..(222): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcncatagnnn

SEQ ID NO: 190746 - DNA, 227 bp, Homo sapiens; identical to SEQ ID NO: 190529
  misc_feature: GYAE6OF02GDY8G.48.37.D04.1.454.CMB.1.raw
  modified_base (220)..(227): a, c, t, g, unknown or other
  misc_feature (220)..(227): n is a, c, g, or t

SEQ ID NO: 190747 - DNA, 220 bp, Homo sapiens; identical to SEQ ID NO: 190321
  misc_feature: GYAE6OF02FX4MN.48.37.D04.1.454.CMB.1.raw
  modified_base (220)..(220): a, c, t, g, unknown or other
  misc_feature (220)..(220): n is a, c, g, or t

SEQ ID NO: 190748 - DNA, 223 bp, Homo sapiens; identical to SEQ ID NO: 190307
  misc_feature: GYAE6OF02FVHHB.48.37.D04.1.454.CMB.1.raw
  modified_base (220)..(223): a, c, t, g, unknown or other
  misc_feature (220)..(223): n is a, c, g, or t

SEQ ID NO: 190749 - DNA, 224 bp, Homo sapiens; identical to SEQ ID NO: 190329
  misc_feature: GYAE6OF02HKVM8.48.37.D04.1.454.CMB.1.raw
  modified_base (220)..(224): a, c, t, g, unknown or other
  misc_feature (220)..(224): n is a, c, g, or t

SEQ ID NO: 190750 - DNA, 228 bp, Homo sapiens
  misc_feature: GYAE6OF02GPJHQ.48.37.D04.1.454.CMB.1.raw
  modified_base (221)..(228): a, c, t, g, unknown or other
  misc_feature (221)..(228): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcaatagnnnnnnnn

SEQ ID NO: 190751 - DNA, 222 bp, Homo sapiens; identical to SEQ ID NO: 190314
  misc_feature: GYAE6OF02GAEFO.48.37.D04.1.454.CMB.1.raw
  modified_base (220)..(222): a, c, t, g, unknown or other
  misc_feature (220)..(222): n is a, c, g, or t

SEQ ID NO: 190752 - DNA, 235 bp, Homo sapiens
  misc_feature: GYAE6OF02JH10J.48.37.D04.1.454.CMB.1.raw
  modified_base (222)..(235): a, c, t, g, unknown or other
  misc_feature (222)..(235): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctgggcaaggcgcatagnnnnnnnnnnnnnn

SEQ ID NO: 190753 - DNA, 228 bp, Homo sapiens
  misc_feature: GYAE6OF02HV5BN.48.37.D04.1.454.CMB.1.raw
  modified_base (134)..(134): a, c, t, g, unknown or other
  misc_feature (134)..(134): n is a, c, g, or t
  modified_base (220)..(228): a, c, t, g, unknown or other
  misc_feature (220)..(228): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggancacctccgagagcacagcggccctgggctgcctggtcaaggactacttcctatgtatactctgagcgggctggcaaggcgcatagnnnnnnnnn

SEQ ID NO: 190754 - DNA, 222 bp, Homo sapiens; identical to SEQ ID NO: 190314
  misc_feature: GYAE6OF02JF1UY.48.37.D04.1.454.CMB.1.raw
  modified_base (220)..(222): a, c, t, g, unknown or other
  misc_feature (220)..(222): n is a, c, g, or t

SEQ ID NO: 190755 - DNA, 273 bp, Homo sapiens
  misc_feature: GYAE6OF02GSSJP.48.37.D04.1.454.CMB.1.raw
  modified_base (227)..(233): a, c, t, g, unknown or other
  misc_feature (227)..(233): n is a, c, g, or t
  modified_base (235)..(273): a, c, t, g, unknown or other
  misc_feature (235)..(273): n is a, c, g, or t
tcagagtatacatacacgaccggtgctcgatttagtagcatactgttggggtttgggggccaagggacaaccggtcaccgtctcttcagcctccaccgaagggcccatcgggtccttcccctggcgccctgcgtcctaggagcacctccgagagcacaggcggccctagggctgcctggtcaaggctacttcctctctcgactctgagcggctgcaaggcgcatagnnnnnnngnnnnnnnnnnnnnnnnnnnnnnnnnnnnnnnnnnnnnnn

SEQ ID NO: 190756 - DNA, 132 bp, Homo sapiens
  misc_feature: GYAE6OF02G2PMT.48.37.D04.1.454.CMB.1.raw
tcagagtatacatacacgaccggtgctcgatttagtagcatactgttgggtttggggccaagggacaacggtcaccgtctcttcagcctccaccaagggcccatcggtcttccccctggcgccctgctcccg

SEQ ID NO: 190757 - DNA, 221 bp, Homo sapiens; identical to SEQ ID NO: 190302
  misc_feature: GYAE6OF02G7JPC.48.37.D04.1.454.CMB.1.raw
  modified_base (220)..(221): a, c, t, g, unknown or other
  misc_feature (220)..(221): n is a, c, g, or t

SEQ ID NO: 190758 - DNA, 225 bp, Homo sapiens; identical to SEQ ID NO: 190459
  misc_feature: GYAE6OF02G3YGC.48.37.D04.1.454.CMB.1.raw
  modified_base (220)..(225): a, c, t, g, unknown or other
  misc_feature (220)..(225): n is a, c, g, or t

SEQ ID NO: 190759 - DNA, 229 bp, Homo sapiens; identical to SEQ ID NO: 190463
  misc_feature: GYAE6OF02I0WWL.48.37.D04.1.454.CMB.1.raw
  modified_base (220)..(229): a, c, t, g, unknown or other
  misc_feature (220)..(229): n is a, c, g, or t

SEQ ID NO: 190760 - DNA, 225 bp, Homo sapiens; identical to SEQ ID NO: 190459
  misc_feature: GYAE6OF02GAPV5.48.37.D04.1.454.CMB.1.raw
  modified_base (220)..(225): a, c, t, g, unknown or other
  misc_feature (220)..(225): n is a, c, g, or t

SEQ ID NO: 190761 - DNA, 221 bp, Homo sapiens; identical to SEQ ID NO: 190355
  misc_feature: GYAE6OF02HCWQM.48.37.D04.1.454.CMB.1.raw
  modified_base (220)..(221): a, c, t, g, unknown or other
  misc_feature (220)..(221): n is a, c, g, or t

SEQ ID NO: 190762 - DNA, 593 bp, Homo sapiens
  misc_feature: GYAE6OF02G60LR.48.37.D04.1.454.CMB.1.raw
  modified_base (501)..(501): a, c, t, g, unknown or other
  misc_feature (501)..(501): n is a, c, g, or t
tcagagtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagccgcccgggcagttccgcccagtccactgtgatctatgagaataatgagacgaccctcgtcggggtccccgagttccggttctcgtcgggctccgatccgactacggtccctaccgaacttcgtcgcccttcctctaccacccactctcgtcggtacctgaccacgacgttcggaacgggaccgtaggcctagtactttactacgtgtctacgttcttagtacgtagttagnggtactaagttaagttgggtttagggttggttgggacgggtacgggtaaccgtaaggtccgtacggtacccggttacggtacggtaacccgg

SEQ ID NO: 190763 - DNA, 224 bp, Homo sapiens
  misc_feature: GYAE6OF02G8G7M.48.37.D04.1.454.CMB.1.raw
  modified_base (220)..(224): a, c, t, g, unknown or other
  misc_feature (220)..(224): n is a, c, g, or t
tcagagtatacatacacgaccggtgctcgatttagtagcatactgttgggtttggggccaagggaaaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 190764 - DNA, 230 bp, Homo sapiens
  misc_feature: GYAE6OF02IRBVX.48.37.D04.1.454.CMB.1.raw
  modified_base (220)..(230): a, c, t, g, unknown or other
  misc_feature (220)..(230): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnnnn

SEQ ID NO: 190765 - DNA, 225 bp, Homo sapiens; identical to SEQ ID NO: 190459
  misc_feature: GYAE6OF02HFN8F.48.37.D04.1.454.CMB.1.raw
  modified_base (220)..(225): a, c, t, g, unknown or other
  misc_feature (220)..(225): n is a, c, g, or t

SEQ ID NO: 190766 - DNA, 225 bp, Homo sapiens
  misc_feature: GYAE6OF02FZSHK.48.37.D04.1.454.CMB.1.raw
  modified_base (214)..(214): a, c, t, g, unknown or other
  misc_feature (214)..(214): n is a, c, g, or t
  modified_base (220)..(225): a, c, t, g, unknown or other
  misc_feature (220)..(225): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcncatagnnnnnn

SEQ ID NO: 190767 - DNA, 279 bp, Homo sapiens
  misc_feature: GYAE6OF02FT78I.48.37.D04.1.454.CMB.1.raw
  modified_base (228)..(228): a, c, t, g, unknown or other
  misc_feature (228)..(228): n is a, c, g, or t
  modified_base (233)..(279): a, c, t, g, unknown or other
  misc_feature (233)..(279): n is a, c, g, or t
tcagagtatacatacacgaccggtgctcgatttagtagcatactgttgggtttgggggccaagggacaacggtcaccgtctcttcaggcctccaccaagggcccatccggtcgttcccctggcgccctgtcctccacggacgcacctccgaggagcacgagcggcccctgggctgccctggtcaaggactacttcctatgtatactcgtgacgcgggctggcaaggcncatgnnnnnnnnnnnnnnnnnnnnnnnnnnnnnnnnnnnnnnnnnnnnnnn

SEQ ID NO: 190768 - DNA, 225 bp, Homo sapiens
  misc_feature: GYAE6OF02I2KP9.48.37.D04.1.454.CMB.1.raw
  modified_base (220)..(225): a, c, t, g, unknown or other
  misc_feature (220)..(225): n is a, c, g, or t
tcagagtatacatacacgaccggtgctcgatttagtagcatactgttgggtttggggccaagggaaaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnn

SEQ ID NO: 190769 - DNA, 240 bp, Homo sapiens
  misc_feature: GYAE6OF02IAYH5.48.37.D04.1.454.CMB.1.raw
  modified_base (222)..(240): a, c, t, g, unknown or other
  misc_feature (222)..(240): n is a, c, g, or t
tcagagtatacatacacgaccggtgctcgatttagtagcatactgttgggtttgggccaaagggacaacggtcaccgtctcttcagcctccaccaagggcccaatcggtcttcccctggcgccctgctccaggagcacctccgagagcacagcggccctgggctgcctggtacaaggctacttctatgtatactctgagcggactggacaaggcgtcatagnnnnnnnnnnnnnnnnnnn

SEQ ID NO: 190770 - DNA, 228 bp, Homo sapiens; identical to SEQ ID NO: 190489
  misc_feature: GYAE6OF02JCXR3.48.37.D04.1.454.CMB.1.raw
  modified_base (220)..(228): a, c, t, g, unknown or other
  misc_feature (220)..(228): n is a, c, g, or t

SEQ ID NO: 190771 - DNA, 234 bp, Homo sapiens
  misc_feature: GYAE6OF02G0FNZ.48.37.D04.1.454.CMB.1.raw
  modified_base (219)..(234): a, c, t, g, unknown or other
  misc_feature (219)..(234): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcggctggcaaggcgcatagnnnnnnnnnnnnnnnn

SEQ ID NO: 190772 - DNA, 228 bp, Homo sapiens; identical to SEQ ID NO: 190489
  misc_feature: GYAE6OF02HWULM.48.37.D04.1.454.CMB.1.raw
  modified_base (220)..(228): a, c, t, g, unknown or other
  misc_feature (220)..(228): n is a, c, g, or t

SEQ ID NO: 190773 - DNA, 263 bp, Homo sapiens
  misc_feature: GYAE6OF02GA6US.48.37.D04.1.454.CMB.1.raw
  modified_base (223)..(225): a, c, t, g, unknown or other
  misc_feature (223)..(225): n is a, c, g, or t
  modified_base (228)..(232): a, c, t, g, unknown or other
  misc_feature (228)..(232): n is a, c, g, or t
  modified_base (234)..(235): a, c, t, g, unknown or other
  misc_feature (234)..(235): n is a, c, g, or t
  modified_base (237)..(237): a, c, t, g, unknown or other
  misc_feature (237)..(237): n is a, c, g, or t
  modified_base (240)..(263): a, c, t, g, unknown or other
  misc_feature (240)..(263): n is a, c, g, or t
tcagagtatacatacacgaccggtgctcgatttagtagcatactggttaggggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnntgnnnnncnncngcnnnnnnnnnnnnnnnnnnnnnnnn

SEQ ID NO: 190774 - DNA, 230 bp, Homo sapiens; identical to SEQ ID NO: 190533
  misc_feature: GYAE6OF02GDQAG.48.37.D04.1.454.CMB.1.raw
  modified_base (220)..(230): a, c, t, g, unknown or other
  misc_feature (220)..(230): n is a, c, g, or t

SEQ ID NO: 190775 - DNA, 230 bp, Homo sapiens; identical to SEQ ID NO: 190533
  misc_feature: GYAE6OF02F3R5B.48.37.D04.1.454.CMB.1.raw
  modified_base (220)..(230): a, c, t, g, unknown or other
  misc_feature (220)..(230): n is a, c, g, or t

SEQ ID NO: 190776 - DNA, 230 bp, Homo sapiens; identical to SEQ ID NO: 190533
  misc_feature: GYAE6OF02FM62C.48.37.D04.1.454.CMB.1.raw
  modified_base (220)..(230): a, c, t, g, unknown or other
  misc_feature (220)..(230): n is a, c, g, or t

SEQ ID NO: 190777 - DNA, 228 bp, Homo sapiens; identical to SEQ ID NO: 190489
  misc_feature: GYAE6OF02FUEQX.48.37.D04.1.454.CMB.1.raw
  modified_base (220)..(228): a, c, t, g, unknown or other
  misc_feature (220)..(228): n is a, c, g, or t

SEQ ID NO: 190778 - DNA, 614 bp, Homo sapiens
  misc_feature: GYAE6OF02I2ADQ.48.37.D04.1.454.CMB.1.raw
  modified_base (322)..(322): a, c, t, g, unknown or other
  misc_feature (322)..(322): n is a, c, g, or t
tcagagtatacatacacgaccggtgctcgatttagtagcatactgttgggtttggggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgacccatctcctgcacccgcagcagtggcagcgttcgccaccaactatgtgcagtggttccagcagccgccgggcagttcgcccatcactgtgatcgtatgaagaataatgacganacccgtcgtcgggtccccagttcggttctcgtcggctaccgatccgactacgggttccctaccaacgttctacgtccttcgtacctccaccctcttacctcgtcggtactcggacaacgaccgtggacggacggtaggcctagtacctttactacgtcgtctacgttacttagtacgtaagttacgtaggacttaagttaacggtttgggttttacggggttacgggttttacgggaacgggtacgggaaccgtacggtcgttaccggtaccccggttcgtaacggtaccgg

SEQ ID NO: 190779 - DNA, 378 bp, Homo sapiens
  misc_feature: GYAE6OF02IWW7L.48.37.D04.1.454.CMB.1.raw
  modified_base (365)..(378): a, c, t, g, unknown or other
  misc_feature (365)..(378): n is a, c, g, or t
tcagagtatacatacacgaccggtgctcgatttagtagcatactgttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccactctcttgcagcctccaccaagggcccatcggtcttcccctgccaccctcctccaagagccacctctgggggcacagtcggccctgggctcgcctggtcaaggtctacttcctatgtactactctgagcggtctggcaagcgacagtannnnnnnnnnnnnn

SEQ ID NO: 190780 - DNA, 234 bp, Homo sapiens
  misc_feature: GYAE6OF02I84TR.48.37.D04.1.454.CMB.1.raw
  modified_base (214)..(214): a, c, t, g, unknown or other
  misc_feature (214)..(214): n is a, c, g, or t
  modified_base (220)..(234): a, c, t, g, unknown or other
  misc_feature (220)..(234): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggctacttcctatgtatactctgagcgggctggcaaggcncatagnnnnnnnnnnnnnnn

SEQ ID NO: 190781 - DNA, 222 bp, Homo sapiens; identical to SEQ ID NO: 190350
  misc_feature: GYAE6OF02GH08M.48.37.D04.1.454.CMB.1.raw
  modified_base (220)..(222): a, c, t, g, unknown or other
  misc_feature (220)..(222): n is a, c, g, or t

SEQ ID NO: 190782 - DNA, 223 bp, Homo sapiens; identical to SEQ ID NO: 190307
  misc_feature: GYAE6OF02FN8FC.48.37.D04.1.454.CMB.1.raw
  modified_base (220)..(223): a, c, t, g, unknown or other
  misc_feature (220)..(223): n is a, c, g, or t

SEQ ID NO: 190783 - DNA, 230 bp, Homo sapiens
  misc_feature: GYAE6OF02H1S4R.48.37.D04.1.454.CMB.1.raw
  modified_base (222)..(230): a, c, t, g, unknown or other
  misc_feature (222)..(230): n is a, c, g, or t
tcagagtatacatacacgaccggtgctcgatttagtagcatactgttgggtttggggccaagggacaacggtcaccgtctcttcagcctccaccaagggcccatcggtcttccccctggcaccctcctccaagagcacctccgagagcacagcggccctgggctgcctggtcaaggactacttcctctctcgactctgaggcgggctggcaaggcgcatagnnnnnnnnn

SEQ ID NO: 190784 - DNA, 225 bp, Homo sapiens
  misc_feature: GYAE6OF02GP5PB.48.37.D04.1.454.CMB.1.raw
  modified_base (220)..(225): a, c, t, g, unknown or other
  misc_feature (220)..(225): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctctctcgactctgagcggctggcaaggcgcatagnnnnnn

SEQ ID NO: 190785 - DNA, 265 bp, Homo sapiens
  misc_feature: GYAE6OF02F7S6A.48.37.D04.1.454.CMB.1.raw
  modified_base (185)..(185): a, c, t, g, unknown or other
  misc_feature (185)..(185): n is a, c, g, or t
  modified_base (221)..(226): a, c, t, g, unknown or other
  misc_feature (221)..(226): n is a, c, g, or t
  modified_base (228)..(230): a, c, t, g, unknown or other
  misc_feature (228)..(230): n is a, c, g, or t
  modified_base (232)..(233): a, c, t, g, unknown or other
  misc_feature (232)..(233): n is a, c, g, or t
  modified_base (235)..(265): a, c, t, g, unknown or other
  misc_feature (235)..(265): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggcctgggctgcctggtcaaggactacttcctntctcgactctagagcgggctggcaaggcacagtagnnnnnngnnngnngnnnnnnnnnnnnnnnnnnnnnnnnnnnnnnn

SEQ ID NO: 190786 - DNA, 244 bp, Homo sapiens
  misc_feature: GYAE6OF02GKWN0.48.37.D04.1.454.CMB.1.raw
  modified_base (221)..(244): a, c, t, g, unknown or other
  misc_feature (221)..(244): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgaggcggctggacaaggcgcatagnnnnnnnnnnnnnnnnnnnnnnnn

SEQ ID NO: 190787 - DNA, 225 bp, Homo sapiens; identical to SEQ ID NO: 190459
  misc_feature: GYAE6OF02F7M8J.48.37.D04.1.454.CMB.1.raw
  modified_base (220)..(225): a, c, t, g, unknown or other
  misc_feature (220)..(225): n is a, c, g, or t

SEQ ID NO: 190788 - DNA, 226 bp, Homo sapiens
  misc_feature: GYAE6OF02FF10Q.48.37.D04.1.454.CMB.1.raw
  modified_base (221)..(226): a, c, t, g, unknown or other
  misc_feature (221)..(226): n is a, c, g, or t
tcagagtatacatacacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnn

SEQ ID NO: 190789 - DNA, 230 bp, Homo sapiens
  misc_feature: GYAE6OF02IC80K.48.37.D04.1.454.CMB.1.raw
  modified_base (222)..(230): a, c, t, g, unknown or other
  misc_feature (222)..(230): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagacgcacagcggccctgggctgcctggtcaaggactacttcctatgtatactctgagcgggctggcaaggcgcatagcnnnnnnnnn

SEQ ID NO: 190790 - DNA, 245 bp, Homo sapiens
  misc_feature: GYAE6OF02G7T7K.48.37.D04.1.454.CMB.1.raw
  modified_base (219)..(245): a, c, t, g, unknown or other
  misc_feature (219)..(245): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggcctgggctgcctggtcaaggactacttcctatgtatactctgagcgggctggcaaggcgcatagnnnnnnnnnnnnnnnnnnnnnnnnnnn

SEQ ID NO: 190791 - DNA, 245 bp, Homo sapiens
  misc_feature: GYAE6OF02ILOB2.48.37.D04.1.454.CMB.1.raw
  modified_base (215)..(215): a, c, t, g, unknown or other
  misc_feature (215)..(215): n is a, c, g, or t
  modified_base (221)..(245): a, c, t, g, unknown or other
  misc_feature (221)..(245): n is a, c, g, or t
tcagagtatacatacacgaccggtgctcgatttagtagcatactgttggggtttggggccaagggacaacggtcaccgtctcttcagcctccaccaagggcccatcggtcttcccctggcgccctgctccaggagcacctccgagagcacagcggccctgggcctgcctggtcaaggctacttcctatgtatactctgagcgggctggcaaggcncatagnnnnnnnnnnnnnnnnnnnnnnnnn

SEQ ID NO: 190792 - DNA, 243 bp, Homo sapiens
  misc_feature: GYAE6OF02G22VN.48.37.D04.1.454.CMB.1.raw
  modified_base (222)..(243): a, c, t, g, unknown or other
  misc_feature (222)..(243): n is a, c, g, or t
tcagagtatacatacacgaccggtgctcgatttagtagcatactgttgggtttggggccaaacccgggacaacggtcaccgtctcttcagcctccaccaagggcccatcggtcttcccctggcgccctgctccaggagcacctccgagagcacagcggccctgggctgcctggtcaaggactacttcatgtatactctgagcgggctggcaaggcgcatagnnnnnnnnnnnnnnnnnnnnnn

SEQ ID NO: 190793 - DNA, 227 bp, Homo sapiens
  misc_feature: GYAE6OF02FKZJB.48.37.D04.1.454.CMB.1.raw
  modified_base (214)..(214): a, c, t, g, unknown or other
  misc_feature (214)..(214): n is a, c, g, or t
  modified_base (220)..(227): a, c, t, g, unknown or other
  misc_feature (220)..(227): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcncatagnnnnnnnn

SEQ ID NO: 190794 - DNA, 226 bp, Homo sapiens
  misc_feature: GYAE6OF02G89A9.48.37.D04.1.454.CMB.1.raw
  modified_base (219)..(226): a, c, t, g, unknown or other
  misc_feature (219)..(226): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatgnnnnnnnn

SEQ ID NO: 190795 - DNA, 237 bp, Homo sapiens
  misc_feature: GYAE6OF02FFME2.48.37.D04.1.454.CMB.1.raw
  modified_base (220)..(237): a, c, t, g, unknown or other
  misc_feature (220)..(237): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnnnnnnnnnnnnnn

SEQ ID NO: 190796 - DNA, 172 bp, Homo sapiens
  misc_feature: GYAE6OF02HBRGL.48.37.D04.1.454.CMB.1.raw
  modified_base (126)..(172): a, c, t, g, unknown or other
  misc_feature (126)..(172): n is a, c, g, or t
tcagagtatacatacacgaccggtgctcgatttagtagcatactgttggggtttggggccaagggacaacggtcaccgtctcttcagcctccaccaagggcccatcggtcttcccctggcgcctgnnnnnnnnnnnnnnnnnnnnnnnnnnnnnnnnnnnnnnnnnnnnnnn

SEQ ID NO: 190797 - DNA, 226 bp, Homo sapiens
  misc_feature: GYAE6OF02GZGZL.48.37.D04.1.454.CMB.1.raw
  modified_base (185)..(185): a, c, t, g, unknown or other
  misc_feature (185)..(185): n is a, c, g, or t
  modified_base (220)..(226): a, c, t, g, unknown or other
  misc_feature (220)..(226): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttccnctctcgactctgagcgggctggcaaggcgcatagnnnnnnn

SEQ ID NO: 190798 - DNA, 232 bp, Homo sapiens
  misc_feature: GYAE6OF02FXDBD.48.37.D04.1.454.CMB.1.raw
  modified_base (210)..(232): a, c, t, g, unknown or other
  misc_feature (210)..(232): n is a, c, g, or t
tcagagtatacatacacgaccggtgctcgatttagtagcatactgttgggtttggggccaaagggacaacggtcaccgtctcttcagcctccaccaagggcccatcggtcttcccctggcgccctgctccaggagcacctccgagagcacagcgcctgggctgcctggtcaaaggctacttccatggagcgggctggcaaggcgcatagnnnnnnnnnnnnnnnnnnnnnnn

SEQ ID NO: 190799 - DNA, 234 bp, Homo sapiens
  misc_feature: GYAE6OF02F8U4V.48.37.D04.1.454.CMB.1.raw
  modified_base (220)..(234): a, c, t, g, unknown or other
  misc_feature (220)..(234): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggcaaggcgacatagnnnnnnnnnnnnnnn

SEQ ID NO: 190800 - DNA, 226 bp, Homo sapiens
  misc_feature: GYAE6OF02HNJYA.48.37.D04.1.454.CMB.1.raw
  modified_base (219)..(226): a, c, t, g, unknown or other
  misc_feature (219)..(226): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcggctggcaaggcgcatagnnnnnnnn

SEQ ID NO: 190801 - DNA, 233 bp, Homo sapiens
  misc_feature: GYAE6OF02IDPNK.48.37.D04.1.454.CMB.1.raw
  modified_base (220)..(233): a, c, t, g, unknown or other
  misc_feature (220)..(233): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnnnnnnnnn

SEQ ID NO: 190802 - DNA, 237 bp, Homo sapiens
  misc_feature: GYAE6OF02GAMM4.48.37.D04.1.454.CMB.1.raw
  modified_base (215)..(215): a, c, t, g, unknown or other
  misc_feature (215)..(215): n is a, c, g, or t
  modified_base (221)..(237): a, c, t, g, unknown or other
  misc_feature (221)..(237): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggacaaggcncatagnnnnnnnnnnnnnnnnn

SEQ ID NO: 190803 - DNA, 236 bp, Homo sapiens
  misc_feature: GYAE6OF02HGB67.48.37.D04.1.454.CMB.1.raw
  modified_base (220)..(236): a, c, t, g, unknown or other
  misc_feature (220)..(236): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcgaggcgcatagnnnnnnnnnnnnnnnnn

SEQ ID NO: 190804 - DNA, 238 bp, Homo sapiens
  misc_feature: GYAE6OF02FI0GJ.48.37.D04.1.454.CMB.1.raw
  modified_base (219)..(238): a, c, t, g, unknown or other
  misc_feature (219)..(238): n is a, c, g, or t
tcagagtatacatacacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttccatgtatactctgagcgggctggcaaggcgcatagnnnnnnnnnnnnnnnnnnnn

SEQ ID NO: 190805 - DNA, 229 bp, Homo sapiens; identical to SEQ ID NO: 190463
  misc_feature: GYAE6OF02FPO7T.48.37.D04.1.454.CMB.1.raw
  modified_base (220)..(229): a, c, t, g, unknown or other
  misc_feature (220)..(229): n is a, c, g, or t

SEQ ID NO: 190806 - DNA, 226 bp, Homo sapiens; identical to SEQ ID NO: 190511
  misc_feature: GYAE6OF02FRQHN.48.37.D04.1.454.CMB.1.raw
  modified_base (220)..(226): a, c, t, g, unknown or other
  misc_feature (220)..(226): n is a, c, g, or t

SEQ ID NO: 190807 - DNA, 505 bp, Homo sapiens
  misc_feature: GYAE6OF02F3LBN.48.37.D04.1.454.CMB.1.raw
  modified_base (133)..(133): a, c, t, g, unknown or other
  misc_feature (133)..(133): n is a, c, g, or t
  modified_base (219)..(223): a, c, t, g, unknown or other
  misc_feature (219)..(223): n is a, c, g, or t
  modified_base (225)..(226): a, c, t, g, unknown or other
  misc_feature (225)..(226): n is a, c, g, or t
  modified_base (229)..(230): a, c, t, g, unknown or other
  misc_feature (229)..(230): n is a, c, g, or t
  modified_base (233)..(236): a, c, t, g, unknown or other
  misc_feature (233)..(236): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (267)..(268): a, c, t, g, unknown or other
  misc_feature (267)..(268): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagagtatacatacacgaccggtgctcgatttagtagcatactgttggggtttgggccaagggacaacggtcaccgtctcttcagcctccacaaggcccaatcggtcttcccctggcgccctgctccaggancacctccgagagcacagcggccctgggctgcctggtcaaggactacttccaatgtatactctgagcgggctggcaaggcgcatagnnnnnannacnncgnnnnangangcatcanatcagcaganacgtnatanntctactangtcanacgngcagtacnagnatgactcatacggatacgatacactacgatacgtacacgactacgtactacacacgtagtacgtacgtaagtacacgacgtacgtaagtaagtatacgaacgacgtactacacgtagacgacgacgacgtactacgtaactagtagtagagagacgtacgtaacgtacgtacgtaactactacgacgactacgtacgtactacgtacgc

SEQ ID NO: 190808 - DNA, 523 bp, Homo sapiens
  misc_feature: GYAE6OF01AKYJY.11.67.G01.1.454.CMB.1.raw
  modified_base (185)..(185): a, c, t, g, unknown or other
  misc_feature (185)..(185): n is a, c, g, or t
  modified_base (520)..(520): a, c, t, g, unknown or other
  misc_feature (520)..(520): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctgacacctcagcctccctggccatcactgggctccagcctgagatgaggctgattattactgtcagtcctttgactattaactggatgtggtattcgggcggagggacccacgtaaccgtcctaggtcacgcccgaaggctcgcccctcggtccactctcgttcccgccctcctcgtntcc

SEQ ID NO: 190809 - DNA, 514 bp, Homo sapiens
  misc_feature: GYAE6OF01D7N82.11.67.G01.1.454.CMB.1.raw
  modified_base (185)..(185): a, c, t, g, unknown or other
  misc_feature (185)..(185): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggnagagggtcatcatctcttgttctggaagcagctctaatatcggaagtaatactgtaaaattggtatcaacaactccaggaacggcccccaaactcctcatctatagtaataatcagcggccctcaggggtccctgaccgattctctggctccaagtctggcacctcagcctccctggccatcagtcgggctccagtctgatgatgagctgattattactgtgcagcagtgggatgacaccctgatggtccttgtgttggtttcggcggagggaccagcgtcgaccgtctaggtcacgcccaacggcctcgccccctcggtccgcctccg

SEQ ID NO: 190810 - DNA, 522 bp, Homo sapiens
  misc_feature: GYAE6OF01CCK3L.11.67.G01.1.454.CMB.1.raw
  modified_base (184)..(184): a, c, t, g, unknown or other
  misc_feature (184)..(184): n is a, c, g, or t
  modified_base (433)..(433): a, c, t, g, unknown or other
  misc_feature (433)..(433): n is a, c, g, or t
  modified_base (512)..(512): a, c, t, g, unknown or other
  misc_feature (512)..(512): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagctccaaatatcggaagtaacgatgtcaattggtatcaacatctccccggtacgcccccaaactcctcatctataggaatagccagcggccctcgacggggtccctggccgattctctggctcgaagtctggcacctcacgccctcctggcctgccaggtcgggctccgagtctgaggatgaggctgacttattattgtgcagcggtgggatgacggtntgagtgcgtgtggtcgttcgggcggagggactaagcgtgaccgtcgtaagtcacgacccgaaggctcgccccctggtcnctcgttcccg

SEQ ID NO: 190811 - DNA, 526 bp, Homo sapiens
  misc_feature: GYAE6OF01DWV4D.11.67.G01.1.454.CMB.1.raw
  modified_base (195)..(195): a, c, t, g, unknown or other
  misc_feature (195)..(195): n is a, c, g, or t
  modified_base (520)..(520): a, c, t, g, unknown or other
  misc_feature (520)..(520): n is a, c, g, or t
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatcaacatctccccggtacggccccaaactcctcatctataggaatagccagcggccctcgacggggtccctggccgattctctggctcgaagtctggcacctcagcctcctggcctgcagtgggctcagtctgaggatgagctgactatttattgtgcgagcgtgggatggacggtcgtgagtgcgtgtggttcgttcggcggagggaccaaggcgtggccgtcgtcgggtcgacgcccgaggtcctcgccccgtcggtcncgtccg

SEQ ID NO: 190812 - DNA, 174 bp, Homo sapiens
  misc_feature: GYAE6OF01EP72W.11.67.G01.1.454.CMB.1.raw
  modified_base (173)..(174): a, c, t, g, unknown or other
  misc_feature (173)..(174): n is a, c, g, or t
tcagcgagagataccacgaccggtgctcgatttagagtatacatattgggtttgggggaagaggaagactgacggtcccccaggagttcaggtgctgggcacagcggccctgggctgcctggtcaaggactacttccgtatctctcgctgagcgggctggcaaggcgcatagnn

SEQ ID NO: 190813 - DNA, 475 bp, Homo sapiens
  misc_feature: GYAE6OF01DMYTD.11.67.G01.1.454.CMB.1.raw
  modified_base (463)..(475): a, c, t, g, unknown or other
  misc_feature (463)..(475): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggccacgggtcatcgtctcctcagcctccaccaagggcccatcggtcttcccctggcaccctctccaagagcacctctgggggcacagcggccctgggctgcctggtcaacggctacttccgtatctctcgctgagcgggctggccgaggcgcatagnnnnnnnnnnnnn

SEQ ID NO: 190814 - DNA, 578 bp, Homo sapiens
  misc_feature: GYAE6OF01B6GG9.11.67.G01.1.454.CMB.1.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
  modified_base (440)..(440): a, c, t, g, unknown or other
  misc_feature (440)..(440): n is a, c, g, or t
tcagcgagagataccacgaccggtgctcgatttagagtatacatattgggcgttggtgcagccgaggggtcctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgacaaatggacagcctgagagccgacgacacggcctatattacngtcgaccagaaactccgtacagtactattgctaacgtggtcgacaagtcgactaccgacgcccttaactatttacnccaaccactagtcggaacgtcgtaggggactaaagggaccacggtcacgtcgtctccnacgcctccacgaacggccctagtccgtcccttccccgtacgcctaccccgtctaccgaaagccgacctacccgtcgtcggggccacgcgcccggcccgtgggccctcggccttagggtccaaacggtcctttaacccg

SEQ ID NO: 190815 - DNA, 731 bp, Homo sapiens
  misc_feature: GYAE6OF01D3N5R.11.67.G01.1.454.CMB.1.raw
  modified_base (187)..(187): a, c, t, g, unknown or other
  misc_feature (187)..(187): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctcggggacccccgggnagagaatcaccatctcttgtactggaagcagctaccaaatactcggaaagtaacgatgtactaattggtaatacaaactactccgtcccccggtaaccggacccccaaaactccctactacgtctaataggaatacgccaggccggccctcgacgggtcctggccgtattctctggctcggaacgtctcggcacctcacgtcccgtcccgtggtccctgccgtaggtcgggcctacccgtagttccgaggtaggaagttgggaacggtccgttaggtaacctttagttttaacgtttgggtacggtaccgtaggggtcgggttaggggtaacgttcgggtaacgggtttcgtagggtacggttcggtccggttgggtttcgggtttccggtttacgggggaccgggtaacgggtaaacccgtaaagggtcccgttacgggaccccggtttcggtacggggttaccgaaccgggtaccccggtaaacggtccccgtcccggtaccccccggttccgggtacccttacccgttccgttacccccgg

SEQ ID NO: 190816 - DNA, 666 bp, Homo sapiens
  misc_feature: GYAE6OF01EF91T.11.67.G01.1.454.CMB.1.raw
  modified_base (197)..(197): a, c, t, g, unknown or other
  misc_feature (197)..(197): n is a, c, g, or t
tcagcgagagataccacgaccggtgctcgatttagagtatacatattgggtttggggggggttgagaagacaggactcaggacaatctccagcatggccagcttccctctcctcctcaccctcctcactcactgtgcagggtcctgggcccagtctgttctgactcagccaccctcagcgtctcgggacccccgggnagagaatcaccatctcttgtactggaagcagcctaccaatatacggaagtaacgatgtacaatttggtatcaaactatccgttcccccgggtaaccggcccccaaaacttcccctcactccttaagtaggaaactagccacggccggccctcgacggggtccctgggccgtattcctcgtggctacggaagtctcggcctacctcacgtccctcccgtggccctggctaggtcgggcctccgtacgtcgtggagggtagtggaggtctagtaacttagtttagtttggtgacgagggtcgggtgggtacgttcggacggttcgtaggtagtcggtcgttgggttcggttcggttcggggcgggacgggaccgtaacggtcgttacggtacccggttccggtcgggttccgaccggaccccggtaacggtcccgttcccggaccccccgttcggtcccctccgttccccg

SEQ ID NO: 190817 - DNA, 483 bp, Homo sapiens
  misc_feature: GYAE6OF01BDFK0.11.67.G01.1.454.CMB.1.raw
  modified_base (472)..(483): a, c, t, g, unknown or other
  misc_feature (472)..(483): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaagggaccacggtcatcgtctcctcagcctccaccaagggccccatccggtcttcccccgtggccacccctcctcccaagacgcaccctctgggggcacagccggccctgggcctgcctggtcaaggcctacttccgtatctctcgctgagcgggctggcaggcgcatagnnnnnnnnnnnn

SEQ ID NO: 190818 - DNA, 200 bp, Homo sapiens
  misc_feature: GYAE6OF01A9C2G.11.67.G01.1.454.CMB.1.raw
  modified_base (174)..(200): a, c, t, g, unknown or other
  misc_feature (174)..(200): n is a, c, g, or t
tcagcgagagataccacgaccggtgctcgatttagagtatacatattgggtttgggggaagaggaagactgacggtcccccaggagttcaggtgctgggcacagcggccctgggctgcctggtcaaggactacttccgtatctctcggctgagcgggctggcaaggcgcatagnnnnnnnnnnnnnnnnnnnnnnnnnnn

SEQ ID NO: 190819 - DNA, 549 bp, Homo sapiens
  misc_feature: GYAE6OF01DQ2FI.11.67.G01.1.454.CMB.1.raw
  modified_base (325)..(325): a, c, t, g, unknown or other
  misc_feature (325)..(325): n is a, c, g, or t
  modified_base (533)..(534): a, c, t, g, unknown or other
  misc_feature (533)..(534): n is a, c, g, or t
  modified_base (536)..(549): a, c, t, g, unknown or other
  misc_feature (536)..(549): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatatgcactggtggcaactgctacgacgcctactattatcaccacatggacgtctggggcaaaagggccacggtcatcgtctcctnagcctccaccaagggcccagtccgtaccttccccctggccacccctcctcccaaagacgccaccctcgtcggggggccacgacggccggcccgtcggggcttcggccgtcgggtaccgaaacgggtaccttaacctttcccggtaattccgtccttccggctcggaacgggtcgggtccttgggaccgaagggccgccaagttacggnngnnnnnnnnnnnnnn

SEQ ID NO: 190820 - DNA, 754 bp, Homo sapiens
  misc_feature: GYAE6OF01CJRBO.11.67.G01.1.454.CMB.1.raw
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
tcagcgagagataccacgaccggtgctcgatttagagtatacatattggggtttggggggttgagaagacaggactcaggacaatctccagcatggccagcttccctctcctcctcaccctcctcactcactgtgcgagggtcctgggcccagtctgttctgactcagcccaccctnagcgtcgtcgggaccccgggnagagtaatccaaccatctcttgtactggaacgcaagctacaaatagtacgggaaagtaaccgatgtactaaagttggtaatacaactactccgtaccccggtaaccggacccctaaacttcctacacgttactaagttaaggaaactacgacccgacggcccgtccccgtacggtaccggggttcccctgggccgtactttcgtcgttcggccgttacggaagtccgtacgggccaacccgtcgaccgtccctccgttcgggaccctgaccgaggtcgggcctcgacgttcgtaggaggtagtacgggacgtacttaggtaaccttagtttagttaggtcgaccggtaagggtcgggttagggaacgttcgggtaaccgggtttgaaggtacgggttcgtccggtttgggtacgggttccggttacggggacgggtaacggggtaaccaaacgggttccttaaccgggtcccggtccggttagggcccgaacggtaaccccggttaagggccccttcccggtaccccccggttggtaacccctcggtttcccccgg

SEQ ID NO: 190821 - DNA, 555 bp, Homo sapiens
  misc_feature: GYAE6OF01EOTSQ.11.67.G01.1.454.CMB.1.raw
  modified_base (165)..(165): a, c, t, g, unknown or other
  misc_feature (165)..(165): n is a, c, g, or t
  modified_base (396)..(396): a, c, t, g, unknown or other
  misc_feature (396)..(396): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctnagcgtctgggacccccgggagagaatcaccatctcttgtactggaagcagctccaatatcggaaagtaacgatgtacaattggtatcaacatcctaccccggtacgcccccaaatcctacatctaataggaatagccaggcgccctcgaggggtccctggccgattctctggctcgaagtctggcactcagccctcctggcctgcaggtggctccgagtctgagatgaggntgactattatgtgcagcgtggagtgagtctgagtgcgtgtggtcttcgggacggtagggaccgaagtcgtagtacccggttccgtaggggtaccacggaccccgaaacggtcccgtaccggccccccgttacgggttaccctaaccgtcgttccccggg

SEQ ID NO: 190822 - DNA, 689 bp, Homo sapiens
  misc_feature: GYAE6OF01DO2MU.11.67.G01.1.454.CMB.1.raw
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
tcagcgagagataccacgaccggtgctcgatttagagtatacatattgggttgagaagacaggactcaggacaatctccagcatggccagcttccctctcctcctcacccctcctcactcactgtgcagggtcctgggcccagtctgttctgactcagcccaccctcagcgtctgggaccccccggnaganaactccaccatctcttgtacgtggaagcagtcctaccaatacgtacggaaagtaacgatcgtactaagttgtatacaactacgtcccgtaccccggtaacccgaccccaaactcctacatactagtaggaatacgccgacggccggcccgtcggaccgggtcccgtggccgtattccgtcgtacggcgtacgtacgttccgtcggcctacctcgaccgtccccttcccgtcggtccgtcgcgtaggtcgggtcctaccgtagtcgtaggaggtagtggacggtcgttagtaacgtttagttacgttgtcgtcgtaggtcgggtagggtagtcggtacggttcgtggtaggttcggttcgttgggttcggttcggttcggggtacgggtaacgggtaacgtacgtccgtacggtacccgttaccgtaacgtaccgaaccggtacccggtaacggtccccgtacccgtcccccgttaccggtccctccgttcccgtcccg

SEQ ID NO: 190823 - DNA, 667 bp, Homo sapiens
  misc_feature: GYAE6OF01AKC9K.11.67.G01.1.454.CMB.1.raw
  modified_base (175)..(175): a, c, t, g, unknown or other
  misc_feature (175)..(175): n is a, c, g, or t
  modified_base (194)..(194): a, c, t, g, unknown or other
  misc_feature (194)..(194): n is a, c, g, or t
tcagcgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctnagcgtctgggacccccggnagaaaatcaccatctcttgtactggaagcagctccaatatcggaagtaacgatgtcaattggtatacaacatcctccccggtacggacccccaaactcctcatctataggaatagccagccggccctcgacggggtccctggcccgtattccgtctggcctcgaagtctgggccaccctcgacgccccttcccgtcggcctcgccgaggttcggggacccttcccgagtccgtaggagggtagtggaggacgtagtacttaagtttagtttggttacggtcgaggtcgggttggggtacgttaggtacccgggttcgttacgggtagttcggtcgtttcgggttgggttccggtttacggggcgggtacgggaccgtaacggccgtcggacccggttccggtcgggtccgaccggtcccggtaacggtcccgtacccggtcccccgtacggtccctaccgttcccgttccccg

SEQ ID NO: 190824 - DNA, 579 bp, Homo sapiens
  misc_feature: GYAE6OF01AMTLD.11.67.G01.1.454.CMB.1.raw
  modified_base (185)..(185): a, c, t, g, unknown or other
  misc_feature (185)..(185): n is a, c, g, or t
  modified_base (400)..(400): a, c, t, g, unknown or other
  misc_feature (400)..(400): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatccaacatcctccccggtacggccccctaaactcctcatctataggaatagccagcgccctcgacggggtccctggccgtattcctctggctcgaagtctggcacctcacgccctccgtggccctgctaggtcggcctcgagtcgtgaggntgaggctagacttagtttattgtgcgaggtcggtgggacgtggacggttcgtggagtgcgttggtggtcgttcgggcgggtacgggacaaggtccgtacggacccggttccgtgggtcgacggacccgtaacggcccgtcccggtccccccgttaggtccctcccgttccgttccccgg

SEQ ID NO: 190825 - DNA, 729 bp, Homo sapiens
  misc_feature: GYAE6OF01D1JNM.11.67.G01.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (521)..(521): a, c, t, g, unknown or other
  misc_feature (521)..(521): n is a, c, g, or t
  modified_base (583)..(583): a, c, t, g, unknown or other
  misc_feature (583)..(583): n is a, c, g, or t
tcagcgagagataccacgaccggtgctcgatttagagtatacatattgggtttggggggggttgagaagacaggactcaggacaatctccagcatggccagcttccctctcctcctcaccctcctcactcactgtgcagggtcctgggcccagtctgttctgactcagccaccctcagcgtctcggggacccccggnagagaatcaacctntctcttagtactggaancacgctaccaatagcggtaaagtaatactagtaattgtatcaaacactaccaggaacccgcccaaatccactaatctaagttaagtaaatactacgacggcccggtcccgtacggacggggttcccctaggtaaccgtacttaccgttccgtacggtaccttacgtaaacgttcgtacggtacctacccttacggaccgtcccctttacccggcggtaccccgtaagtcccgtaaggggttccgggcccttaccgtaacggtttccgtaaggttaccgtaggtacgtaacggnggtacttagttaaacgttttacgttaccgtggttaccgacgtagtaccgtaggttacgggtntaccgtaaccctaccgtaggttaacgttcggttcgtttacggttggttcgggttaccggcgggtaacggtcgtaaccgtcgggtaacccgtacgtcggttaacggccacggtacccggctcccgcccggttccctggtacctaccg

SEQ ID NO: 190826 - DNA, 738 bp, Homo sapiens
  misc_feature: GYAE6OF01BDMDH.11.67.G01.1.454.CMB.1.raw
  modified_base (712)..(712): a, c, t, g, unknown or other
  misc_feature (712)..(712): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgacaaagtggacagcctgagacgccgacgacaccggccgtatattactgtgaccaagaactccgacagatatgctacgtggtggcacgtgacctacgaccgtaccttactattactaccgaccacagtcggacgtcgtacggggacgaaacgggaccacggtctacgtccgtcctccctacgtacgccccgtaccaacccggaaccgggtccccaacgtttcccggttccctttccccccgtacggtacccctacccctaccccgtacccgaacggtaccgtacccgtacccggttcgggaccgggggaccaaaccggacccgggtccccgggtcccgggttacgggtcccgttccgggtacccggttacgggtaacccggtaaacgggttacccgtttaacccggtttacccgttaacgttcccgttaccggtacccgtaccgggttaccgggaaccgggtcccggggttaccgggtaccgggaacccgggtaacccggggtacgaaccgttaacggaacggtcacgcgacggngcgacgacgcgtcgacancgngtgcg

SEQ ID NO: 190827 - DNA, 692 bp, Homo sapiens
  misc_feature: GYAE6OF01BB78H.11.67.G01.1.454.CMB.1.raw
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
tcagcgagagataccacgaccggtgctcgatttagagtatacatattgggcttggtgcagccgaggggggtccctgagactctcctgtgtaggctctggattcagttttagcagctacgccatgacctggggtccgccaggctccgaggggaaggggctggagtgggtctcggctattaatggccacgggtggcaagacatactacgcagagtccgtgcgagggccgatgcaccatctccagagacaacttcccgaagaacgacgtctagtacctgacaaagtggaacagccgtggagacgccgagacgacggccgtatattacngtcgacaagaactccgtacagtatatgacngtggcgactaacgtcgactacggtaccgtaccttaattacttactacaaccanagtacgggtacgtcggtagggacgaaacgggaccgtaaggtctacgtccgtccttaccgactaccgcccgtaaccgaaccggaaccgggtacccctacggttccccggttaccccttccccggttccgacccctaccccgttaccctaccgaacgtaccgtacccgtacccggtccgggttaccggggaccaaccgggtacccggccccggggtaccccgggttgggacccgttccgggacccgggttaaggtacccggtaaacggtaccccgtttaacccggg

SEQ ID NO: 190828 - DNA, 825 bp, Homo sapiens
  misc_feature: GYAE6OF01BUNUI.11.67.G01.1.454.CMB.1.raw
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
tcagcgagagataccacgaccggtgctcgatttagagtatacatattgggttgagaagacaggactcaggacaatctccagcatggccagcttccctctcctcctcaccctctcactcactgtgcagggtcctggcccagtctgttctgactcacgccacctnagcgtcgtcgggaccccgnagagatcacntctntgtacnggancagctacaatagtacggaagtacgtntgtactaagttgtactcaactctcccgtacccggtaccgacccctaatcctacatactaagtaggactacgccgacggcccgtaccgtcgggaaccgggttccacgggtccttacttcgtcggtacgggaccttacggtaaccgttccggtacggtaccctaacccgtccgaacccgttcccccggttaacccggtcgggtccccgttaggtacccgggtacggggttacccggtacccgtttaccgacgggtttaccgtaacggggtaacgggtacggttcggggtaaaccggtttccgtaaggtttaacccttttagggtttaacggtcgggtaacggtacgggtaccgggttaacggggtcgggttaacggttacgggttaccgttcggggttaaggttcggttacggtcggtttggggttaccgggttcgggttaaccggggaccgggggtacctaaaccggtcgggttcccgttaaccggggtccggttccggtaacggggacccacccgggtaacccgtacggttcccggttacccccggtccccgttaagggttcccccttaaccgggtttccccttaacccccgg

SEQ ID NO: 190829 - DNA, 718 bp, Homo sapiens
  misc_feature: GYAE6OF01APXLR.11.67.G01.1.454.CMB.1.raw
  modified_base (165)..(165): a, c, t, g, unknown or other
  misc_feature (165)..(165): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctnagcgtctggggacccccggagagaatcacatctcttgtactggancagctcaatgtcgaagtacntgtacaagttgtatcaactactcccgtccccggtacgaccccctaaactcctacatctagtaggaatacgccgagccggtccctcgggtacgggtccctacgggcccgtatttcgtacccgtggtctacgaacgttccgtggtaccctacctaccggacctccccgtaccgtcggtacccttggccgtaacggttccgggcttacccgacggttctacggggaacgtacgtagggttaacgggcttacggaacttttaactttaggtttcggtcgtaacgtcgggtacggttggggaacgttcggacggttcgtaaggtcgttaggtccggttaggttccggttcggttacccggggaggggaccggttaacccgaacgggtccgttaccggtacccgggttaccgggttcgggtcggaaacccgtcccggtaaaccggtccgttccccgtaccccggtccgtaacgcccgttttacccggtccccgg

SEQ ID NO: 190830 - DNA, 766 bp, Homo sapiens
  misc_feature: GYAE6OF01CDII9.11.67.G01.1.454.CMB.1.raw
  modified_base (188)..(188): a, c, t, g, unknown or other
  misc_feature (188)..(188): n is a, c, g, or t
  modified_base (217)..(217): a, c, t, g, unknown or other
  misc_feature (217)..(217): n is a, c, g, or t
  modified_base (598)..(598): a, c, t, g, unknown or other
  misc_feature (598)..(598): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtcttgttctgactcacgcccacctcagcgtcgtcgggacccccggnagagactcaccatctcttgtacaggaacncagcctaccaatacgacggaagtaacgatggtactaagttggtatacaactactcccgtccccggtaccgaccccctaaactccctacacttactaacgtaaggaactacgaccacggcccgggtacccctccgggtaaccggggttccccggtacgggtcccggtactttccgtccgtacgggtcccgttacggtaacgttccgtacgggtccctacccgtcgaccggtcccccgttccccggtcggtacccctcggtaccggtacgggtcgggtccctaccgtacggttccgtagggaaggtacggtaggacgggtcgttagtaactttaagtttacgttcgtacgtcgtaagggtcggtagggtacgtggtaccggtntacggtgtgttcggtggttcggttccggttacggggaccggtaacgggacctaggtcccgttaaccgggtcccggttccggttgggtacccgtacccggacccgttacgggtaccccgttcccgggccccccgtttagggtcccttcccgttcccggtttaccccccg

SEQ ID NO: 190831 - DNA, 731 bp, Homo sapiens
  misc_feature: GYAE6OF01ASRW6.11.67.G01.1.454.CMB.1.raw
  modified_base (191)..(191): a, c, t, g, unknown or other
  misc_feature (191)..(191): n is a, c, g, or t
  modified_base (583)..(583): a, c, t, g, unknown or other
  misc_feature (583)..(583): n is a, c, g, or t
  modified_base (601)..(601): a, c, t, g, unknown or other
  misc_feature (601)..(601): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcacgcccaccctcacgcgtcgtcggggaccccccggnaggagaactccacctatcttcttgtacgtggaacgcacgcctacctaatacgtacgggaaagtaacgatacgtactaaatttggtactacaaactacgttcccgtacccccgggtaacccggaccccctaaactccctactacttacctaagtaacggaatccgaccgacggccccggtacccgtacggaccggggttcccctacgggtcccgtaacgtttccgttccgtcggttaccgtacggtaacggttccgtcggcctaacccgttccgaccgtcccccgttcccgtacggtccccgtaggtcccgtagggtcggtaccctccgttacgtcctagggtacggagtcgggacgtcgtagtaactttagttagttgtcgacgtggtacgngggtacgtcggacggttntggacgttcgtcgtagggttccggttcggtacggggacgggtacggtacgaacgcgtaaccggccgttcggacggtaccgcgtacccgggacgttccgcccgttccccgtagccttaccgtcgtaccccc

SEQ ID NO: 190832 - DNA, 740 bp, Homo sapiens
  misc_feature: GYAE6OF01AS6OB.11.67.G01.1.454.CMB.1.raw
  modified_base (173)..(173): a, c, t, g, unknown or other
  misc_feature (173)..(173): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (483)..(483): a, c, t, g, unknown or other
  misc_feature (483)..(483): n is a, c, g, or t
  modified_base (597)..(597): a, c, t, g, unknown or other
  misc_feature (597)..(597): n is a, c, g, or t
tcagcgagagataccacgaccggtgctcgatttagagtatacatattggggtttggggggggttgagaagacaggactcaggacaatctcagcatggccagcttccctctcctcctcaccctctcactcactgtgcacggtcctgggccagtctgttctgactcagccacctnagcgtcgtcgggacccgagagactcacntctctgtacnggaacncagcctacaatcgtacgtaacgtaacgtntcgtactaagttggtaactaccaaactcgtaccccggttacccccgggtaacccgtaaccccctaaacttccctactaacttaccgtaagtaacgggtaacttaccgaccgtaccggcccggtacccgtacggaccgggggttccctacggggtacctacgtttccgttacgtacggtacgtacggtacgttcgtcgggacctaccgtccgtaccgtcccgttaccgcgggttaccnggaccgtaaggtccgggtccttacgtacggttacgtaggtacggtacgtacgggtacggtacgtacgtaacgtttagtttacgttacggacgtcgtacgggtcggtacgggtanacggtacggtcgtaaggtcgtcgtgttacggtggtaccggtacgggacgggtaacgacgtacggacgtccggtaccgtggtacgggacctaccggacccgtacggtccctacccgggtaccccgtcgtaccgtccgttacccg

SEQ ID NO: 190833 - DNA, 743 bp, Homo sapiens
  misc_feature: GYAE6OF01CPLZG.11.67.G01.1.454.CMB.1.raw
  modified_base (90)..(90): a, c, t, g, unknown or other
  misc_feature (90)..(90): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
  modified_base (573)..(573): a, c, t, g, unknown or other
  misc_feature (573)..(573): n is a, c, g, or t
tcagcgagagataccacgaccggtgctcgatttagagtatacatattgggttgagaagacaggactcaggacaatctccagcatggccancgttccctctcctcctcaccctcctcactcactgtgcagggtccgtcgggccctagttctgttcctgactcacgcccacctcagtcgtcgtcgggacccccggnagagaactccacnttctcgttagtacgtggaacgcagtaccttaccaaagttacgtacggaaagtaacgtntcgtacttaaagttggtaactacaactacgtccccgtaccccgggtaccgaaccccctaaactcctactattacgtaagtaacgaactacgaccacggcccggcctacgggcgggtcccgtcgtaccgtacttcgtcgtcggcgttacgtacgtcgtcggaccctaccgtcgaccgtccccgtccggtcgtaccgtggtacgacggtccggtacctaccgtgtcgtaagggagtacgtggacgtacgttacgtactttaagttgtacggtcgtacgtacggtggtaggtcgtacggtaaccgggtttntaggtaggtcgtggtttcggtacggttaccggtcggacggggacgtaacccgtacggtacggtacccggttaccggttcggtaccggaccggtaacccgtacccgggtccgttacccccggtccccgtacccggtacggttccccgttacccgttcccggtttacccccg

SEQ ID NO: 190834 - DNA, 775 bp, Homo sapiens
  misc_feature: GYAE6OF01BEW27.11.67.G01.1.454.CMB.1.raw
  modified_base (195)..(195): a, c, t, g, unknown or other
  misc_feature (195)..(195): n is a, c, g, or t
  modified_base (591)..(591): a, c, t, g, unknown or other
  misc_feature (591)..(591): n is a, c, g, or t
  modified_base (607)..(607): a, c, t, g, unknown or other
  misc_feature (607)..(607): n is a, c, g, or t
  modified_base (626)..(626): a, c, t, g, unknown or other
  misc_feature (626)..(626): n is a, c, g, or t
tcagcgagagataccacgaccggtgctcgatttagagtatacatattgggttgagaagacaggactcaggacaatctcagcatggccagcttccctctcctcctcaccctcctcactcactgtgcagggtcctgggcccagtctgttctgacctcagccctaaccctgagtccgtcgtccggggaccccccgggnaaggacgtaactccaacctagttccttcgttacggtacgtagggaaacgccgaacgtcctaacctaaagttagtaaccggggaaatacggtatggttactaagtttcggtatacaacgtccttacccgtaccccggggtacccgacccctaaatccttactacgttactaaggtaacggtaactcggaccacgggtccccgtacccgttacgggtaccggggttccccgtacgggtaccctttacgtttctcggttaccggctttacccgaaggtttccggacggtaccctccgttaccggacccgttccccgtccgggttgcccccgttagggctacggggtccggtactaccggtcgttggtacggaagtgtcggaggtactcgtaattcgttntcgggatcgtaacggnggtgtacggtcgacgttgngtctcgggtgttacgggttcgacgggttcgggacggggtaaccacgccgttgggtcccttacggggtcgtaacgggtcccgaaccggcccttaacgggttccccggtacccccgtacggttcctaccttacccggtccgggttaccccg

SEQ ID NO: 190835 - DNA, 689 bp, Homo sapiens
  misc_feature: GYAE6OF01BDD9M.11.67.G01.1.454.CMB.1.raw
  modified_base (152)..(152): a, c, t, g, unknown or other
  misc_feature (152)..(152): n is a, c, g, or t
  modified_base (166)..(166): a, c, t, g, unknown or other
  misc_feature (166)..(166): n is a, c, g, or t
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (265)..(265): a, c, t, g, unknown or other
  misc_feature (265)..(265): n is a, c, g, or t
tcagcgagagataccacgaccggtgctcgatttagagtatacatattgggttgagaagacaggactcaggacaatctccagcatggccagcttccctctcctcctcaccctcctcactcactgtgcgagggtcctgggccctagtctgttcngactcagccacctnagcgtcgtcgggacccccggnagagaatccaccattcctcgttgtaacgtggaacncgtacgtacctaccaaagtacgtaaccgggtaaagtaaccgtnttcggtactaaagttggtataccgaactactcccgtaccccggtaccgacccctaaacgtcctactactactaagtacgaactcgaccgacggccgtcccgtcgacgggtccgtggcctacttccgtcgcgtaccgtagtaacgttcgacgtccacctcgtaccgtccccgtcccgtgacccgtcgcgtacggtccggcctacgtacgtacgtggtaacggacgtacggcggtacgttagtacgttagttacgttgtcgtcgtcggtacgggttggtacgttacggtcggttcgtaggtcgtacggtcgttggttcgggtcggttcgggacgggacggacgtacgtcggtaccggtccggtcggtcggaccgtaccgccggtacggtccgtcccgtccccgtgtccgtccgttccgttaccccg

SEQ ID NO: 190836 - DNA, 177 bp, Homo sapiens
  misc_feature: GYAE6OF02HXABC.11.67.G01.1.454.CMB.1.raw
  modified_base (173)..(177): a, c, t, g, unknown or other
  misc_feature (173)..(177): n is a, c, g, or t
tcagcgagagataccacgaccggtgctcgatttagagtatacatattgggtttgggggaagaggaagactgaaggtcccccaggagttcaggtgctgggcacagcggccctgggctgcctggtcaaggactacttccgtatctctcgctgagcgggctggcaaggcgcatagnnnnn

SEQ ID NO: 190837 - DNA, 173 bp, Homo sapiens
  misc_feature: GYAE6OF02F1LM6.11.67.G01.1.454.CMB.1.raw
  modified_base (173)..(173): a, c, t, g, unknown or other
  misc_feature (173)..(173): n is a, c, g, or t
tcagcgagagataccacgaccggtgctcgatttagagtatacatattgggtttgggggaagaggaagactgacggtcccccaggagttcaggtgctgggcacagcggccctgggctgcctggtcaaggactacttccgtatctctcgctgagcgggctggcaaggcgcatagn

SEQ ID NO: 190838 - DNA, 173 bp, Homo sapiens; identical to SEQ ID NO: 190837
  misc_feature: GYAE6OF02H43TL.11.67.G01.1.454.CMB.1.raw
  modified_base (173)..(173): a, c, t, g, unknown or other
  misc_feature (173)..(173): n is a, c, g, or t

SEQ ID NO: 190839 - DNA, 552 bp, Homo sapiens
  misc_feature: GYAE6OF02I4RDP.11.67.G01.1.454.CMB.1.raw
  modified_base (364)..(364): a, c, t, g, unknown or other
  misc_feature (364)..(364): n is a, c, g, or t
tcagcgagagataccacgaccggtgctcgatttagagtatacatattgggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatattgcactggtgcaactgctacgacgcctactattancaaccacatggacgtcgtggggacaaagggaccacggtcatcgtctcctcacgcctccacccaacgggcccacgtccggtcccttcccccgtcggtccctaccctccctacccaacgacgccacccgtcgtcggggcaccgacggccggcccgtgggcctcgcccgtcggtaccgaggtaccttaccg

SEQ ID NO: 190840 - DNA, 701 bp, Homo sapiens
  misc_feature: GYAE6OF02F00YL.11.67.G01.1.454.CMB.1.raw
  modified_base (186)..(186): a, c, t, g, unknown or other
  misc_feature (186)..(186): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggaccccccgggnagagaatcaccatctcctgcactggaaacngctccaacgtcggggcaggttangatgttcactggtaccagcaccttccacaaacacgcccccaaactcctcatatatggtaacagcattcggccctcacggggtccctgaccgattctctggttccttgtctgacacctcacgcctcctggcccatccactcgggcctccgacgtccgtgagggactggaggccttgtaactttacttacgttgttaccacgtttccttttacggaactaacttttaaaaccgtgggtaacttagggttacgggtttaacgtttaccggggaccggggaaccggggtaaccccctaaaccgggttaaaccccggttccccgttaacgggttacccgaacggtacccccggtaaaacgggccctttacccgggtaccccccccgtttccggggttaccctaccccgtttccgttacccggttttccccccccggcccccctttacccgttacccggtttaacccg

SEQ ID NO: 190841 - DNA, 755 bp, Homo sapiens
  misc_feature: GYAE6OF02JLD2A.11.67.G01.1.454.CMB.1.raw
  modified_base (173)..(173): a, c, t, g, unknown or other
  misc_feature (173)..(173): n is a, c, g, or t
  modified_base (195)..(195): a, c, t, g, unknown or other
  misc_feature (195)..(195): n is a, c, g, or t
  modified_base (517)..(517): a, c, t, g, unknown or other
  misc_feature (517)..(517): n is a, c, g, or t
tcagcgagagataccacgaccggtgctcgatttagagtatacatattggggttgagaagacaggacttcaggacaagtctccagaccatggccagctttccctctcctcctcaccctcctcactcactgtgcagggtcctagggcccagtctgttctgactcagcccaccctnagtcgtctcgggacccccgggnaggagaactccacctatcgtcgttcgtaactcggaaagccaggtcctaccaaattacgtacggaaacgttaaccgattcgttacaaagtttcggtaactaccaaacgtacgttcccggtcccccgggttaacccggacccccctaaaacttcccctactaacttaccttaaagttacggtaaacgttaccgaccgtaacggcccgggtacccctacggtaaccgggggtccccgttacgggccccgtaagtttcccgtacggttcgggaccttacgggaacgttccggtagggccctaccgtcgaacggtccccttacccgnggtccctcgaccgtaggtccgggtcctaccgacggttccgtggtaacggacggttggaacggtcgttacgaactttaagttacgttgtagcgtacggtggtaggacgtcgtacggtcgtaggtacgtcggtcgttaggttcgggttcgttacgggacggtacggacgtagcgtacgtaccgtccggtaggtacgacgtccgaagtcccgtctccccgtgtccttaccgtcgttacccg

SEQ ID NO: 190842 - DNA, 530 bp, Homo sapiens
  misc_feature: GYAE6OF02JFT73.11.67.G01.1.454.CMB.1.raw
  modified_base (225)..(225): a, c, t, g, unknown or other
  misc_feature (225)..(225): n is a, c, g, or t
  modified_base (514)..(514): a, c, t, g, unknown or other
  misc_feature (514)..(514): n is a, c, g, or t
  modified_base (518)..(522): a, c, t, g, unknown or other
  misc_feature (518)..(522): n is a, c, g, or t
  modified_base (524)..(530): a, c, t, g, unknown or other
  misc_feature (524)..(530): n is a, c, g, or t
tcagcgagagataccacgaccggtgctcgatttagagtatacatattggtttgggtgtcccgaagctgctggagtgggtctcggcgtattaatggccacggtggcaagacatactacgcagagtccgtgcagggccgatgcaccatctccagagacaattcccagaagacgctgtacctgcaaatggacagcctgagagccgagacacggccgtatattactgtnccagaaatccgtcagatattgcactggtgcaactgctacgcgcctactattatcaccacatggacgtctggggcaaagggccacggtcatcgtctcctcagcctccacctaagggccccatccggtccttccccctgggcccaccctccctcccaacgacgccaccctcctcgggggccaccgacgccggcccgtcgggccgtcgcccttgggtccaacgggaccttacgttcccgtactcctcgtcgccttcgacgtccgggcttcgggccaacgggccgcacgtgcngcgnnnnncnnnnnnn

SEQ ID NO: 190843 - DNA, 495 bp, Homo sapiens
  misc_feature: GYAE6OF02H3ZS0.11.67.G01.1.454.CMB.1.raw
  modified_base (482)..(482): a, c, t, g, unknown or other
  misc_feature (482)..(482): n is a, c, g, or t
  modified_base (487)..(495): a, c, t, g, unknown or other
  misc_feature (487)..(495): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacgggtcatcgtctcctcagcctcccaccaacgggcccatccggtctccccctggccaccctccctcccaagacgcaccctcgtgggggccacgaggccggccctggggcctggccctggtccaaaggtactaccttccgtatcctctcgctgacgcgggctggcaaggcgnatagnnnnnnnnn

SEQ ID NO: 190844 - DNA, 483 bp, Homo sapiens
  misc_feature: GYAE6OF02JG4GC.11.67.G01.1.454.CMB.1.raw
  modified_base (459)..(459): a, c, t, g, unknown or other
  misc_feature (459)..(459): n is a, c, g, or t
  modified_base (467)..(468): a, c, t, g, unknown or other
  misc_feature (467)..(468): n is a, c, g, or t
  modified_base (470)..(483): a, c, t, g, unknown or other
  misc_feature (470)..(483): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtctcccctggccaccctcctccaagcgcaccctcgtcgggggcacagcggcctcgggctgcctggcaaggactacttccgtatcctctcgctgagcgggctggcaggcncgatacgnngnnnnnnnnnnnnnn

SEQ ID NO: 190845 - DNA, 662 bp, Homo sapiens
  misc_feature: GYAE6OF02GLDYJ.11.67.G01.1.454.CMB.1.raw
  modified_base (166)..(166): a, c, t, g, unknown or other
  misc_feature (166)..(166): n is a, c, g, or t
  modified_base (187)..(187): a, c, t, g, unknown or other
  misc_feature (187)..(187): n is a, c, g, or t
tcagcgagagataccacgaccggtgctcgatttagagtatacatattgggttggagaagacaggactcaggacaatctccagcatggccagcttccctctcctcctcaccctcctcactcactgtgcagggtcctgggcccagtctgttctgactcagccaccctnagccgtctgggacccccgggnagacgaatccaccatctcttgtactggaacgcagctccgaaatatcggaagtacgattgtcaaatttggtatcaaactacttcctccccggtacgacccccaaacgtccctacatcctaagtaggaaattacgccagccggtccctacggacggggttcccctcgggcccgttagtttcctcgtgggccttacggaacgttccgttgggacctacccgttcacgtccccttaccccgtggccctacgcctaggtcggggcctccgtacggtcgtaggacggtagtggaacggcgttagtaccttatttagttcgttgtacgagtcggtagggacgtcggtacggtcgtggtagtcgtcgttgggtcggttcgttcgggcgggtaacggaccgtagcgtcggtacccggtcggtcgggtccgacggcccgtaaggccgttcccggccccgtacggttcctaccgttccttaccccg

SEQ ID NO: 190846 - DNA, 533 bp, Homo sapiens
  misc_feature: GYAE6OF02FT74S.11.67.G01.1.454.CMB.1.raw
  modified_base (184)..(184): a, c, t, g, unknown or other
  misc_feature (184)..(184): n is a, c, g, or t
  modified_base (329)..(329): a, c, t, g, unknown or other
  misc_feature (329)..(329): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccggnagagaatcaccatctcttgtactggaagcagcctccaaatatcggaagtaacgatgtcaattggtatcaacatctccccggtacggcccccaaactcctcatctatagaatagccagcggccctcaggggtccctggccgattcnctggctcgaagtctggcacctcagccctcctggcctgcagtggcctcagtctagagatgaggctgacttattagttgtgcaggtcgtgggatggacggtctgagtcgcgtggtgtcgttcggcggacggacgagcgtaggaccgttcgtgggtaccacgtcccgaaggcctaccggtcccccgtcggtccaccgtcttacccgg

SEQ ID NO: 190847 - DNA, 550 bp, Homo sapiens
  misc_feature: GYAE6OF02GHB86.11.67.G01.1.454.CMB.1.raw
  modified_base (186)..(186): a, c, t, g, unknown or other
  misc_feature (186)..(186): n is a, c, g, or t
  modified_base (214)..(214): a, c, t, g, unknown or other
  misc_feature (214)..(214): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctggggacccccgggnagagaatcaccatctcttgtactggaancagctccaatatcggaataacgatgtcaattggtatcaacatctccccggtacgcccccaactcctcatctataggaatagccagccggccctcgacggggtccctggccgattctcgtggctcgaagtctggccacctcagccctccgtggccctgcaggtcgggcctccgagtcgtgaggatggaggtctgacttattgttgtgcgaggtcggtgggatggacggtctggagtgcttggtggttcgttcgggcggtagggaccagcgtcggaccgtcgtcgggtcacggacccgaaggtcctccggtcccccgtcggtcctaccgtccgtcccg

SEQ ID NO: 190848 - DNA, 574 bp, Homo sapiens
  misc_feature: GYAE6OF02F1ID8.11.67.G01.1.454.CMB.1.raw
tcagcgagagataccacgaccggtgctcgatttagagtatacatattgggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattccagaagacgctgtacctgcaaatggacagcctgagagccgacgacacggccgtatattactgtgccaagaaatccgtcagatattgcactggtggcaactgctacgacgcctactattatcaccacatcggacgtcgtaggggacaaacgggaccgaccggtcatccgtctccctcacgccctaccaccgaacggggcccaagtccggttcctcccctcggcctacccctccgtaccaacgacgccaccgtcggtcggggtccaccgacggacccgggtcccgtcgggccgtcggcccgttaggtaccgtaaggtaccctttaacccgg

SEQ ID NO: 190849 - DNA, 578 bp, Homo sapiens
  misc_feature: GYAE6OF02HZPWL.11.67.G01.1.454.CMB.1.raw
  modified_base (288)..(288): a, c, t, g, unknown or other
  misc_feature (288)..(288): n is a, c, g, or t
  modified_base (481)..(481): a, c, t, g, unknown or other
  misc_feature (481)..(481): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtcagatattgcactggtggcaactgctacgacgcctactattactcacccaanatggactctggggccaaagggaccacggtcatcgtcctcctacagtcctcccacaagggcccagtcggtaccttcccccgtgccctacccctcctccgaacgacgccaaccgtcgtcggggacctacgacggccggacccgtcgggcctcggccgtcggtaccgtaacggacttaccgttacgtactccttcncgtaccttacggacgtccgggccttgggacccgtaaacggccgaacgacgttaacggctacgtacgcgtactacgtacgctagcncggtcnctntgc

SEQ ID NO: 190850 - DNA, 742 bp, Homo sapiens
  misc_feature: GYAE6OF02JX4FH.11.67.G01.1.454.CMB.1.raw
  modified_base (167)..(167): a, c, t, g, unknown or other
  misc_feature (167)..(167): n is a, c, g, or t
  modified_base (188)..(188): a, c, t, g, unknown or other
  misc_feature (188)..(188): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagcccacccctngtcgtcgccggggaccccggnagagactccactacttcttcttacgtacgtaggaacgcacgtcctaacctaaagttacgtaacgggtaaacgttaaacagtttacgtaacttaaggtttggttactacaaactacttccccggtaccccggtaccccggaacccctaacctcctcaccttactacgtaacggaatacgaccgacggcccgtcctccggaacgggtcccgtcggccgttactcgtaccgtggtccgtacgtacgtcgtggacctcctactaccgtcctccgtcgcgtacgcgtaggtcgtcctacgtcgtgtcggagtgtaggcgtgtacgtaacgttagtttagtgtcgtacgacggtcgggtacgggtacgtcggtaacgggttcggtggtacgggtcggttcggttagggttccgggtttcgggttacgggtacgggtaaccggggtacctaaccggtcgtaccggttacccggttccgggtaccggttacggacccggaccggtaccggcccgttccccggtcccggttaccccggtctacccggtttccgttacccccgg

SEQ ID NO: 190851 - DNA, 525 bp, Homo sapiens
  misc_feature: GYAE6OF02GNBG6.11.67.G01.1.454.CMB.1.raw
  modified_base (127)..(127): a, c, t, g, unknown or other
  misc_feature (127)..(127): n is a, c, g, or t
  modified_base (324)..(324): a, c, t, g, unknown or other
  misc_feature (324)..(324): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(519): a, c, t, g, unknown or other
  misc_feature (516)..(519): n is a, c, g, or t
  modified_base (522)..(525): a, c, t, g, unknown or other
  misc_feature (522)..(525): n is a, c, g, or t
tcagcgagagataccacgaccggtgctcgatttagagtatacatattgggtttgggtgcccaagctgctggagtgggtctcggctattaatggccacggtggcaagacatactacgcagagtccgtnaggccgactgcaccatactccagagacaattcctacgaagaacgcctgtacctgcaaataggacagcctgagagccgacacacggccgtatattactgtgaccagaaaataccgtcccagatatttgcacctggtggcaactgctacgacgcctatattatcaccaacatgacgtgtcgggacaaaggaccacggtnatcgtctcctcagcctcaccaagggcccatccgtcttccccacggcaccctctccgagagccacctcagggggccacgagccggaccgtcggcgtcgccggtggtaccgaagggtacctacttcccggtaatcgtactcgtctcgagggtcgagtcgacaacggtcacacgttanacgtgcngtacnancannnnacnnnn

SEQ ID NO: 190852 - DNA, 733 bp, Homo sapiens
  misc_feature: GYAE6OF02I2377.11.67.G01.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
tcagcgagagataccacgaccggtgctcgatttagagtatacatattgggcttggtgcagccgagggggtccctgagactctcctgtgtaggctctggattcagttttagcagctacgccatgacctgggtccgccaggctccgagggaaggggctggagtgggtctcggctattaatggccacgggtggcaagacatactacgcagagtccgngcgaggccatgccacatcncagacacacttccagaagcgctgtacctnacaatggacagcctagagacgccgagacaccggccgtaatactactgtcgacctaagaactccgtaccaagtacttattcggacctacggtggtaggactaaccgtgaccgtacgacgtacccttactaacttataccgaacctacgacgtacggaccgttcgggtacggggaacgtaaacgggaccaacgggtctaacttaccggtccacccttacgaccgtcctacccgaaccggaacgggtccctacgttaccccgggttaccctttacccccggtcggtacccctacccccgttaccgtaaaccccggtaaacggacccgtacccgtaccccgggttccgggtttaacccggggggaccccgtaacccggtaaccgggtcccccgggttacccggggttccgggtacccggttccgggttaccccggttacgggtacccgtaaaccgggttacccctttaacccggg

SEQ ID NO: 190853 - DNA, 923 bp, Homo sapiens
  misc_feature: GYAE6OF02F5IN3.11.67.G01.1.454.CMB.1.raw
  modified_base (247)..(247): a, c, t, g, unknown or other
  misc_feature (247)..(247): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccacctcagcgtcgtgggacccccggacggagaatcaccgatcctcttgtactggaacgccagccttaccaatataccgggaaataacgnttgtacaatttggtactacaactattccgtaccccggttaccggacccccaaaaccgttcctacgaacttcgtaacgtaacggtaattacggaccctaagggccccggtacccttccggaaccggggttccccgtagggtcccgaattttccgaccgttcggggaccttaccggaacggtttccctacgggtccctaaacccgttcgaaccggtccctttaccccggtacgggtccgttacggacccgttaacgggtcgggtccccttaaccggtacgttcggttacggtacggtaacgttcgggtaacgggtacgttacgggaaccttttaacggttaacgtttacgggtttccggaaccgaaccgggtttcggggaacgggttaacggttacccggttaccggggttacctttaaccggggtaccgttacgggttccggttaccgggttttaccgggtttaacccggggttcccggggtaaccgggtaaccgggggttaaacccggaacggttaccgggttaaccccggtacccgggtttcccgggttaaccggggttcccggttaaacccggtacccgggttaaacccgggttcccggttaacccccggggttacccccccggtttacgggttacccccggtttaaccgttccccggtttttaaccccccggg

SEQ ID NO: 190854 - DNA, 689 bp, Homo sapiens
  misc_feature: GYAE6OF02FGOWL.11.67.G01.1.454.CMB.1.raw
  modified_base (189)..(189): a, c, t, g, unknown or other
  misc_feature (189)..(189): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagcccaccctcagccgtcgtcgggacccccgggnaagacgaatccaccatcctcgttgtactggaagcagctaccaatacgcggaagtaacgattgtacaattggtatcaacactccgtacccggtaccgaccccaaactcctacatctatacggaatcgaccacgccggccctacgacgggtccctcggccgtacttcgtctcggctcggaacgtcgtcggaccactccgacgtccctcccgtcggcctcgcgagggtcggtcctccgaagttccgtggaacgggtacgtacgggtacggcctacggtaacttattacgttcgtgtacgagggttcgggtagggtacgtacggtaccggttacgtggtacgttcgtcgttggttcggttcgtaccggggtacgggaacggtacccgaacggttccgtaccggtacccggttccggtacgggtacccgtaccgggacccgtaacggcccggttccccggtacccccgttcgggtaccccgttaccgttccccggttacccccgg

SEQ ID NO: 190855 - DNA, 592 bp, Homo sapiens
  misc_feature: GYAE6OF02I3UHD.11.67.G01.1.454.CMB.1.raw
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (570)..(570): a, c, t, g, unknown or other
  misc_feature (570)..(570): n is a, c, g, or t
  modified_base (590)..(590): a, c, t, g, unknown or other
  misc_feature (590)..(590): n is a, c, g, or t
tcagcgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtcgaccagaactcccggtacagatagttcgctacgtggtggcctaactgcctacgaccgcctactattatccaccgacatcggtacgtcgtggggacaaacgggaccacggtcatcgtctcgtcacgcctcccaaccgacgggccctagtccggttccttccccgtggcccacccctccctaccgaacgacgtacctacccgtcggtcggggacctacgacgggtcccggtcccgtcgggtccgtcgtcccgtacgggtacgtaacgtaccgttaccgttaccgttactccttcgtccgtacgcgtagggtccgggtcgtcggacgtacgcgctanacggtncgngancgtgactgactcagctagcngc

SEQ ID NO: 190856 - DNA, 915 bp, Homo sapiens
  misc_feature: GYAE6OF02FL2NU.11.67.G01.1.454.CMB.1.raw
  modified_base (214)..(214): a, c, t, g, unknown or other
  misc_feature (214)..(214): n is a, c, g, or t
tcagcgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagcccaccctcagcgtcgtcgggacccccggagagaatcaccatctcttgtactggaancacgctaccaaatacgtacggaagttaacgattgtactaagttggtaactacaaactactcccgtacccccgggtaaccggaccccccaaaacttccctactaacgttaccgttaagtaacggtaaactaccggtccaacgggtcccggtaccccttacgggaccggggggttccccctacggggtacccttaacgtttcccgttccggtacgggtcccgtttaaccgggtaaacggtttcccggtacgggtacccctaaaccccgttccgtaacccggtcccccgtttcccggtcgggtacccctacggtaccggtaacggggttccgggtacccttaccgtacggttcgtttaacgggaacgggttaggtacgggtacgggttaccgttacggtttaaaccgtttacgttttaacggtttcggttacggtaccgtacggggttacgggttacggggttaacgtaccggggttaaccggttcggttacggggttaacggtttcggtacggtttcgggttaccgggtttacggggttaccggggacggggtaaccggggtaccgtaaccgggtccggttaccgggtacccgggttcccggttacggggttaacccgacccggtacccggttaacggtccccggttaccccggtcccccggttaccggtttcccgtacccggtttacccggtttccccccgg

SEQ ID NO: 190857 - DNA, 700 bp, Homo sapiens
  misc_feature: GYAE6OF02IS7FY.11.67.G01.1.454.CMB.1.raw
  modified_base (176)..(176): a, c, t, g, unknown or other
  misc_feature (176)..(176): n is a, c, g, or t
  modified_base (557)..(557): a, c, t, g, unknown or other
  misc_feature (557)..(557): n is a, c, g, or t
  modified_base (689)..(689): a, c, t, g, unknown or other
  misc_feature (689)..(689): n is a, c, g, or t
tcagcgagagataccacgaccggtgctcgatttagagtatacatattgggcttggtgcagccgagggggtccctgagactctcctgtgtaggctctggattctagtttagcagctacgccatgacctgggtccgcaggctccgagggagggctggagtggtctcggctagttaagnggccgaggtggacaagacatacgtacgcaggacgtccgtgcgagggccgtagtcgcacctatcctaccgagtacgacaacgttcccgaagtaacgaccgtcgtacgtacgtgaacgtaaagtcggaaccacgccctaggaagaccggccggtaaccgaacggaccggtaccgtacttacggttactggacgaccgtaaagtaaccgttcccgacgtaaagtagttaacggttcacgtaacggttgggacgactaactggtaccaacgtaccgtacctaacgttaactacgtaccaactaacgtacgtacgtaacgtccggtaacggggtaaccaaacgggtaacccgtcgggtaacctaccgtcgtaccttcgtacctacncccgttaccaaccggtaccggaccctacgtcccgttccgaccccggttacgaccctacccgtaccaccgtaaaggccctacgtaccctcgggacggccacggacggtcccgacgtggcctacgctcggtaanacggtctaccg

SEQ ID NO: 190858 - DNA, 724 bp, Homo sapiens
  misc_feature: GYAE6OF02GATVA.11.67.G01.1.454.CMB.1.raw
  modified_base (168)..(168): a, c, t, g, unknown or other
  misc_feature (168)..(168): n is a, c, g, or t
tcagcgagagataccacgaccggtgctcgatttagagtatacatattgggttgagaagacaggactcaggacaatctccagcatggccagcttccctctcctcctcaccctcctcactcactgtgccagggtccctgggcccagtctgttctgactcagcccaccctnagcgtctgggaccccccggagagaactccaccgtatccttcttgtactgggaaacgtcagtcctaccaagtactaccgggaaagtaaacgagttggtaccttaaaggtttaggttactactaaccgtaagtcccgttacccccgggttaaccggacccccctaaaccgtccctacgacttaccgtatacggaaattacggcctaggaccggtccgtcggaccggggtccctgggacccgtacttccgttcgtcggtacctaccgaacgttcgtcgggacctacccgtcaccggcccttacccgtgtcctacggccaacgggtggtccctaaccgagttaccgtcggtacggtaggttcggaacggttctacgtacttacgtttagttgacggtcgtagggccgggttaggacgttacggtacggtcggtaacgtcgggtcgtcggttaggttccggtcgggttcggaccggaggtaccgagtccgtcgtcgtccggtggtaccgaccgtaccgacggtccgtaccgtcccgtaggtcccttacgtccgttaccccg

SEQ ID NO: 190859 - DNA, 751 bp, Homo sapiens
  misc_feature: GYAE6OF02JV8YU.11.67.G01.1.454.CMB.1.raw
  modified_base (125)..(125): a, c, t, g, unknown or other
  misc_feature (125)..(125): n is a, c, g, or t
  modified_base (193)..(193): a, c, t, g, unknown or other
  misc_feature (193)..(193): n is a, c, g, or t
tcagcgagagataccacgaccggtgctcgatttagagtatacatattgggttgagaagacaggactcaggacaatctccagcatggccagcttccctctcctcctcaccctcctcactcactgtncaggtcctgggcccagtcttgttctgactcacgcccaccctcacgcgtccgtccggggacccccgggnagaagaactccacctactcttcgttagtaccgtggaagcgacgtcctacctaagttacgacggaagtaaccgattacgtactaagttgtacgtaccaacgtacgttcccgtccccgggtacccgacccccctaaacctccgtctattcctaagtagtaatacgtccgaacgccggtaccgtcggtaccggtccgtacggtcctacgtccgtcgtcgctcgagtctcggcctacctcgtaccgcccgtcctacggccctggaccctacgggtcggtcctccggtaagtacgtacggtacgagtcggacgtcgttaacgtacgttagttacgttaggtcggtacggacggtcgggttaacggtacgggttcggttaccgggttgttacgggtcggttaacgtcggttaggttcccggtttacgggtccggggaccggtaacgggtaccgtacggttacccgacggggttacccggtacggttccgggacgttaccggtaccgtacggtcccgttccggtaccccgtccgggttacccttacccggttcccggttccccgg

SEQ ID NO: 190860 - DNA, 508 bp, Homo sapiens
  misc_feature: GYAE6OF01B45YF.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttgagtggatgggactaatcaaccctaatagtggtaggacagactacgcacagaagttccagggcagagtcgccatgacccgggacacgtccacgagcacagtctacatggagttgagcaggctgagatatgacgacacggtccgtctttatgcgcgagagaagggagtacagaaactcgtggtctccctttgctgtcgggg

SEQ ID NO: 190861 - DNA, 562 bp, Homo sapiens
  misc_feature: GYAE6OF01DOUN9.42.42.D09.1.454.CMB.1.raw
  modified_base (324)..(324): a, c, t, g, unknown or other
  misc_feature (324)..(324): n is a, c, g, or t
  modified_base (410)..(410): a, c, t, g, unknown or other
  misc_feature (410)..(410): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggactgagtggatgggactaancaacctaatacgtggtaggacagactacgcacagaagttccagggcagagtcgccatcgacccggacacgtcacgagcacagtcanatggagttgagcaggctgagatagtcgaacgacgaccggtccgttacgttttacgtcggcgtacggaaggaacggaaggggacgtaacgaacgtaaaacgttccgtacgggttacccttaccccgttttagacccgttacggtaccgggggg

SEQ ID NO: 190862 - DNA, 523 bp, Homo sapiens
  misc_feature: GYAE6OF01D5BST.42.42.D09.1.454.CMB.1.raw
  modified_base (225)..(225): a, c, t, g, unknown or other
  misc_feature (225)..(225): n is a, c, g, or t
  modified_base (304)..(304): a, c, t, g, unknown or other
  misc_feature (304)..(304): n is a, c, g, or t
tcagtgacgtatgtcacgaccggtgctcgatttagacacatacgcagggaaaggggcagtcagtccaacgaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctnagtgaaggtttcctgcaaggcatctggatacaccttcaccaggcaccatatgcactgggtgcgacacgggcccccgganaaggacttgagtggatgggactaatcaaccctaatagtggtaggacagactacgcaacagaagttccgagggcagagtacgccagtcgacccgggacacgtccacgagcacagtctacatggagttcgagcaggctgagatagtgacgacgacggccgttctttattgcgcgagacggaagggagtacagtaactctggtctcctttgcgtcgtcgggg

SEQ ID NO: 190863 - DNA, 560 bp, Homo sapiens
  misc_feature: GYAE6OF01BDF4V.42.42.D09.1.454.CMB.1.raw
  modified_base (223)..(223): a, c, t, g, unknown or other
  misc_feature (223)..(223): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctnagtgaaggtttcctgcaaggcatctggatacaccttcaccaggcaccatatgcactgggtcgcgacgacggcccccggaacaacggacttgagtggatgggactaatcaaccctaatacgtaggtaggacagactacgcanagaagtcgagggcagagtcgcagtcgacccgganaccgtccacgacgcacacgtctacagtggtagtgagcgaggctagagatagtaggacgacgacggccgttactttagtgccggacgaaggaggaagggaagtacgaacggtaaaccgttccgtacgggttcccttaccgttttacgaccgttacggtcgggg

SEQ ID NO: 190864 - DNA, 513 bp, Homo sapiens
  misc_feature: GYAE6OF01BJA2K.42.42.D09.1.454.CMB.1.raw
  modified_base (473)..(473): a, c, t, g, unknown or other
  misc_feature (473)..(473): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttgagtggatgggactaatcaaccctaatagtggtaggacagactacgcacagaagttccagggcagagtcgccatgacccgggacacgtccacgagcacagtctacatggagttgagcaggctgagatatgacgacacggccgtctttatcgcgcgagagaagggngtacgaagaactcgtggtctccctttgacttcgtacgggg

SEQ ID NO: 190865 - DNA, 506 bp, Homo sapiens
  misc_feature: GYAE6OF01B92JH.42.42.D09.1.454.CMB.1.raw
  modified_base (283)..(283): a, c, t, g, unknown or other
  misc_feature (283)..(283): n is a, c, g, or t
  modified_base (391)..(391): a, c, t, g, unknown or other
  misc_feature (391)..(391): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtncgacaggcccccggacaaggacttgagtggatgggactaatcaaccctaatagtggtaggacagactacgcacagaagttccagggcagagtcgccatgacccggganacgtcacgagcacagtctacatggagttgagcaggctggagatatgacgacacggccgtctttatgcgcgagagaagggagtacagaaactctggtctcctttgactcgtcgggg

SEQ ID NO: 190866 - DNA, 510 bp, Homo sapiens
  misc_feature: GYAE6OF01EJZEL.42.42.D09.1.454.CMB.1.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
  modified_base (454)..(454): a, c, t, g, unknown or other
  misc_feature (454)..(454): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctnagtgaaggtttcctgcaaggcatctggatacaccttcaccaggcaccatatgcactgggtgcgacagggcccccgganaaggcttgagtggatgggactaatcaaccctaatagtggtagacagactacgcacagaagttccagggcagagtcgcatcgacccgggacacgtccacgacgcacagtctacatggagttgagcaggctgagatagtgacgacgacggccgttntttagtgcgcgagaggagggatacagaactcgtggtctaccgtttgactgtacggg

SEQ ID NO: 190867 - DNA, 571 bp, Homo sapiens
  misc_feature: GYAE6OF01D49X0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtgaaggtttcctgcaaggcatctggatacaccttcaccaggcaccatatgcactgggtcgcgacacggcccccggacaacggaccttggagtggatgggactaatcaaccctaatagtggtagacagactacgcacagaagttccgagggcagagtcgccagtcgacccgggacacgtaccacgagacacacgtctacgagtggagttgagcaggctgagatagtcgaacgacgacggtccgttacttttagttcgccgacggaaggaggaaggggacgtaacgaagtaaaaccgttcccgtaggttaccctttacccgttttcgaacgttcggtacccggggg

SEQ ID NO: 190868 - DNA, 562 bp, Homo sapiens
  misc_feature: GYAE6OF01BXAML.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtcgcgacgacggcccccggacaaggacgttgagtggagtgggaactaatacaaccctaatagtggtagacagactacgcacagacgtcagggcagagtcgcatcggacccgggacaccggtccacgagcaacgacgtctacgagtggagttgagcgaggcgtagagagtagtaggaccgacgacggtccgtacttttagtcgcgacgaaggaaggtaagggacgtaacgaacgtaaacgtccgttaggtccttacccgtttacgaccgttacgtacgggg

SEQ ID NO: 190869 - DNA, 560 bp, Homo sapiens
  misc_feature: GYAE6OF01DEOTH.42.42.D09.1.454.CMB.1.raw
  modified_base (411)..(411): a, c, t, g, unknown or other
  misc_feature (411)..(411): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaaggacttgagtggatgggactaatcaaccctaatagtggtaggacagactacgcacagaagttccgagggcagagtcgaccatcgacccgggacacgtccacgagcacngtactacagtggagttgagcaggctagagatagtggacgacgaccggtccgttcgttttatcggtcggacgaggaaggaaggggagtacgaacggtaaaccttcccgtacggttcccttacccgttttcggaccgttcggtaccggggg

SEQ ID NO: 190870 - DNA, 572 bp, Homo sapiens
  misc_feature: GYAE6OF01EALRN.42.42.D09.1.454.CMB.1.raw
  modified_base (302)..(302): a, c, t, g, unknown or other
  misc_feature (302)..(302): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggttttcctgcaaggcatctggatacaccttcaccaggcaccatatgcactgggtgcgacacggcccccgganaaggacttgagtggatgggactaatcaaccctaatagtggtaggacagactacgcaacgagaagtccagggcagagtcgccagtcgacccgggacacgtacccgacgacgcaacagtctacatgggagttgagcagggctaggagatagtgacgacgacgggtccgttcgttttagtgcgacggaggaaggaaaggggtagtaaccgaaggtaaacccttcccgttaggttacccttacccgtttttacggaccgttacggtaccggggg

SEQ ID NO: 190871 - DNA, 682 bp, Homo sapiens
  misc_feature: GYAE6OF01EJF4H.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacgacgggcccccggacgaaggacttgaggtggagtgggactaagtcaaacctaataggtggtaggacagactacgcaacagaagttccagggcagacgtcgccatcggaccccgggacaccgtaccacgacgacacgagtacctacagtacgggaggttggacgacgagggctaggaagagttaacgtacgggaaccgaaccgtaacccggggtacccgtttacgttttttaacgttccggtaccggtaccgggaaagggtaacgggtaaaaggggggtaacggttaaacccgaaaccgggtaaaaacccgtttccccggtttaacggggtttaccccttttacccccggttttttacgggtaaacccggtttaaccgggttaacccgggggggg

SEQ ID NO: 190872 - DNA, 528 bp, Homo sapiens
  misc_feature: GYAE6OF01EBGMN.42.42.D09.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtncgacacggcccccgganaaggacttgagtggatgggactaatcaacctaatagtggtagacagactacgcacagaagtccgagggcagagtcgcatcggacccggacacgtccacgacgcacagtctacagtggagttgagcaggctgagatagtgacgacgacggccgttctttagtcgcgacgaggaaggaagggagtacgaagaacctccgtggtaccttaccctttgcctcggtacgggg

SEQ ID NO: 190873 - DNA, 539 bp, Homo sapiens
  misc_feature: GYAE6OF01BRYH5.42.42.D09.1.454.CMB.1.raw
  modified_base (235)..(235): a, c, t, g, unknown or other
  misc_feature (235)..(235): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagctggggcctcagtgaaggtttccngcaaggcatctggatacaccttcaccaggcaccatatgcactgggtgcgacgacggcccccggacgaaggaccttgaggtcggatgggactaagtcaaccctaatagtggtagacagactacgcacagaagttccgagggtcagagtcgccatcgacccgggacacgtccacgacgcacagtctacgatcggagttaggagcgaggctagacggatagtgaacgacacggtccgtgtttagtgcgacgagacgaggagtacgaagaaacgtcgtaggtccttccgtttcgacgttcgtacgggg

SEQ ID NO: 190874 - DNA, 600 bp, Homo sapiens
  misc_feature: GYAE6OF01DZTKJ.42.42.D09.1.454.CMB.1.raw
  modified_base (459)..(459): a, c, t, g, unknown or other
  misc_feature (459)..(459): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggcaccatatgcacgtgggtcgcgacacggcccccggacaaggacttggagtggagtgggactaatcaaccctaagtacgtaggtaggaacagaactacgacacgagtaacgttcagggacaggacgtcgcagtacggacccggacaccggtcaacgacgcaacagtacctacgacgtggagttcggagtacgngggactgacgtatagtacgtaacgacgtaaccggtccgtttactttagtcggcgacggtaaggacggtaagggacgttaacgaacggtaaaccttccggtacggttaccttacccgtttttagaccgtacggtaccggggg

SEQ ID NO: 190875 - DNA, 750 bp, Homo sapiens
  misc_feature: GYAE6OF01CB4FM.42.42.D09.1.454.CMB.1.raw
  modified_base (306)..(306): a, c, t, g, unknown or other
  misc_feature (306)..(306): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcagtgtaaggtttcctgcaaggcatctggatacaccttcaccaggcaccatatgcacgtgggtcgcgacgacgggcccccggaanaacggacttggagtgggagtaggggactaaataccaaaccctaagtacggtaggtaaggaacgaacgaactaacgacacgaaggtaaacgttcccgaagggccaaggacggtccgaccgtaacgtaccgggaacccgggaaccgtaacccggtacccgaacggaacggacctaaccgtacgttacccgtaaccgtaagtaccggggtaaggtttacggaacggccgtaacgggtacgttaggaacgttaagtaacgtacggaaacccggaaccgtaacccggggtcccgtttacgtttttaacgtcgggaccggtaccggaacgggtaaacgggtaaagggggaacgttaaaccgaaacggttaaacccgttaccccggtttacgggttaccccttttaccccgtttttacgggaacccggtttaccggttaaccccggggggg

SEQ ID NO: 190876 - DNA, 570 bp, Homo sapiens
  misc_feature: GYAE6OF01DMR18.42.42.D09.1.454.CMB.1.raw
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggccaccatatgcagttgggtgcgacaggcccccgganaaggacttgagtggatgggactancaacctaatgtgtagacagactacgacacaagaagttccgagggcaaggagtcgccagtcgacccgggacacgtccacgagcacagtctananggagttgagcagggtctagaggatagtcggacgacacgggtccgttattttacgtgccggtacgaaggtaaggaaggggagtaaccgaacggtaaacttcccgttaggttacccttacccgtttttggaaccgttccggttacccgggggg

SEQ ID NO: 190877 - DNA, 552 bp, Homo sapiens
  misc_feature: GYAE6OF01DTTDO.42.42.D09.1.454.CMB.1.raw
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggacttgagtggatgggactaatcaacctaatagtggtaggacagactacgcacagaagtccagggcagagtcgcagtcgacccgggacacgtccacgacgcacagtctacagtggagttgagcaggctgagagtatgacgacgacggtccgttctttagtggcgtgaacggaggaaaggggaggtaacgaacggtaaacttcccgttagggttacccttcccgttttacgaccgttacggtacgggggg

SEQ ID NO: 190878 - DNA, 510 bp, Homo sapiens
  misc_feature: GYAE6OF01A5PAM.42.42.D09.1.454.CMB.1.raw
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggcttgagtgggatgggactaatcaaccctaatagtggtaggacagactagcacagaagtccagggcagagtcgcatgacccgggacacgtccacgagcacagtctacatcggagttgagcaggctgagatagtgacgacacggccgtctttatcgcgcggagagaaggggatacagaaactccgtggtcttcctttgctagtcgggg

SEQ ID NO: 190879 - DNA, 598 bp, Homo sapiens
  misc_feature: GYAE6OF01EE62D.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatcgtggatacaccttcaccaggcaccatatgcacgtgggtcgcgacgacggcccccggacaacggtacttgacgtggagtgggactaataccaaccctaatagtggtagacagactagcacagaagttcgaggcaggagtcgcagtcgacccggacacgtccgacgacgacacgagtctacgatgggagttcggagacgacggcgtagaaggagtaagtacggaacgacgaccgggtcccgtttacgttttagttacggtcgtacggaagggtaaggaaggggtagtaaccgaagtaaaccgtaccgttacggttacccttcccgttttacgtaccgttacggtaccggggg

SEQ ID NO: 190880 - DNA, 615 bp, Homo sapiens
  misc_feature: GYAE6OF01AQD6T.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcacgtgggtgcgacacggccccggacaaggacttgagtggagtgggactaatcaaccctaataggtggtaggacagactacgcacagaacgttccgagggcagagtcgacctagtcggacccgggacaccggtccacgacgccaacgacgtcctacgagtcgggagttggagcgaggtcgtggaagtatagtgaaccgacgtaccgggtccgtttacttttagtcggccggacggaagggtaacgggaaaggggtacggtaaccgaacggtaaaacccgttcccgtacgggtttaccctttaccccgttttacggtaacccgttacgggtacccgggggg

SEQ ID NO: 190881 - DNA, 891 bp, Homo sapiens
  misc_feature: GYAE6OF01AVOFH.42.42.D09.1.454.CMB.1.raw
  modified_base (119)..(119): a, c, t, g, unknown or other
  misc_feature (119)..(119): n is a, c, g, or t
  modified_base (121)..(121): a, c, t, g, unknown or other
  misc_feature (121)..(121): n is a, c, g, or t
  modified_base (318)..(318): a, c, t, g, unknown or other
  misc_feature (318)..(318): n is a, c, g, or t
tcagtgacgtatgtcacgaccggtgctcgatttagacacatacgcagggaaagggggcatcatccaacaaccacatcccttctctacagaagcctctgagggaaggtaacttctacacngngacgtcgcgtgggtcggttcttgtcgtccttcggtcggtcgttaggtacgtcctaccggtagggtcgtcctacctacccctacccggtagggtcgaacctaacggttgggtcgacgtacgttcggggtcggggtgtaaggtaaggtaaggaaaggaccgtccggggtcgggtcctagtaggtaggttaccgtttcgngaacggacgctacgtcggtagaactacctacctaccacggacgaccaactatagtcgactacgggttgggtacgacgaaccggaccccggggacccccggtaaacggaacggttacgttaggtagggtacggtagggtacgggtaaacttaacgtaacccctaaaccgttaaggtacgggttacgggtaacggacgaacggtaaccgtacgactaaacgaaggttaaccgtacgggaggtacgaaggtcgtacccgacgtacgtacccggggaacccggacgtacccgtaccgaacgacgaccaaacgtccgtaacctacgtaagggtaggttacggtaggacgtacgggacggttcgtaagggaacgttaagtaacgtacggggaaccctaacccgggtacccggtttacccgtttttagttttacggtccgggacccggtaaaggggaacgggtaaacggggtaaggggtaaccctaaaacgggaaaccgttaaacccgttccgggtttacccggtttacccctttttaccgggtttaccggtaaacccggtttcggggggtaacccgggg

SEQ ID NO: 190882 - DNA, 584 bp, Homo sapiens
  misc_feature: GYAE6OF01C5MGL.42.42.D09.1.454.CMB.1.raw
  modified_base (320)..(320): a, c, t, g, unknown or other
  misc_feature (320)..(320): n is a, c, g, or t
  modified_base (483)..(483): a, c, t, g, unknown or other
  misc_feature (483)..(483): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggttctgcaggcgatctggatacaccttcaccacgcgaccaatatgcactgggtggcgacgacggccccggaccgaagactgacgtggagnggacgtaatacaaccctaactagtacggtaggaacgagaacgtacgacgacaacgaagtacgacgggaccgagacggtcgaccgatacggacccgggaaccgacgtcccgacgagacgacaagtctacactggagttgacggcaggcgtgagactatgacganaccggccgttctttagttgccgcggaaggtaggaaaggggtagtaacgaacgtaaacctccgttaggtccttacccgttttcgacggtacgttaccggggg

SEQ ID NO: 190883 - DNA, 595 bp, Homo sapiens
  misc_feature: GYAE6OF01BRNE3.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctgatacaccttcaccaggcaccatatgcacgtgggtgcgacacggcccccggacaaggacttgagtggatgggactaatcaaccctaatagtggtaggacagactacgcacagaagtccgagggcagagtcgccagtcgacccgggacacgtccaacggagccaacacgtactacgagtcggagttgagcgagggctaggagtatagtggaacgacgaccgggttccgttacgtttttattcggccgacgggtaagaagggaaggggaagtaacgaaacggaaaacccttcccggttacgggttaccctttaccccgtttttaggtaaccgttaaccggtaccgggggg

SEQ ID NO: 190884 - DNA, 558 bp, Homo sapiens
  misc_feature: GYAE6OF01B3LDN.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttcctgcaaggcatctggatacaccttcaccaggcaccatatgcactgggtgcgacgacggcccccggacaaggacttggaggtggagtcgggactaatcaaaccctaataggtggtaggacagacctacgcacagaagttccagggcagagtcgaccagtcggaccccgggacaccgtccgaacgacgcaacagtctacagtggagttgagcgaggctgagatatgaccgacaccggtccgtcttttagtcgcgtacggaggaaggtagggatacgaacgaacgttccgtaggttcccttaccgtttgacgttcggtacggggg

SEQ ID NO: 190885 - DNA, 516 bp, Homo sapiens
  misc_feature: GYAE6OF01BB2UV.42.42.D09.1.454.CMB.1.raw
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (466)..(466): a, c, t, g, unknown or other
  misc_feature (466)..(466): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtncgacacggccccgganaaggacttgagtggatgggactatcaacctatagtgtaggacagactacgcacagaagttcagggcagagtacgccatcggacccggacacgtccacgagcacagtctacagtggagttgagcaggctaggacgatagtgacgacacgggccgtctttagtcgcgngagagaagggatacgagaaactcgtcgtacttcctttagctcgtacgggg

SEQ ID NO: 190886 - DNA, 541 bp, Homo sapiens
  misc_feature: GYAE6OF01B2I05.42.42.D09.1.454.CMB.1.raw
  modified_base (391)..(391): a, c, t, g, unknown or other
  misc_feature (391)..(391): n is a, c, g, or t
  modified_base (459)..(459): a, c, t, g, unknown or other
  misc_feature (459)..(459): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggcaccatatgcactgggtgcgacacggcccccggacaacggacttgagtggatgggactaatcaacctaatagtggtagacagactacgcacagaagtccagggcagagtcgcatcgacccgganaccgtccacgagcacagtctacagtggagttgagcaggctgagatagtgaaccgacgacggtccgttntttagtgcgacgaggaggaagggagtacgaagtaaacctcgtcggttacccttaccgttttcgaccgttacggtaccggggg

SEQ ID NO: 190887 - DNA, 707 bp, Homo sapiens
  misc_feature: GYAE6OF01CZ0GU.42.42.D09.1.454.CMB.1.raw
  modified_base (310)..(310): a, c, t, g, unknown or other
  misc_feature (310)..(310): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtgggcctcagtgaaggtttcctgacaaggcatctaggataccaccttcaccaggcaccatatcgcacgtgggtcgaccgacgaccggcccccgganaacggtacgttaggagttggagtacgggaacttaacgtaccaaacccgtaagtaacggtggtaaggacgagaaccgtacgacaacgagaacgttaccgacgggacaggtacgtccgaccacgtcggacccggtaccgaccgtacccgaacggacgacaacgtacgtacctaagacgtagggagttacggacgtaggacgggtacgaggtaacggtagtaacggtacgaaccggtaaccgaacccgggttcccgtttacgtttttaagtccggtccggtaacgggtaaggtaacggggtaaaggggtaacgtaacggtaaacggtaaacccgttccggttacccgggttacccgttttaccccgtttacgggttaaccgtacccgggttaccgggggg

SEQ ID NO: 190888 - DNA, 554 bp, Homo sapiens
  misc_feature: GYAE6OF01BXFXH.42.42.D09.1.454.CMB.1.raw
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
tcagtgacgtatgtcacgaccggtgctcgatttagacacatacgcagggaaaggggtcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaggtttcctgcaaggcatctggatacaccttcaccaggcaccatatgcactgggtgcgacgacggcccccgganaaggcttggagtggatgggactaatcaaccctaatagtggtagacagactacgcacagagttcagggcagngtcgccatcgacccggacacgtccacgacgcacagtctacagtggagttgagcgagctgagagtagtagacgacgaccggtccgttcgttttagtggccgacgaggaggaaggggacgtacgaacgaaaccgttcccgttacggttaccctttcccgttttagaccgttacggtaccgggggg

SEQ ID NO: 190889 - DNA, 569 bp, Homo sapiens
  misc_feature: GYAE6OF01DTPM3.42.42.D09.1.454.CMB.1.raw
  modified_base (438)..(438): a, c, t, g, unknown or other
  misc_feature (438)..(438): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgtaaggtttcctgcaaggcatctggatacaccttcaccaggcaccatatgcactgggtgcgacgacggcccccggacaaggaccttggagtggatgggactaatcaacctaatacgtggtaaggacagactacgcacagaagtccagggcagagtcgccatcgaccggacacgtccacgagcacgagtctacagtcggagttgagcgaggcngagatagtgacgacgaccggtccttacgttttatggtcgtaggaacggaggtaaaggggaactacgaaacggtaaaccgttaccgttcgggttaccttaccccgttttggacccgttacggtacccggggg

SEQ ID NO: 190890 - DNA, 576 bp, Homo sapiens
  misc_feature: GYAE6OF01D3C41.42.42.D09.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctnagtgaaggtttccngcaaggcatctggatacaccttcaccaggcaccatatgcacgtgggtgccgacgacggcccccggaacaaggacttggagtggagtgggaactaatacaaccctaatagtggtaaggacagactacgcacagaagtccaggcagagtcgcagtacggacccggacaccgtcacgagcacgacgtctacagtggagttgagcaggctagaagatagtacgaacgacaccggtccgttactttagtcggaccgacggaagaacgggaagggtacgtacgaacggtaaacttccgttacggttaccctttaccccgttttagaccgttacggtaccggggg

SEQ ID NO: 190891 - DNA, 538 bp, Homo sapiens
  misc_feature: GYAE6OF01BEPVO.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacgacggcccccggacaaggacttgagtggatgggactaatcaaccctaatagtaggtagacagactacgacacagaagtccgagggcaggagtcgcatcggacccgggacacgtccacgacgcacagtctaacgatggagttgagcaggctgagatagtgacgacacggtccttctttagtcgcgcggagtaggaagggagtacgaacgaaacttccgtggttcctacccgttttgaccgtacggtcgggg

SEQ ID NO: 190892 - DNA, 581 bp, Homo sapiens
  misc_feature: GYAE6OF01DSGWD.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaaggtttcctgcaaggcatctggatacaccttcaccacggcaccatatgcactgggtcgcgacgacggccccggacgaacggtctaggacgtaggagtagggtactaataccaaaccctaagtagtcggtaaggacaacgactacgacaacgagaacgttccagggcagagtcgacagtcgaccggacacgtccacgacgcacagtcactagtgtagttgacgacacggtctagaagtatacgtagaaccgacgtacgtccgttacttttagtcgacgtacggaggaggtaagggagtacgaacgaaacgttccgtacggttcctacccgttttacgtacgttacggtaccgggg

SEQ ID NO: 190893 - DNA, 561 bp, Homo sapiens
  misc_feature: GYAE6OF01EB9RA.42.42.D09.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctnagtgaacggtttcctgcaaggcatcgtggatacaccttcaccaggccaccatatgcactgggtgcgacgacggcccccgganaaggactgagtggatgggactaatcaacctaatagtggtaggacagactacgcacagaacgtcgaggcagagtcncatcgacccggancgtcacgncacngtcacngtggagttgagcgaggctagagaatagtgacgacgacggtccgtttatttagtggaccggcgaaggaaggaaaggggtcgtaaacgaaacggtaaacccttcggttcggtacctttacccgttttagaacgttcgggtaacccggggg

SEQ ID NO: 190894 - DNA, 623 bp, Homo sapiens
  misc_feature: GYAE6OF01CE407.42.42.D09.1.454.CMB.1.raw
  modified_base (251)..(251): a, c, t, g, unknown or other
  misc_feature (251)..(251): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcagtgaaggtttcctgcgaaggcatcnggatacaccttcaccaggcaccatatgcacgtgggtgccgacgacgggcccccgagaacggacttgagtcggagtacgggaactaataccaaccctaagtagtggtagacagactacgcaacagaagtccgagggcagagtcgaccagtcggacccgggacaccgtaccacgacgacacgagtcctaacgtagtggtagttcgacgcgaggtctagagtataagtcgaacgaccgtaccggtccgtttacgttttacgtcggacgtaggaacggacgggaaagggtaacggttaaccgaaacgttaaacccgttcccggttacggttaccccgtttacccgttttaacggtaccgttaccgggtaccggggg

SEQ ID NO: 190895 - DNA, 721 bp, Homo sapiens
  misc_feature: GYAE6OF01EMA06.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagaagccgtggggcctcagtgaaggtttcctgcaaggcatctggatacaccgttcaccaggcaccatatgcactgggtgacgacgacgggacccccggacaaggaccttggacgtggatggggaactaataccaaaccctaagttacggtaggttaggaacaggaacgtaccgacaacaacggaaaggtttcccgaaggggtaccaaggaacggtaccggtaccgtaacgttaccgggaacccccggggtaactaaccgggtaccccaaacggaacgacccaacgaacggttaccttaaccagttaggggacgtttaggaagtaccgagggtccgtaagaaggtactaagtacgtaaccggacgtaccgggtaccgtttacgttttaagttccgggtacggaccggaaggaaagggtaaacgggtaaaggttaaaaacggaaacccggtttacccttagggtttccccttaccccgtttttaggaaccgttaccgggtggggtaaacccccgggg

SEQ ID NO: 190896 - DNA, 696 bp, Homo sapiens
  misc_feature: GYAE6OF01CEMNG.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctagaaggtagaagacgccgtgggcctcgaggtgtaacggtttcctgacgaaggcatcgtagatacctaccttccaccaggccaccatatgcacgtggtgcgacgaccggccccgagaacggctaggaggtggagtaggaactaactaccgaaacccgttaataggtaggtaacggaacgacgacgtaacgactaacgaaggtaacgttaccgagggacaaggacgtaccgacgagtccggaacccggacgaaccgtaccgaacgagaccaacgcgtacgtacgtaggtggtacgttgacgtacgacggtctaggaagtaactaaacgtaaccggaaccgtaccggttaccgttttacgtttaagtcgggtaccgacgggtaaaggaacggggtaaacgggtaacgtaccggaaacgttaaacccgttcccggttacggtttacccgtttaccccgttttaggtaacccggtttacgggtcgggggtaaaccccggg

SEQ ID NO: 190897 - DNA, 579 bp, Homo sapiens
  misc_feature: GYAE6OF01AV1B0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcacgtgggtcgcgacgacggcccccggacaaggaccttgaggtggagtcgggaactaatcaaccctaataggtaggtagacagactacgacacagaacgttccgaggcagagtcgaccagtcggacccggacacgtccacgacgacacgagtctaacagtggagttgagtacagggctgaagagtagtaggacgtacgaccggtaccgttgtttacgtcgtcggacgagtacgggaagggacgtaacgaacgtaacgttcccgtacgggttaccttacccgttttagaccgttcggtacggggg

SEQ ID NO: 190898 - DNA, 649 bp, Homo sapiens
  misc_feature: GYAE6OF01CP2KO.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagagccgtggggcctcgagtgaaggtttcctgcaaggcatctggataccaccttccaccaggccaccatatgcacgtgggtcgccggaccgacggccccccggaacgaacgggaccttggaggtgggtaagtcggggaactaataccgaaacccgttaagtaggtggtaaggacagactacgacacgagtaacgtccgagggcaggacgtcgccagtcggacccgggacaccgtcccgaacggacgccacgacgtctacgagtggagttgacgcgaggctagagatagtagacgtaccgtacggtcctttacgttttagtcgccggtacgaagggaacgggtaaaggggtaacgtaacggtaaaccggtaaacccgtttcccggttaccgggtttaccctttaccccggtttttacgaacccgtttaccgggtacccgggggg

SEQ ID NO: 190899 - DNA, 755 bp, Homo sapiens
  misc_feature: GYAE6OF01AEFQ7.42.42.D09.1.454.CMB.1.raw
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactccagtgcaactggtgcagtcgtggggctgaagtgaagaagccgtggggcctcgagtgaaggtttcctgcaagggcatctaggataccaccgttacaccgaggccaccatagtgaccagttggcggccgaccgacggcccccggaacgaacggaccgtttaggacggtggacgtgggaactaacgtaccgaaacccttaagtaggtacgggtaagaaccgaggaacccttacgggaccacgtaacggaacggtttccgaaggggcaagacggttaccgaccgtacggtaacgggacccgggtacgaccggtaccgacgacgtaccaacgtcgtaaccgtacgtaaggtgggtacgttacggaacgccggaagggtacttacgggaaggttaaggtaacggtaccggtaaccggtaaccggtaacccggggttcccgtttaacgttttacggtaccgggtccggtaacgggtaacgggaaacggggtaagggtaacggtttaaaccggaaggttaaaaccccgttccgttaaccgggttccctttacccggttttaaccggtaccggttcgggtaccccgggggg

SEQ ID NO: 190900 - DNA, 509 bp, Homo sapiens
  misc_feature: GYAE6OF01DXE63.42.42.D09.1.454.CMB.1.raw
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttccngcaaggcatctggatacaccttcaccaggcaccatangcactgggtgcgacacggcccccggacaaggacttgagtggatgggactatcaacctaatagtggtagacagactacgcacagaagtccagggcagagtcgcagtcgacccgggacacgtccacgacgacacagtctacgatgggattgagcgaggctagagatagngacgacacggcctntttatgcngagagagggatacagtaactcgtgtccttcctttgctcgtacgggg

SEQ ID NO: 190901 - DNA, 557 bp, Homo sapiens
  misc_feature: GYAE6OF01BFRL6.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacgacggccccggacaaggacttgagtggatgggactaatacaaccctaatagtggtaggacagactacgcacagaacgttccgagggcagacgtcgaccagtcggacccggacacgtccacggagcacagtctacagtggagttgagtcagggctaggagatagtcggaacgtacgacggtccgtttacgtttatggcgacgaggaaggtaagggagtacgaagtaaaccgtccgttaggtccttaccttttgaccgttaggtaccgggg

SEQ ID NO: 190902 - DNA, 712 bp, Homo sapiens
  misc_feature: GYAE6OF01CO4S0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggcaccatatgcacgtgggtgcgaccgacggcccccggtacgaaggacgtttaggagtgggaatgggactaacgtacaaaccctaagtacggtaggtacggaacaagacgtaacgacaacagtaacgttacccgagggacaaggacgtccgccaacgtcggacccgggacaaccggtcccaacggacgacaacacgtacctaacagtacgggagtttagaacggacgagggacgttagaacggtagtaacgtaggaaccggtaaccggtaaccggggtacccgtttacgttttttaagttacgggtaccggaccggtaaagggtacgggtaaagggggtaaacggttaaaccgtaaacggtaaaaacccgtttcccggttaacggggtttacccctttaccccggttttttacgtaaacccggtttacccgggtttaacccgggggg

SEQ ID NO: 190903 - DNA, 592 bp, Homo sapiens
  misc_feature: GYAE6OF01DVQAQ.42.42.D09.1.454.CMB.1.raw
  modified_base (238)..(238): a, c, t, g, unknown or other
  misc_feature (238)..(238): n is a, c, g, or t
  modified_base (494)..(494): a, c, t, g, unknown or other
  misc_feature (494)..(494): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgccgtcgtgggctgaagtgaagaagccgtggggcctcagtgaaggtttccngcaaggcatctggatacaccttcaccaggcaccatatgcacgtgggtgcgacgacggcccccggacgaacggacgttggacggtggagtagggaactaagtaccaaccctaagtaggtaggtagacagactacgcacgaagaacgttccgaggcagacgtcgaccagtcgacccggacaccgtccgaacgacgacacgagtctacagtggtagtgagcgagtcgtagagatagtacgacgacgaccggtccgtttntttacgtggcgcggaaggaggaaagggataacgacgtaaaccgttccgtacggtttcccttacccgttttaggtaccgttcggtcggggtaaccccgg

SEQ ID NO: 190904 - DNA, 656 bp, Homo sapiens
  misc_feature: GYAE6OF01B1PNZ.42.42.D09.1.454.CMB.1.raw
  modified_base (336)..(336): a, c, t, g, unknown or other
  misc_feature (336)..(336): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcgagtgaaggtttcctgcaaggcatctggatacaccttcaccaggccaccatatgcacgtgggtgcgacgacgggcccccggaagaacggacttgaggtggagtgggaactaanccaaccctaagtaggtggtagacacgactacgcaacagtaacgtccgagggcagcgtcgaccagtcggacccgggacacccgtaccaacggacgaccacgtagtcctaacgtacgtagggtacgttcggaacgtacgagggcgtaggaaggtacttaacgtaggaacccggtacggacccgggttcccgtttacgtttttacgtcggtaccggtacggaacgggtaaagggaaaggggtaacgtaacgaaacggtaaacccttccggttaccggttaccccgtttacccgttttacgtaaccgtccgggtaacccggggg

SEQ ID NO: 190905 - DNA, 675 bp, Homo sapiens
  misc_feature: GYAE6OF01BNZK0.42.42.D09.1.454.CMB.1.raw
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtcgctcactcccaggtgcaactggtgcagtcgtggggctgaagtgaagagccgtgggctnagtgagtttccngcaaggcatcgtgatacnccttcaccaggcaccatatgacacgtgggtcgcgacgaccggacccccggtacaacggtacgttgaggtaggagtgggaacttaagtccaaacccgtaagtacggtacggtaggactaaggaacgtacgacgtaacgacgtaacggttacccgagggacaaggtacggtacccgaccgtaacgtaccgggaacccgggaaccgtaccggtacccgaacggaacgccgaacgtacgtacctaacgtagtacggtagttacggacgtcgaaggtccgtaagtacgaagttcgacggacgtaccgacggtcccggtttacttttacgtggccggtacggtaaggaaggtaaagggacgtaacgaaaggtaacccttcgtaccggtttccgttacccgtttacggtccgttaacgggtacccgggg

SEQ ID NO: 190906 - DNA, 697 bp, Homo sapiens
  misc_feature: GYAE6OF01D8L3V.42.42.D09.1.454.CMB.1.raw
  modified_base (188)..(188): a, c, t, g, unknown or other
  misc_feature (188)..(188): n is a, c, g, or t
  modified_base (318)..(318): a, c, t, g, unknown or other
  misc_feature (318)..(318): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtncagtcgtggggctgaagtgaagaacgccgtggggcctcgagtgtaacggtttcctgcgaaggcagtctggactaccaccttcaccgaggcaccgatatcgacacgtgggtcgcgacgaccggccccgganaaggtacttgacgtggagtaggactaactacaaccgtaagtaggtaggtaagacagactacgaccgaacgagtaacgttccgagggtacaggtacgtccgacgagtccggaacccgggaccacggtacccgaacggacgaccgtacgaaccgtacctactaaggtgggtagttagacggacgaggtcgttaggaagtagtaacgtcggaaccggtaccgtacgggtcccgtttacgtttgtaccggacggtacgggaaaggtacgggtaaacggggtaacgttacccgaaagggtaaaccccgtttaccggtttaccgggttacccctttttaccccggtttaacggttacccggttaacccggggttaacccgggggg

SEQ ID NO: 190907 - DNA, 509 bp, Homo sapiens
  misc_feature: GYAE6OF01AT037.42.42.D09.1.454.CMB.1.raw
  modified_base (471)..(471): a, c, t, g, unknown or other
  misc_feature (471)..(471): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggcttgagtggatgggactaatcaaccctaatagtgttaggacagactacgcacagaagtccagggcagagtcgcatcgacccgggacacgtccacgagcacagtctacatggagttgagcaggctgagatatgacgacacggtcctcgtttatgcgcgagaggaaggngtacagaactcgtggtctcccgtttgacgtcgtcgggg

SEQ ID NO: 190908 - DNA, 791 bp, Homo sapiens
  misc_feature: GYAE6OF01DW3YE.42.42.D09.1.454.CMB.1.raw
  modified_base (199)..(199): a, c, t, g, unknown or other
  misc_feature (199)..(199): n is a, c, g, or t
tcagtgacgtatgtcacgaccggtgctcgatttagacacatacgcagggaaggggcatcatccaacaaccacatcccttctctacagaagcctctgagaggaagttctacaccatggactggacctggtgggtcttcgtgtcttccgtggctagtacgcctccgaggtcgcctcacctccgaggtcgctaacgtggtcnccgtaggttcggtcggggtactagggaaagtacggaaacggacgtcccgggtacggggtcccttacggtaaggttacggttaaccgggtttccaggaaccggtaggacctattacggtacgtaacttaccctaccgttaccgaccgtaggaccctaacctaagtacgtcgaccgtacgttggggaccgtaccgacggacccggtaccccgaagtaacggtcgtaggtacgtacggtagtacggtaaaccttacgaacccgtaaaccgttaggtacggtacggtaacgacgtacgtacgtaccgcgaaacgttacggaacgttcgaggtactacggtacgaccgacgtacgtacccggaccgacgtaccgtaccgagactccgtaagtacgtacgtacgacggtacggtagtacgacgtacgaggtcgtaagtagtacgtacggtacgtacgacgttacccggtcgttttaacgtgggtaccgacggtaacggagggtaaacggtaacggtaacgtaacccggaacgtttaacccggttcgtaccggttttacccgttaacgtttacgggaccgtttcggggaaaccccgggg

SEQ ID NO: 190909 - DNA, 576 bp, Homo sapiens
  misc_feature: GYAE6OF01CNW7I.42.42.D09.1.454.CMB.1.raw
  modified_base (303)..(303): a, c, t, g, unknown or other
  misc_feature (303)..(303): n is a, c, g, or t
  modified_base (384)..(384): a, c, t, g, unknown or other
  misc_feature (384)..(384): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacgaccttcaccaggcaccatatgcactgggtgcgacgacggcccccgganaacggactttggagtcggatcgggaactagtcaaccctatacggtggtaggacagactacgcacagaagttccagggcagngtcacagtcgacccggacacgtccagtacgcacgagtcctaacgatcgggagttcgagcgaggtcctaggagtactagtgaacgccgtacggtccgttacgttttatcgacggtgaaggaggaaagggtcgtaacgaacggtaaacctccggttacggtacccttccgtttaggccgttaccgttacggggg

SEQ ID NO: 190910 - DNA, 810 bp, Homo sapiens
  misc_feature: GYAE6OF01BJ7Q9.42.42.D09.1.454.CMB.1.raw
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcagtgaaggtttccngcaaggcatcgnggatactaccttcaccaggcaccatangcacgtgggtcgacggacgaccgggacccccggacgaaacgggtaccttaggacggtaggacgtacggggtaaacttaacgtaccaaaacccgttaagtaaggttagggtaacggtaaccgaacggtaacctaacggacctaacgaacggtaacggtttaccgaaacggggtacaaaccgggtacgttacccggaacccgtaagttacccggggaaaccccgggtaaccgtaacccgggttaacccgaaacggaacgacccgtaaaccgtacgttaccgtaaccgtaggttacgggtaaggttacgacggtacggtaacgggtacggttaaggaacggttaagtacgggtaacgacccggtaaccggtacccggggttaccgtttttacgtttacggtcggtaccggtaaacggtagggaaacgggtaaaggggaaccggttaaaccgaaaccggttaaacccgttccgggttaaccgggtttaccctttacccggtttttacgaaacccgggttccgggttaacccggggg

SEQ ID NO: 190911 - DNA, 545 bp, Homo sapiens
  misc_feature: GYAE6OF01CHE3Q.42.42.D09.1.454.CMB.1.raw
  modified_base (490)..(490): a, c, t, g, unknown or other
  misc_feature (490)..(490): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcagtgaaggtttcctgcaaggcatcgtggatacaccttcaccaggcaccatatgcacctagggtcgcgacgacggcccccggacgaacggacttcggagtggagtgggaactaataccaacccttaagtagttacggtaggacacgactacgcacgagaacgttccgagggcagagtcgcagtcgaccgggacacgtccacgacgcacagtctacgatcggagttgagcaggctgagtatagtgaacgacgacggtctactttgtcgngtacgaggagagggactacgacgaactcgtagtcttcctttagcgtcgtacgggg

SEQ ID NO: 190912 - DNA, 549 bp, Homo sapiens
  misc_feature: GYAE6OF01EMSEH.42.42.D09.1.454.CMB.1.raw
  modified_base (307)..(307): a, c, t, g, unknown or other
  misc_feature (307)..(307): n is a, c, g, or t
  modified_base (477)..(477): a, c, t, g, unknown or other
  misc_feature (477)..(477): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgaaggtttcctgcaaggcatcgtggatacaccttcaccaggcaccatatgcacgtgggtgcgacgacggcccccgganaaggacttgaggtggatgggactaatcaacctaatagtggtaggacagactacgaacagaagtcagggcagagtcgcagtcgacccgggacacgtccacgacgcacagtctacagtggagttgagcaggctgaagatagtgacgacacggtccttacttttatcggacgngaagaggaagggtatacgaagaaccttccgtcggttaccttcccttttaggaccttcggtggggtaacccgg

SEQ ID NO: 190913 - DNA, 865 bp, Homo sapiens
  misc_feature: GYAE6OF01D3L1D.42.42.D09.1.454.CMB.1.raw
  modified_base (187)..(187): a, c, t, g, unknown or other
  misc_feature (187)..(187): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccaggtgcaactggtncagtcgtgggctgaagtgaagagccgtggggcctcgaggttgtaaggtttcctggacgaaggctaagtcgtaggtaactaccgtacccttccaccgaggccaaccgatatcgactacgttggggtcgacggaccgaccgggacccccggaagaacgggtaccttggaggtggacgtagggtaactaactaccgtaaaccctaagtacggtaggtaacggaacgaacgtaacgtaaccgcaaacgaagtaaccgttaccgacgggtacgaaggacgtaccggaccgaacggttaccgggaaccccgggaacgtaacccggtacccgtaacggaacggtaccgaaccgtaccgttaccgtaacggtaacggttacgggtaacggtttacggaaccggtacggtaaccgggtacgttaaccgggaagtaacgttaacggttaaccgggaaacccgttaacccggtaacccggggtttaccccgttttaaccggttttacgtacccgggtacccggtaacgggttaaacggggaaaccgggttaaacggggggttaacccttaaaccgggtaaaaccgggttaaaacccccgtttacccgggtttaccgggttttacccccgttttaaccccgtttttaccggggttaaaccccggttaccggggttaaacccccggggggg

SEQ ID NO: 190914 - DNA, 596 bp, Homo sapiens
  misc_feature: GYAE6OF01B9R8X.42.42.D09.1.454.CMB.1.raw
  modified_base (238)..(238): a, c, t, g, unknown or other
  misc_feature (238)..(238): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttccngcaaggcatctggatacaccttcaccaggcaccatatgcacgtgggtgcgacgacggcccccggacaaggactcgagtggatgggactaatcaacctatagtggtagacagactacgacacgagaagttccgaggcagacgtcgccagtcgacccgggacacggtaccacgacgacacgagtcctaacagtacgggtagttgacgcgaaggctggaacgtagtacgtaggaacgaccgtaacgggtccgttaccttttagtcggtacgtcggaaggacgggtaaagggaggtaaccgtaaggaaaccttccgtcggttaccctttcccgttttacggaccgttacggtacccgggggg

SEQ ID NO: 190915 - DNA, 494 bp, Homo sapiens
  misc_feature: GYAE6OF01EE8C7.42.42.D09.1.454.CMB.1.raw
  modified_base (237)..(237): a, c, t, g, unknown or other
  misc_feature (237)..(237): n is a, c, g, or t
  modified_base (412)..(412): a, c, t, g, unknown or other
  misc_feature (412)..(412): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (474)..(478): a, c, t, g, unknown or other
  misc_feature (474)..(478): n is a, c, g, or t
  modified_base (480)..(494): a, c, t, g, unknown or other
  misc_feature (480)..(494): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttccngcaaggcatctggatacaccttcaccaggcaccatatgcactgggtgcgaccgacgggcccccggacgaaggacttggagtggatgggaactaatacaaccctaatagtggtagacagactacgcaacagaacgtccagggcagagtcgcagcgacccgggacacgtaccacgancacagtctacgatcgggagtcgaggcgggcgtcggacgaacggacggcgacgtagngagngnnnnngnnnnnnnnnnnnnnn

SEQ ID NO: 190916 - DNA, 638 bp, Homo sapiens
  misc_feature: GYAE6OF01C0F42.42.42.D09.1.454.CMB.1.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (405)..(405): a, c, t, g, unknown or other
  misc_feature (405)..(405): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcactcccaggtgcaacgtggtgcagtcgtggggctgagtgaagagcgtgggctgagtgtagttcngcaagcatcnggataccacttcaccagcaccatactgcacgtgggtcgcgacgaccggccccgaagaggtactggacggtggagtacgggactaactacctaaaccgtagtaggtaggtaagacacgactaccgacaacgaagtaacggtacgaggacgagtacgtcgaccngtaccggaaccgggacaccgtacccgaacgacgacaacgtacgtactaacgacgttacggagtacgcggacgacgngtagagatagngaacccgagtacccggtcgttttacgttaggtcgaccggtacggtaaggtaacggaagggtaactaacggtaaacgtaacccgttaccggttccgggtttaccctttacccggtttactaacccgggtcggttaaaccccgggggg

SEQ ID NO: 190917 - DNA, 820 bp, Homo sapiens
  misc_feature: GYAE6OF01CX3CH.42.42.D09.1.454.CMB.1.raw
  modified_base (241)..(241): a, c, t, g, unknown or other
  misc_feature (241)..(241): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagacgccgtggggcctcgagtgaacggtttccngacgaaggcatcgtggactaccgtaccttcaccgaggaccacctatactgactacgtggggtcgaccggacgaccgggacccccggaagaacggtaccgttaggacggtaggacggttacgggtaactaacgtaaccctaaaccgttaagttaacgggtacggtaacggaacaaggtaaccgtaacgtaccgaacgaaggtaaaccggttaccggacgggtacgaggacgtaccgaccgacgtaccggaaccgggacgacgtaccgacgacgacgacgtacgtacgtacgtagtacccccggtaggttacgacggacggacggtacgtaacggtaaggtaacgttaacggtaacggtaaccggtaacccggtaacccgggttacccggttttaccgttttaacggtttaccggttaccgggtaaccgggtaaggggtaaaccggggtaaaggggttaaacgggttaaaccgggtaaacccggttaaaacccggtttacccggtttacccgggttttaccccgttttacccggttttaacccggttaacccgggttaacccggggttaaaccccgggggg

SEQ ID NO: 190918 - DNA, 530 bp, Homo sapiens
  misc_feature: GYAE6OF01B1P1W.42.42.D09.1.454.CMB.1.raw
  modified_base (409)..(409): a, c, t, g, unknown or other
  misc_feature (409)..(409): n is a, c, g, or t
  modified_base (487)..(487): a, c, t, g, unknown or other
  misc_feature (487)..(487): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatagcactgggtgcgacacggcccccggacaacggacttgagtggatggggactaatcaaccctaatagtggtaggacagactacgcacagaatcagggcagagtcgaccatcgacccggacacgtcccagagcacngtctacgatggagttgagcaggcgtgaagactataggacgacacggtccttactttagtcgcgacgagaggaaagggngtaacgagaaacctaccgtgtcctacctttgacctagtcgggg

SEQ ID NO: 190919 - DNA, 977 bp, Homo sapiens
  misc_feature: GYAE6OF01EI1ZC.42.42.D09.1.454.CMB.1.raw
  modified_base (249)..(249): a, c, t, g, unknown or other
  misc_feature (249)..(249): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccgaggtgcgacgtggtgcagtcgtggggctaggaagtagaagaacgccgtggggcctacgagtagtaaggtttccngacgaaggctagtcgtaggtactaccgtaccttaccacccgaacggacctaaccctaagttacgttacggaccgtacggttcgggggtcggacccggaaccggaccccggggaccccccgggtaaacggaaacgggttaccgtttacgggtacgggtagggtaacgttacgggggtaaacctttaaaaccgtaaccccgtaaaaccccgttaaaggttaacgggttaacgggttaacgggaaccgaaacgggtaaccccgtaaaccgggacccaaaccggtaaacgggtaaaccggtttacccggaaacgggggtaccgtaaagggtaaccggtacccggtaaccccgtaacggtaaccccgggggaacccccgggggtaaacccgaaccccgggttaacccccgaacgggaaacccggaacccgaaccggtaaccgttaaccgtaaaccggtaccggttaaggggttacggtttaccgggaacggtacccggtaacgggtccggtaaggaaggtaacgtacggtaacgggaacccggtaaccggtacccgggttaccggttttaccgttttaacgggtcggtacccgggtaacggtaaaggggtaacggggtaaaggggttaaccggtaaccggtaaaaccggttaaacccggtcccggttttaaccgggttccccttttaaccccggtttttacgggtaacccggtttaccggggtacccgggggg

SEQ ID NO: 190920 - DNA, 565 bp, Homo sapiens
  misc_feature: GYAE6OF01BT573.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcacgtgggtgcgacgacggcccccggacaaggacttgacgtggagtgggactaatccaacctaatagtggtaggacagactacgcacagagttccagggcagagtcgcagtcggacccggacacgccacgagcacacgtctacagtggagttgacgacagggctaggagtagtagtaggacgacgaccgggtccgttacttttagtcgacggacgaaggtaggaagggacgtacgaagtaaaccgttccgtacggttacctttacccgtttacgaccgttcggtacgggg

SEQ ID NO: 190921 - DNA, 587 bp, Homo sapiens
  misc_feature: GYAE6OF01CX59Z.42.42.D09.1.454.CMB.1.raw
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccaggtgcaactggtgcagtcgtggggctgaagtgaagaagccgtggggcctcagtgaaggtttcctgcaaggcatctggatacaccttcaccaggcaccatatgcacgtgggtgcgaccgacggcccccgganaacggacttgagtggatgggactaagtaccaaaccctaataggtggtaggacaagactacgacanagaagttccagggcagagtcgacacgtcgacccgggacacgtccgagacgacacgagtctaacagtggacgttgacgtgagtctggaagtatagtacggacgacgtaccggtccgttactttacgttcgccgtacggagaagggtaacgggagtaacaaggtaaaccttaccggttacggtacctttcccgttaggtaccctgggttaacccggggg

SEQ ID NO: 190922 - DNA, 587 bp, Homo sapiens
  misc_feature: GYAE6OF01C45Q0.42.42.D09.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttccngcaaggcatcnggatacaccttcaccaggcaccatatgcactgggtgcgacacggcccccgganaaggacttgagtggatgggactaatcaaccctaatagtggtaggacagactacgcacagacgtcagggcagngcgccatcggacccgggacacgtccacgacgcaacngtactacagtggacgttgacgcaggctagagatagtgaccgacgaccggtccgttacttttaacgttggaccggtacgaaggtaaggaaagggtacggtaaaccgaacggtaaaccgttcccgttacgggttacccgtttaccccgtttttaggacccgttaccggtaacccgggggg

SEQ ID NO: 190923 - DNA, 778 bp, Homo sapiens
  misc_feature: GYAE6OF01DCR80.42.42.D09.1.454.CMB.1.raw
  modified_base (252)..(252): a, c, t, g, unknown or other
  misc_feature (252)..(252): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgactcgtcggtgggctaggaagtaggaagacgtccggtcgggtcctacgaggtaggttacgttcngacgagctatcgagtaactacctacctaccgacgacgaccacctatatcgactacggtggtcgaccgaccgaccccgggtaccccgaaggtaacggtcgtaggaggtacggaggtacggaaactacctaacccgtaaaccgtaagtacggtacgggtaacgaacgtaacgtaccgtaccgaacgaacgtaaggtaacccgtacgggagggtacgaacggtacggtacccgacgtaacggaccccggggaacccgggaccgtacccggaacccgaggaccgaaccgaacgtacgttaaccaacgttacgggttagggtacggttaggaccgacggtacggtcgaacggtagtaacgttagtaccgggaaccggtacccggtacggtttaccgttttagtttaacggtccggacggttacggaaagggtaaacggggaagggttactaaaccggtaaacgttacccgttccggtttaccgtttacccctttacggtttaaccgacgggtttaccggggaaccccgggg

SEQ ID NO: 190924 - DNA, 641 bp, Homo sapiens
  misc_feature: GYAE6OF01CZZZR.42.42.D09.1.454.CMB.1.raw
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (493)..(493): a, c, t, g, unknown or other
  misc_feature (493)..(493): n is a, c, g, or t
tcagtgacgtatgtcacgaccggtgctcgatttagacacatacgcgagggaaagggggcatcatccaacaaccacatcccttctctacagaagcctctgagaggaaagttcttcaccatggactggacctggtgggtcttctgcttcctggctgtagctccgaggtgctcactcccgaggtgcaacgtggtgcagtcgtggggctggaagtgaagaacgccgtggggcctgagtggtaacggtttccngacaaggcatctggatacacctcacaggcaccatatgcacgtgggtggacgacgaccggacccccgaanaacggtacgttgaggtggagtagggactaaanacaaaccctaagtagaggtaggaacagaactacgacagaagtaacgttaccgagggaccaggagtccgacacgtacggaccggaccgacgtaccaacgagacacgagtactacgagtggagttaggacgacgacgcgtaggaanagttataggaaccgtacgaccggtacccgtttatttacgttacgccggacggtaaggaacgggaagggtaaccgaaacgtaacgtaaaccgttcccgttacgggttaccctttacccggttttacgtaaccgtcgggtaacccggggg

SEQ ID NO: 190925 - DNA, 575 bp, Homo sapiens
  misc_feature: GYAE6OF01CSOLZ.42.42.D09.1.454.CMB.1.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgacacgtgggtgcgaccgacggcccccggaacaaggacttggagtggagtgggaactanacaaccctaatagtggtaggacngactacgcacagaacgtcgagggcagagcgacagtcgacccggacacgtccaacgcgcacgcgtactacgagtggagttgagcaggcgtagagtaatagtagaccgacgtaccggtccgttagtttagtcggtacggacggtaggaacgggaagggacgtaacgaacgtaaaccttcgtacggttaccttacccgttttacgaccgttacgtaccgggg

SEQ ID NO: 190926 - DNA, 638 bp, Homo sapiens
  misc_feature: GYAE6OF01BFOR5.42.42.D09.1.454.CMB.1.raw
  modified_base (254)..(254): a, c, t, g, unknown or other
  misc_feature (254)..(254): n is a, c, g, or t
tcagtgacgtatgtcacgaccggtgctcgatttagacacatacgcagggaaaggggcatcatccaacaaccacatcccttctctacagaagcctctgaagaggaaagttcttcaccatggactggacctggtggtcttctgcttcctggctgtagctccgaggtgctcacctcccaggtgcaactggtgcaggtcgtggggctagaagtgaagaacgccgtgggcctgagtgaaggtttcctgcaaggcatcgngatacaccttcaccaggcaccatatgcacgtggtcgcgacgacggccccggagaaggactggagtggatggactaagtacaaccgtaagtagtagtagacagactacgacaacgagaacgtcgaggcaagacgtcgaccagtacggacccggactaccgtaccgacgacgacacgacgtactactagtacggtagttaggagaccgaagggtctaggaacgtagtacgtacggaacgtacccgtaaccggtaccgtttacgttttaagttacgtaccggaccggtaagggaacggtaaaggggtacgttaacggaaacggtaaaccttcccggttaggttacccctttacccgttttacggtaacccgttacggtacccggggg

SEQ ID NO: 190927 - DNA, 575 bp, Homo sapiens
  misc_feature: GYAE6OF01EX8HI.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttattcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggccccggacaaggacttgagtggatgggactaatcaaccctaatagtggtaggacagactacgcacagaagttccgagggcagagtcgccagtcgacccgggacacgtccacgagcacagtctacagtggagttgagtcaggctaggagagtagtgaacgacgacgggtccgttcttttagttcggccgtacggaaggtaaggaaaggggagtaaccgaacggtaaacccttccgttacgggttaccctttacccgttttaggaaccgttcggtaaccgggggg

SEQ ID NO: 190928 - DNA, 684 bp, Homo sapiens
  misc_feature: GYAE6OF01DEHX7.42.42.D09.1.454.CMB.1.raw
  modified_base (165)..(165): a, c, t, g, unknown or other
  misc_feature (165)..(165): n is a, c, g, or t
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtnctcactcccaggtgcaactgggtgcaggtcgtggggctagaaggtgaaagacgccgtgggcctgagtgagttcngacaaggcatcagactacaccttcaccnggcaccatangnacgtggtcgccgaacgaccggaccccggaacgacggtaccttggacgtaggtagtacgggaactaagtaaccaaaccgttagtaggtaggtaagaacgtaacgacgtaccgacgaacgaaacggtaacgtcccggaagggacaaggacggtaccgaccgaacggtaccgggaccccggtaacgaaccgtcccggaacgaaccgacgaacgtaacgtacgtaacgtagtagggtagtaggaacgtacgacggtagttacgaagtagtagtacggacggtaaccgtaccggtacgtttattttacggacggtagaccggtaagggaaaggaagggtaaccgtaaacgaacggtaaccttacggtaccggtttcctttaccgttacggttaccgcgggttaaccgggg

SEQ ID NO: 190929 - DNA, 535 bp, Homo sapiens
  misc_feature: GYAE6OF01AC8TJ.42.42.D09.1.454.CMB.1.raw
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccgganaaggcttgagtggatgggactatcaacctaatagtggtagacagactacgcacagaacgttccagggcagngtcgccagtcgacccgggacacgtccacgagcacagtctacatggagttgacgcaggctagacgatagtcgacgacgtaccggccgttcgtttatggccgacgaggaggaagggagtacgaagtaactccgtggttccttacccgttttgccgtcgtacgggg

SEQ ID NO: 190930 - DNA, 732 bp, Homo sapiens
  misc_feature: GYAE6OF01B2XSY.42.42.D09.1.454.CMB.1.raw
  modified_base (179)..(179): a, c, t, g, unknown or other
  misc_feature (179)..(179): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtncactggtgcagtctggggctgaagtgaagagccgtggggcctgagtgaaggtttcctgcaaggcatctggataccaccttcacctaggcaccatatgcacgtgggtgcgacgacggcccccggacaaggacttcggaggtcggagtagggtacgtaaactacctaaaccctaagtagtagggtaacggacaaggaactaaccgactaacgaagtaacggttccgaacgggacaacggacgttaccgacccgtagtaccgggaaccccgggaacctacccggtacccaaccgggaaccgtaccgaaccgtaccgtactaacgtagtagggtacggttaggacggtacgacgggtactagggaagaagttagtacggaccggtaaccggtacgggtacccgttttacgttttacgttcggaccggtaacggaagggtaacggggtaaagggtacgggttaaaccgaaacgggtaaaaccccgttaccggtttaccgggttaccccgttttaacccggtttttcggaaacccggtttcccgggtaaacccgggggg

SEQ ID NO: 190931 - DNA, 521 bp, Homo sapiens
  misc_feature: GYAE6OF01A6RHB.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaaggtttcctgcaaggcatctggatacaccttcaccaggcaccatatgcactgggtcgcgacgacggcccccggacaaggacttgagtggatgggactaatcaaccctaatagtaggtagacagactacgcacagaagttcagggcagagcgccatcgacccgggacacgtccacgagcacagtctacagtggagtgagcgaggctgagatagtgacgacgacggccgttatttagtgcgcgagaggaagggagtacgagaactcgtacgtcttaccctttgactcggtacgggg

SEQ ID NO: 190932 - DNA, 551 bp, Homo sapiens
  misc_feature: GYAE6OF01AQUWV.42.42.D09.1.454.CMB.1.raw
  modified_base (301)..(301): a, c, t, g, unknown or other
  misc_feature (301)..(301): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccgganaaggacttgagtggatgggactaagtcaacctaatagtggtaggacagactacgcacagaagttccgagggcagacgtcgccagtcggacccggacacgtccaacgagcacagtctacgatggagttgagcaggctgagatagtgacgacgacggtccgtatttagtcgcgacgaggacggaagggacgtacgaacgtaaaccgtccgttaggttacccttacccgttttacgacgttacggtacggggg

SEQ ID NO: 190933 - DNA, 841 bp, Homo sapiens
  misc_feature: GYAE6OF01ADNQN.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccgaggtgctcacctccaggtgacaacgtggtgctagtcgtggggtctaggagtagaaggaacgccgtaggggccctagtaggtaggtaacggtttccgtgaccgaaggctagtcgtaggtaacttacctacccgttaccaaccgacggacctaaccgtattacgtacgtccgaacggttcggggtacggaccggaaccgggtaaccccgggacccccggaaaggtaacgggtacgttaacgggaggtagggtaacggtacgggtaacctaaacgtaccgtaaaaccgttaaggttacggggtaacggttaaacggaacgtaacgtaaccggacgaaccgtaacggaacggttaaccggtaacccgggaagggtaccgtaacggtaccggtacccgacccgtacgtacccggggaaccccggtaaccgtacccggtacccgaaaccggacgaccaaaccggtaacgtaccgtaaacggtacgtacgggttacggtaccggagacggacgtacgtaggaactagtaccgtaacgacggtacccggttacggttaccgtttaggtttacgcgggtaaccggagggtaacggtacggggtaaagtacggtaaccgtaaacggttacccgtttcgttacccggtttaccgttacccgtttacgggaaaccgttcggggtaacccgggg

SEQ ID NO: 190934 - DNA, 622 bp, Homo sapiens
  misc_feature: GYAE6OF01B8TWA.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagctggggcctcagtgaaggtttcctgcaaggcatcgtaggatacgaccttcaccaggcaccatatgcacgtggtgcgacgacgggccccgagaaggacttggagtggagtgggaactaacgtcaaaccctaagtacgtaggtagacagacctacgcaacaaggaagtccgaggcagagtcgcagtacgacccggacaccgtccgacgacgacacgagtacgtacagtggtaagttggaacgtacgacggtctaggagtaagttagtacggaacgaccgtacgggtcccgtttagtttacgttacggccgtaaggaaggaacgggtaagggaacggttaaaccgtaaccggaaaaccttcccggtttaggttaccccgtttacccgtttgtaaccggtacggttacccggggg

SEQ ID NO: 190935 - DNA, 680 bp, Homo sapiens
  misc_feature: GYAE6OF01EELMH.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgtaaggtttcctgcaaggcatcgtggataccaccttaccaccaggccaccatatgcacgtgggtcgaccgacgaccgggcccccggaacgaacgggtacttaggaggtaggagtacgggaactaactaccaaaccgttaataggtacggtaaggacgagaccgtacgacacgaacgtaagttacccgagggtacagtacgtccgacctagtaccggaccccgggacaccgtcccgacgacgcaacgagtcctactagtaggtagttacgacggtcgaggcgtaggaagtagtacgtacggaaccgtaccgtaccgggttccgtttacgttttacgtcgggacccgtaggaacgggtaagggaaacggggtacgtaaaccgaaacggtaaaccctttccggtacggttacccgttttacccgttttaagacccgttaccgggtacccggggg

SEQ ID NO: 190936 - DNA, 635 bp, Homo sapiens
  misc_feature: GYAE6OF01CNGC2.42.42.D09.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggctcgagtgaaggtttccngcaaggcatcnggatacacttcaccaggcaccatatgcacgtgggtgaccgaccgacgggcccccggaagaacggtaccgttaggaggtgggagtggggaacctaataccgaaaccctaagtacggtaggtaggaacagactacgacacagtaacgtaccgagggcagagtcgacagtcggacccggacgaccgtaccgaacgacgacgaacgacgtaccgtacgagtaggtagttagacggacgacggcgtagaacgtgtaacgtggtaaccgaccgtacggtccgttagtttacgtacggtcggacggtaagggtaacgggtaaagggacggtaaaccgtaaggtaaacccttccggtcggttaccttacccgtttagaccgtcggttaccggggg

SEQ ID NO: 190937 - DNA, 585 bp, Homo sapiens
  misc_feature: GYAE6OF01BB6BU.42.42.D09.1.454.CMB.1.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctnagtgaaggtttcctgcaaggcatctggatacaccttcaccaggcaccatatcncacgtggtgcgacgacggcccccggacaaggacttgaggtaggacgtagggaactaacgtacaaaccctaatacggtaggtagacgagaccgtacgcaacagaacgttccgaggcgagagtcgccagtcgacccggacacgtccacgagacacagtacacgatggagttgagcaggctgagatagtagaccgacgaccgtaccgttctttagtcgcgtaccggaggtaagggaagggtaagtaccgaaacgtaaaccgttccgtacgggtttaccccttaccgttttcgaccgttagggtacccggggg

SEQ ID NO: 190938 - DNA, 546 bp, Homo sapiens
  misc_feature: GYAE6OF01BHIP0.42.42.D09.1.454.CMB.1.raw
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcacgtgggtgcgacgacggcccccggacaaggacttgagtggagtgggaactatcaacctaataggtggtagacagactacgcacagaacgtccgagggcagacgtcgccagtcgacccggacacgtccacgncacngtcacntggagttgagcaggctggagatagtgacgacacgggtacgttctttagtcgcgacgaggacggtaagggagtacgaagtaaacctccgttggttacccttacccgttttgacccgttggtaccggggg

SEQ ID NO: 190939 - DNA, 772 bp, Homo sapiens
  misc_feature: GYAE6OF01DBVW6.42.42.D09.1.454.CMB.1.raw
  modified_base (286)..(286): a, c, t, g, unknown or other
  misc_feature (286)..(286): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctagagtgaagaagccgtcggggcctcgagtgtaaggtttcctgacaaggcagtcctaggactaccaccttcaccaggccaccaatntcgctacgtgggtcgacggaccgaccgggcccccggaagaacgggtactcggaggtggagtacgggaactacgtaaccaaaccgttaagtacggttaggtaacggacgtaacggtaacgttaaccgaccgtaacgaaggtaaccgttaccggaggggtaccgagggtacgtacccgaccgtaacggtacccgggaaccccgggaccgtacccggtacccgaaacggtacgaacccgtaaaccgtacggttacctaacggtacgttacggggtacgtttacgggaacgtacgggtaacgggtaccgtaagggaacgtaagtttaacgacgggtaacccgaccggttaaccgggttccgttttacgtttacgttcggaccgggtggaaacggtacgggaaagggtaccgtaacggaaccggtaaaccgttcccggtaccggttttacccgttaccgttttaccggaccggttcgggtaacccgggggg

SEQ ID NO: 190940 - DNA, 591 bp, Homo sapiens
  misc_feature: GYAE6OF01A47HG.42.42.D09.1.454.CMB.1.raw
  modified_base (239)..(239): a, c, t, g, unknown or other
  misc_feature (239)..(239): n is a, c, g, or t
  modified_base (483)..(483): a, c, t, g, unknown or other
  misc_feature (483)..(483): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagagccgtggggcctcgagtgaaggtttccngcaaggcatcgtggatacaccttcacctaggcaccatatgacactgggtcgcgacgaccggcccccggacaacggacctttggacgtgggatcgggaactaatacaaccctaataggtaggtagacgagacgtacgcaacagtaacgttccgaggcagagtcgcagtacgaccggacacgtccaagcgcacgacgtctacagtggagttgacgtcaagggctaggagatagtacgacggtaacncggtaccgttctttaagtcgcggtacgaggaagggtaagggacgttaaccgaagtaaacctccggttagttacccgttcccgttttagacccgttggtaacccggggg

SEQ ID NO: 190941 - DNA, 771 bp, Homo sapiens
  misc_feature: GYAE6OF01DY4BS.42.42.D09.1.454.CMB.1.raw
  modified_base (262)..(262): a, c, t, g, unknown or other
  misc_feature (262)..(262): n is a, c, g, or t
  modified_base (430)..(430): a, c, t, g, unknown or other
  misc_feature (430)..(430): n is a, c, g, or t
tcagtgacgtatgtcacgaccggtgctcgatttagacacatacgcagggaaagggggcatcatccaacaaccacatcccttctctacagaagcctctgagaggaagttcttcaccatggactggacctggtgggtcttctgtcttccgtggctgtagctccgaggtgcctcacctcccaggtcgcaacgtggtgcgaggtcggtggggctaggaagtagaaagacggccgtggggcctacgtaggtaggtaacggtttccgngacgaaggcagtcgtagactaccgactccacgagcctaaccatactcgaccgtagttggggaccacggaccggacccgggtaccccgaaagaggtacttggaggtaggagtacggtaactaacgaccaaaccgttaagtaggaacggtagaactaacgacgtaccganaacggaagtcgtaccgaggatacgacgtcgacgagaccggtacccggacctacggtacacggacgtcgaactacgtacgaacgtaggtacgggtagtaacggacggtacgtaccgggagtagggtaaacgtacgtaacgggttacccggaaaccggttacccggtaaccgggtttacccgtttaacgtttttacgggaccgttaccgggaacgggtaaacggggtaaacgggtaagggtaaaaccggtaccgggtaaaaccggttaacccgttcccggtttaacggtttaccggtttaaccccgttttagggtaaaaccccgtcgggggttaaacccgggg

SEQ ID NO: 190942 - DNA, 590 bp, Homo sapiens
  misc_feature: GYAE6OF01BQWT3.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttcctgcaaggcatctggatacaccttcaccaggcaccatatgcacgtgggtcgcgacgacgggcccccggacgaacggaccttggaggtggagtggggaactaatcaaccctaatagtggagacagactacgcacagaacgtccgaggcagagtcgcagtcgacccggacacgtccacgagcacacgtctacacgtgggtacgttggagcgagggtcgtaggaagtaatagtcggaaccgtacgacgggtccgtttacgttttagtcggcgtacggaggtaacggtaaaggggacgtacgaaagtaacctccgttcggttacccttacccgttttgacccgttaggtacccggggg

SEQ ID NO: 190943 - DNA, 608 bp, Homo sapiens
  misc_feature: GYAE6OF01CJCL9.42.42.D09.1.454.CMB.1.raw
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagcctggggcctcagtgaaggtttcctgcgaaggcatcnggatacaccttcacaggcaccatatgcacgtgggtgacgacacgggcccccggacgaaaggaccttggacggtggatggggaactaactacaaccctaataggtggtaggacagactacgcacagaagttcgaggcagngtcgccatcgacccggacacgtccacgancgacagtcaacncgtggtagttgagcagggctagagtagtagtcggacgacgaacgggtccgttacttttcgtcggacgcgggtaaggaacgggaaagggtacggttaaacgaaacggttaaaccttacccggttacggtttaccccgttacccgttttttacgaacccggtttcggtaacccggggggg

SEQ ID NO: 190944 - DNA, 575 bp, Homo sapiens
  misc_feature: GYAE6OF01DI1LT.42.42.D09.1.454.CMB.1.raw
  modified_base (223)..(223): a, c, t, g, unknown or other
  misc_feature (223)..(223): n is a, c, g, or t
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctnagtgaaggtttcctgcaaggcatctggatacaccttcaccaggccaccatatgcactgggtgccgacacgggcccccgganaaggacttggaggtgatgggactaagtccaacctaatagtggtaggacagactacgcaactagaagttccagggcagngtcgcagtcgacccggganacgtccaagacgcacgacgtactacgagtcggagttcggagtccgagggtcctaaggagtaatagtggaacgacgacggtccgttctttagtcggcgacgtaagaacggaagggtacgtaacgaagtaaaccgtccgttcggttaccttaccctttaggaccgtcgtacggggg

SEQ ID NO: 190945 - DNA, 642 bp, Homo sapiens
  misc_feature: GYAE6OF01BA7A8.42.42.D09.1.454.CMB.1.raw
  modified_base (241)..(241): a, c, t, g, unknown or other
  misc_feature (241)..(241): n is a, c, g, or t
  modified_base (340)..(340): a, c, t, g, unknown or other
  misc_feature (340)..(340): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctgaagtgaagagccgtggggcctgagtgtaacggtttccngcaaggcatcgtggataccaccttcaccgtaggcacccatatgctacgtggtcggcgacgacggcccccggacaaggctggaggtggagtgggactaanacctaaccgtaagtaggtagtaggacacgactacgcacagtaacgttcgaggacgagacggtaccgaccgagtaccggacccggacgacgtacccgacgacgcacgacgtacctacgtagtggagttacggacgtcgaggcgtagaaggtatagtacgaccggaacgtaccgggtaccgtttactttacggttacggaccggtacggaacggtacgggtaagggacgtaaccggtaacggaaaccctttcggtaccggtttacccttcccgttttaggtacccgttacgggtaacccggggg

SEQ ID NO: 190946 - DNA, 633 bp, Homo sapiens
  misc_feature: GYAE6OF01CWST5.42.42.D09.1.454.CMB.1.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccgaggtgcaactggtgcagtcgtggggctggaagtgaagaagccgtggggcctcgagtggtaaggttccngacgaaggcagtcgtaggataccgaccttcaccaggcaccatntgctacgtgggngcgaccgacggccccggacgaacggacgtggaggtggagtagggtaactaagtacctaaacctaagtaggtaggtaaggacagactacgacaacgagtaacgtcgaggcaggcgtacgcacgtccggacccggtacaccgtaccgacggacgacaacgacgtactacagtggagttgacgcgagtctaggagactagtcgaacgacgtacggtcctttacgtttacgcggtacgacggtaacggtaagggaacgggtacgtaaacggtacgtaaaccgttccgttacggtttaccgttaccccgttttaggacccggttaacgggtacccggggg

SEQ ID NO: 190947 - DNA, 518 bp, Homo sapiens
  misc_feature: GYAE6OF01EI4EZ.42.42.D09.1.454.CMB.1.raw
  modified_base (407)..(407): a, c, t, g, unknown or other
  misc_feature (407)..(407): n is a, c, g, or t
  modified_base (465)..(465): a, c, t, g, unknown or other
  misc_feature (465)..(465): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggttcctgcaaggcatctggatacaccttcaccaggcaccatatgcactgggtgcgacaggcccccggacaaggcttgagtggatgggactaatcaaccctaatacgtaggtaggacagactacgcacagaagttccagggcagagtcgccatcgacccgggacacgtccacgagcanagtctaacagtggagttgagcaggctgagatatgacgacacggccgttctttatgcgngagagaagggatacagaaactccgtaggtcttaccctttgacctcgtacgggg

SEQ ID NO: 190948 - DNA, 677 bp, Homo sapiens
  misc_feature: GYAE6OF01E2H1H.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagccgtggggcctcgagtgaaggttttcctgcaaggcatctggatacaccttcaccaggccaccatatgcacgtgggtggcgacgacggcccccggacgaaggacttggagtggagtgggactaataccaacctaagtgtggtagacaagactacgacacagaacgttccgagggtacaggacgtcgaccgagtaccggaccccgggaccgaccgtcccaacggacgaccgaacgtacgtactacgtagtgggtagtttacggaggtccagggtctacggtaagtactaggtacgaaccggaacgaccgggtccgttttacgttttagtcgggtaccggacggtaagggtaacgggtaaaggggaacggttaaccgaaaacggtaaaccccgtttaccgggttacggtttaccccgttttaccccgttttaacgggtacccgtttaacccgggtaacccggggggg

SEQ ID NO: 190949 - DNA, 710 bp, Homo sapiens
  misc_feature: GYAE6OF01B6LIU.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagagccgtgggcctcagtgtaaggtttcctgcaaggcatcgtggatacaccttcacaggcaccgatatcgcacgtgggtcgaccggacgaccgggacccccggaacgaacggtaccgttaggacggtagggaacgtaggggtaaccttaactaccgtaaaacccgttaagttacggtagggtaacggaacgaacggtaacgtaccgacaacgaaggtaaacggtttcccgaggggacaaggacgttaccgaccacgtaccgggacccggtaactacccggtaccgaacggtacgaccgaaccgtacgtacctaacgagtacgggtagttacggacgtcgaacgggtctaggaacgtagtaacggtcggaacccgacgtacccggtaccgtttacgttttagttcggtacggaaccggtaggaagggtaaacgggtataccgtaacggtaacccttcggttacggttacccttaccgtttacgacccggttacgggtaccgggg

SEQ ID NO: 190950 - DNA, 560 bp, Homo sapiens
  misc_feature: GYAE6OF01DD9LI.42.42.D09.1.454.CMB.1.raw
  modified_base (308)..(308): a, c, t, g, unknown or other
  misc_feature (308)..(308): n is a, c, g, or t
tcagtgacgtatgtcacgaccggtgctcgatttagacacatacgcagggaaaggggacatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgtaacggtttcctgcaaggcatcgtagatacaccttcaccaggcaccatatgcacgtggtgcgacgacggcccccgganaacggacttggagtggaagtgggactaactaccgaaccctaataggtggtaacgacaagtacgtacgacacgagtaacgttccgagggcaaggacgtaccgcgacgtacggacccgggacacgtccgacgcgacacacgtctacagtggtattgagcgaggctagagatagtacgacgacacggtcgttattagtgcgtgaacgagaggatacgaagaacttccgtgttacgtccctttagccgtggtcggg

SEQ ID NO: 190951 - DNA, 721 bp, Homo sapiens
  misc_feature: GYAE6OF01DH1QT.42.42.D09.1.454.CMB.1.raw
  modified_base (166)..(166): a, c, t, g, unknown or other
  misc_feature (166)..(166): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagtgacgtatgtcacgaccggtgctcgatttagacacatacgcagggaaagggggcatcatccaacaaccacatccccttctctacagaagcctctgagaggaaagttcttcaccatggactggacctggtgggtcttctgcttcctggctgtagctccaggtnctcactcccaggtgcactggtgcagtcgtggggctgaagtgaagagccgtggggcctcagtgtaaggttcctgnaggcntctgatacaccttcaccacggacaccatatgcacgtgggtgaccgaccgaccgggcccccggaacgaaggaccgttggaggtcggagtacgggtaactactacctaaccccgtaagtaaggttggtaacggactaacggaacctacggactaacgacgtaacggttaccgagggacgaaggacgttccgaccgacgtaccgggacccccgggaacgaccgtacccgaacgaacggacctaaccgacgttactacgtaacgtgggtacgttaggtcgacggagtcgtaacgagtaagtacgtaggaccggaaccgtaccggggttcccgttttaggtttttaactacggggacccgtagggaaggtaagggaaagggggttacgtaaaaccggtaaccggttaaaccgttcccccgttaggggtttaccccctttacccggtttttaacggcccggtttaccggtaacccggggggg

SEQ ID NO: 190952 - DNA, 608 bp, Homo sapiens
  misc_feature: GYAE6OF01A5ZX9.42.42.D09.1.454.CMB.1.raw
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
  modified_base (530)..(530): a, c, t, g, unknown or other
  misc_feature (530)..(530): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtgggcctcgagtggtaaggtttcctgacaaggctatcgtaggactacctaccttcaccgacggcaccatatcgcacgtgggtcgacgacgaccggaccccggacaacggtacttaggaggtaggagtagggaacctaataccctaaccgtaagtaggtaggtaagacgagactacgacgtaacagtaacgtaccgaggtcaaggacgtacgcgagtaccggacccggacctacgacacgacgacacgacgtactagngtcgtagtcgacgnacgggctagaagtagagtacgacgacgtacggtacctttgtttancgtggacgaggaaggaagggagtaacgaacgtaacccgtcgttcggtacctttacccgttatccggttacgtccgggg

SEQ ID NO: 190953 - DNA, 564 bp, Homo sapiens
  misc_feature: GYAE6OF01A6CDZ.42.42.D09.1.454.CMB.1.raw
  modified_base (321)..(321): a, c, t, g, unknown or other
  misc_feature (321)..(321): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtggaaggttttcctggcaaggcatctggatacaccttcaccaggcaccatatgcacgtggtgcgacacggccccgacaggacttgacgtggagngggactaagtcaaccctaagtacgtggtagacacgactacgcaacgtagaagttaccgagggcagagtcgacatcggacccggacacgtcacgagcacagtctagatcggngtagagnacggctagacgagtatcgaccgagaccggaccgttcgtttatcgcgtaccggaaggtacggaagggacggtaacacggaaacttccgtaggtaccgttaccctttacgaccgtcggttaccgggg

SEQ ID NO: 190954 - DNA, 613 bp, Homo sapiens
  misc_feature: GYAE6OF01ERVVR.42.42.D09.1.454.CMB.1.raw
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgctttcctggctgtagctccaggtgctcactcccgaggtgcaactggtgcagtcgtggggctggaagtgaagagccgtgggcctgagtgaacggtttccngngaaggcatcgngatacaccttacacgagcaccatatgcacgtgggtgcgacgacggaccccggagaacggtctgaggtgagtacggactaataccaaccgtaagtacggtaggtacgacagacgtacgacaacgagtaacgttacgaggacagtacgccgacagccggaacccggacgtacgtaccgacgacgtacaacgtacgtactacgacgtagggtagttaggaacgtcgacggtcgtaggaagtacgtaggtacgaacgaccgtacggtaccgtttacgtttagcggtacgacggtaggacggaaagggtacgtaacgaacgtaacgtcgtacgttcccttacgttacgtacgtcggtaccgggg

SEQ ID NO: 190955 - DNA, 574 bp, Homo sapiens
  misc_feature: GYAE6OF01ERFGT.42.42.D09.1.454.CMB.1.raw
  modified_base (442)..(442): a, c, t, g, unknown or other
  misc_feature (442)..(442): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtgtaaggtttccctgcgaaggcatcgtggatacaccttccaccaggcaccatatgcacgtgggtgcgacgacggcccccggacgaacggacttgaggtggagtagggactaataccaaccctaatagtaggtagacgagactacgcacgagtaacgtccgaggcagagtcgaccagtacgacccgggacacgtccacgacgacacacgtactacngtaggtagtcgagcgaggcgtagagatagtgacgacgtaccgcgttcgtttagtcgccggagaggaggaagggtagtaccgaagtaacgtccgtacggttccttacccgtttacgtaccgtcggtaccgggg

SEQ ID NO: 190956 - DNA, 538 bp, Homo sapiens
  misc_feature: GYAE6OF01EKVKY.42.42.D09.1.454.CMB.1.raw
  modified_base (303)..(303): a, c, t, g, unknown or other
  misc_feature (303)..(303): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttcctgcaaggcatctggatacaccttcaccaggcaccatatgcacgtgggtgcgacgacggccccgganaaggcttaggagtggatgggactaatcaacctaagtacgtggtacgacagactacgcacagaacgttccgagggcagagtcgaccatcggacccgggacacgtccacgacgacacacgtctaacagtggtagttgagcgaggctggagatagtagacgacgacggtccgtctttagtgcgagagaggaagggagtacgagaaactcgtcggtcttccgtttagcgtcgtacgggg

SEQ ID NO: 190957 - DNA, 869 bp, Homo sapiens
  misc_feature: GYAE6OF01A6ONZ.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtggggtcttcgtgcttcctggctgtacgctccgtagggtctcttccacctcccgaggtcgaccgtaacgtgggttgcgaggttccggtcggggacgttaggaaagggttaggaaaggaaccggtcccgggttacgggggccccttacggtaagggttacgggtttaaaccgggttttcccaggtacggaacgggacacggttcggttaacggacttaacccgtacccgttacgaacccggacggacctaacctaagtacgtcggaccgtacggttggggtaaccggccgtaaccggacccccggggaccccgtaaggtaacgggtaccgtttaggagggtaccggtacgggttacgggtaaccttaaaaccgttaccggaaacccgttaaggtcggggtttaaacgggacgtaaaccggttcgaaacgccggtaacgaacggtaaaggtaccgtacccgaagggtacccaaggtacccggtaccgaaccgtacgtaccgggacccggtaaccgtccggacccgacgaccgactacgaacgttcaggtagtacggtagtagcgggatacgggcgtaagtacaggtacgtaacgtaccgtaacggttccggttacgttaccgtttagcggtccggtaacggtagggtaacggaacggggttaactacggtaaacgtacccggttaggttacccgggttacccgtttacgtttaccgtaacgggttcgggtaaacccgggg

SEQ ID NO: 190958 - DNA, 729 bp, Homo sapiens
  misc_feature: GYAE6OF01DP8AX.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtgaaggtttcctgcaaggcatctggatcaccttcaccaggcaccatatgcacgtgggtcgcggaccgagggccccccggaacaacgggaccttaggacggtggaagtcggggaactaactaccaaaccctaagtagtcggtaaggaacagaacgtacgtacaacgagtaacgttccgagggaccaaggtacgtccgacctagtaccgggaaccccggggtacaaccgggtaccccgacgacgacccagtaccgttacgtacaacgtcgggaagttcggaacgccgtaagggtccgttaagggaacgtaacgtttaagtaccgggaaccgtaaacccggtcccgggtacccgttttaacgtttttacgggttcggtaccgggtacgtaaaggggtacgggggaaaagggtaaccggtaaaccggaaacggttaaaccgtttacccggttacggttcccgtttaccccgttttttacggaacccgttcgggttaacccgggggg

SEQ ID NO: 190959 - DNA, 617 bp, Homo sapiens
  misc_feature: GYAE6OF01AFU6B.42.42.D09.1.454.CMB.1.raw
  modified_base (237)..(237): a, c, t, g, unknown or other
  misc_feature (237)..(237): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagagccgtggggcctcgagtgaaggtttccngcgaaggcatctggataccaccttcaccacggcaccatatgcacgtgggtgcgaccgacggcccccggacgaacggacgttgaggtaggagtcggggaactaacgtacctaaccctaaagttaggtaggtaaggaacaaggacctaacggacacgaaggtaacgttaccgaggggtacaaggacgtccgaccgacgtcggaccccgggacgaccgtaccgacgacgacaccgagtcctacgagtggtagtgacgcgaggctgagtatagtgacgacgccggtcgttacgtttagtggccgtggtaggaggtagggaagtccgaaaggaaccttcggttcggttacccttacccgttttcggtaccgttcgggtaccgggg

SEQ ID NO: 190960 - DNA, 608 bp, Homo sapiens
  misc_feature: GYAE6OF01CKDAV.42.42.D09.1.454.CMB.1.raw
  modified_base (438)..(438): a, c, t, g, unknown or other
  misc_feature (438)..(438): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcaggtgaacggtttcctgcaaggcatctggatacaccttcaccaggcaccatatgcacgtgggtgcgacgacgggcccccggaacgaacggacttggaggtggatagggactaatacaaccctaagtacgtggtagacagactacgcacagagtccgaggcagagtccgacgagtcggacccggacaccgtccgacgacgacacacgtacctaacngtcggaagttgaacgtcgagggtcgtagaaggtataagtcgaacggaccgtaccgggtcccgtttagttttagttcggccggacggtaaggaacgggaaggggacgtacgaaacgtaaaccttccgttcggttaccctttccgttttacggaccgttacggtaccggggg

SEQ ID NO: 190961 - DNA, 788 bp, Homo sapiens
  misc_feature: GYAE6OF01AURNZ.42.42.D09.1.454.CMB.1.raw
  modified_base (242)..(242): a, c, t, g, unknown or other
  misc_feature (242)..(242): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgtaacggtttccngacaaggcatcgtaggactaccgtaccttccaccaggaccaaccatagtgacctacgtgggtcggaccggaccgacccgggaccccccggaacgaacgggtaccgtttaggacggtaggaagtgggtaacctaacttaccccgtaaacccgttaagttaagggtacggttaacggaactaacggtaaccgtaacggacctaacgtaacggtaaacggttacccggacgggaccgaacggtacgtaccggtacccgtaagttccccggggaaaccccgggtaacctaccccgggttacccgaaaccggtacgaccgtaaacccgtaacgttaccgtaaccgttagggtacgggtaggttaccgacggtacgaacgggtcgtaggagtaacgtgtacgaacgtaccgacggttacctttagtttacgtcggtccggtaacggaggtaaacgggaagggttaagtaaccggaaacggttaaccgttaccccggtcgggtttacccctttaccggttttaacggtacccgttaaccgggttaccccgggg

SEQ ID NO: 190962 - DNA, 559 bp, Homo sapiens
  misc_feature: GYAE6OF01A7THN.42.42.D09.1.454.CMB.1.raw
  modified_base (485)..(485): a, c, t, g, unknown or other
  misc_feature (485)..(485): n is a, c, g, or t
tcagtgacgtatgtcacgaccggtgctcgatttagacacatacgcagggaaggggcatcatccaacaaccacatcccttctctacagaagcctctgagaggaagttcttcaccatggactggacctggtggtcttctgcttcctggctgtagctccaggtgcgtcactcccaggtgcaactggtgcagtctggggctgaagtgaagaagcctggggcctcagtgaaggtttcctgcaaggcatctggatacacctttcaccaggcaccatactgcactgggtgcgaccaggcccccggagaaggcttgagttggagtcgggactaactccaaaccctaagtaggtacggtaaggaaccaggacctacgacacagaacgttccaagggtcagagtcgaccagtcgacccgggacacgtccacgagccacagtctacagtggtagtgagcaggctgagactagtcgacgacgacggcctcttttagngacgcggagaggaagggtactacgacgtaaactccgtacggtccttacccgtttgtaaccgttcggtaccgggg

SEQ ID NO: 190963 - DNA, 673 bp, Homo sapiens
  misc_feature: GYAE6OF01DINAD.42.42.D09.1.454.CMB.1.raw
  modified_base (169)..(169): a, c, t, g, unknown or other
  misc_feature (169)..(169): n is a, c, g, or t
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
tcagtgacgtatgtcacgaccggtgctcgatttagacacatacgcgagggaaagggggcatcatccaacaaccacatcccttctctacagaagcctctgagaggaaagttcttcaccatggactggacctggtgggtcttctgcttcctggctgtacgctccgaggtcnctcacctcccgaggtcgacaactggtgctagtcgtggggctaggaagtagaagacgccgtgggcctgagtgtaacgtttccngacaaggcatcgtagactacaccttcaccgagacaccatagtcncgacgtgggcgacgaccgaccggccccggtaagaacggtacgttagggaggtagggaagtacgggtaaacctaacgtaacctaaaccgtaatagggtaggtaaggaacaacgacgtagaacgagaagtaacgtccgaggcaaggtacgcgacgagtaccggaaccggaaccgacgacccgaagacgacaactagtaccaagtacgtggacgttagacgtaccggagtcgtaagacgtatacggaacgaccgtaaacgtcggttaccgtttactttaacgtcggcggaacggtagggaaaacggtaaggggtaacttaaacgaaagtacccgttacgttcggtaaccgtttccgttacggaaacgtcggtaaccggggg

SEQ ID NO: 190964 - DNA, 647 bp, Homo sapiens
  misc_feature: GYAE6OF01CWCNK.42.42.D09.1.454.CMB.1.raw
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcagtgaagttccngcaaggcatcgtgatacacttcaccaggcacatatcgcacgtggtgcgacacggccccganaacggacttgaggtgagtcggaactaanaccaaacctaagtacgtggtaaggacacgactacgacaacgaaggtaacgttcccgaagggacaaggtacgtccggcccgaagttaccgggaccccgggtaacctaccggtaccccgaacgacgaccaaccgacgttactaaacgacgttggacgtttggaagtccgagggtccgttaagacggtaatacggtacgaaccgacgtaccgggttcctttacttttaggtcgacggtacggaggtaaggaaagggacgttaaacgaacggtaaccttcgtacggtttacccttacccgttttagaccgttacggtaccggggg

SEQ ID NO: 190965 - DNA, 637 bp, Homo sapiens
  misc_feature: GYAE6OF01BHMJB.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtggtaaggtttcctgcaggcatctggatacaccttcaccaggcaccatatgcacgtgggtgcgacgaccggcccccggaacgaacggacgttgaggtggagtgggaactaacgtaccaacccgttaagtaggtaggtacggaacgacgacgtacgacgaacgaggtaacgttaccgagggcgaggacgtaccgccgtacgtacggacccgggacgaccgtcccgaaccggacgacacgtacgtactaacgagtcgggagttacggagcgaggtcgagaagattagtacgacgaccgtaccggtccgtttacgttttacgtacggtcgacggaaggagggtaagggacgtaacgaacgtaaccgttccgttcggttaccctttaccgtttacgtaccgtcggtacccgggg

SEQ ID NO: 190966 - DNA, 626 bp, Homo sapiens
  misc_feature: GYAE6OF01EJL6W.42.42.D09.1.454.CMB.1.raw
  modified_base (224)..(224): a, c, t, g, unknown or other
  misc_feature (224)..(224): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagcctggggcctnagtgtaacggtttcctgcgaaggcatcgtggatacgaccttcaccaggcaccatatgcacgtgggtgcgacgacggcccccggacaacggacttgaggtggagtgggactaagtaccaacctaagtagtaggtagacagactacgcacagagttccgagggcagagtcgaccagtcggacccgggacaccggtacccgacggacgacgaacgacgtactaaccgagttcgggagtttaggacgacgtagggcgtacggaagtaatagtacgacgaccgaccggtaccgtttcgttttaagtcggccgtacggaaggtacgggaaaggggacgtaacgaaggtaaacccgttccggtaggttaccctttccccgttttaggacccgttacgggtaccgggggg

SEQ ID NO: 190967 - DNA, 754 bp, Homo sapiens
  misc_feature: GYAE6OF01A225S.42.42.D09.1.454.CMB.1.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcgactccgaggtcgcaacgtggtcgctagtcgtggggctggtaacgtggaagacgccgtggggcctntaggtgtacggtttccngactaaggctatcgtgactacaccttcaccgaggcacctatacgtgaccgtacgttgggacgacggaccgacgggccccggaanacgggtaccgtggaggtaggtacgtagggtaactacgtaaaccgtaaccttaaggtacggtacggtaacggaacaggtaaccagccaacgtacggaacgtcgaagggtcaggtacgtcgacgtagtaccggaccgggtacaccgttcacggacgtagaccgtaagtaccgacgtacggtaggtaccgggttagcggtaacgaacgggttcgacggttaaacggagttaaccgggtacgaacccgggtaacgtccccggggtttaacgttttcggttttaaacgtcggggaccgttaaggggtaaaccggtacggggtaaaaggtaaccgggttaaaccgtaacggtaaacccgttacccggtttggttaacccgttttcccggtttaaagggacccggttaagggtaaccccgggggg

SEQ ID NO: 190968 - DNA, 607 bp, Homo sapiens
  misc_feature: GYAE6OF01BUU5H.42.42.D09.1.454.CMB.1.raw
  modified_base (164)..(164): a, c, t, g, unknown or other
  misc_feature (164)..(164): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
tcagtgacgtatgtcacgaccggtgctcgatttagacacatacgcagggaaggggcatcatccaacaaccacatcccttctctaccagaagcctctgagaggaaagttcttcaccatggactggacctggtgggtcttctgcttcctggctgtagctccaggtnctcactcccaggtncaactggtncagtctggggctgaacgtgaagagcctggggcctcagtgaagtttcctgcaaggcatctggactactacctcacgacgacacatatcgactagtggtcgcgacgaccggacccgacgacggtactagagtgagtacggtaactactacctaaccgtagtacggtacggtacgacgacgacgtacgacacgtacgtacgtacgaggacagacgcgacagtcggaccggacacgtacacgacgacacgacgtactacgagtcggtacgtcgacgcgacgcgtagagtacgtacgtacgaccgtaccgtacggttccgttacgtttacgtcggaccggacggtaacggacggtaagggtacgtaacgaacgtaaccgttcgttaccggttaccctttaccgttacggtaccgtcgggtacggg

SEQ ID NO: 190969 - DNA, 794 bp, Homo sapiens
  misc_feature: GYAE6OF01DOSKW.42.42.D09.1.454.CMB.1.raw
  modified_base (167)..(167): a, c, t, g, unknown or other
  misc_feature (167)..(167): n is a, c, g, or t
tcagtgacgtatgtcacgaccggtgctcgatttagacacatacgcgagggaaagggggcatcatccaacaaccacactcccttctctacagaagcctctgagaggtaaagttcttcaccatggactggacctggtgggtcttctgcttctggctgtagctcgaggtnctcactcccgaggtcgccaagtggtgcgtacggtcggtaggggcttaggaagtaggaaaggtacgcccgggttcggggacccttaggtaaggtttaggttaaccgggttttccgaggaaccgaggtactacgttccggtaagtaacctacccgtaaccttacccgaacggacgtaccaacctaagttcgcgacgtacggtgggcgaccggtaaccggacccggtaccccggaagacggttacgtaggggtaggtacgtagggtaacgtaactttaacccgaaaccgttaaaccgtaaggttaagggtaccggttaaacggaacctacggtaaccgaccgtaacgaactaaacggtaccggtaccgaggtaacggaacggtacccggacaccgtaacgggtaaccggacccgggtaacgtaccggacgacgaaccgtacacgtagtacccgagtaggtgggagttacgacgcggagtagtaacgagtactaagacgaccggacgttaccgtcttttaacgttgcggaaggaggtaacgggtaaggaaacggtagtaaacgtacttaaaccggtcccgtttacggttaacccctttcggtttacggaacccggttcggggtaaccgggg

SEQ ID NO: 190970 - DNA, 914 bp, Homo sapiens
  misc_feature: GYAE6OF01B1U7P.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgacaacgtggtgcagtcgtggggctgaagtgaagagccgtgggcctgagtgtaacggttcctagacgaaggcatcgtaggtactacctaccttacaccgaggaccaccatagtcgctacgtgggtcgaccgaaccgaccgggaccccggaagaacggtacgttagaggtggtagtacgggtaactaacgtaccaaaccgttaagtaggtaggtacggtaacgaacgtaaccgtaccgaaccgtaacgtaacggtaacgttacccggaacgggtaccgtaacggtacggtacccggtaccctaacggttaccccggggaaacccccggggtacgttaaccccgggaaccccgaacgggtaaccgaacccgtaaacgtaacccggttaacccgttaacgtaacgggttacggggtaacgtttgggaaccgggtacggtaacgggtacgttaagggaattaacgggttaacgtaacccggggtaacggtaacccccggttaacccggggtttacccgtttttaacggttttacggttacccgggtacccgggttaaaaggggaaccgggttaaaacgggggtaaaaccggggttaaaccggttaaacccgggtaaaaccgggtttaaaaacccccgtttcccccgggttttaaaccgggttttaaccccccgttttttaaccccgggtttttaaccggtaaacccccggggttttcccggggtaaaccccggggggggg

SEQ ID NO: 190971 - DNA, 833 bp, Homo sapiens
  misc_feature: GYAE6OF01B9DXZ.42.42.D09.1.454.CMB.1.raw
  modified_base (374)..(374): a, c, t, g, unknown or other
  misc_feature (374)..(374): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccgaggtgctcactccgaggtgcaactggtgcagtcgtggggctagtaagtgaagacgccgtggggcctcgagttaggtaacggttttcccgtgacggaaggctaagttccgtggtaactacctacccttcgaacccgaggaccaacctaagtacgtcgacctacgggtggtcggaccggaccgacccgggaccccggaagtaacggtacgttaggnggtagggtacggtacgggaacttaacgtaccgtaaacccttaaggtaacggtaggtaacggaacgtaacgaaccgtaaccggtacgaaacgtaacggtaaccggttaccggaggggtacgaacgggtaccggttaccggaccgtaacgggtaacccgggtaaccccggggtaacgaaccccggtaccggaaccggaacgtaccgaaaccggtacgttaccgtaacgtaacggttacgggtaagttacgggacggtacgaacggggtacgtaacggtaacggtaattacggtacggtaaccggtaacccggttacggttaccgtttccgtttttaacggcgggtacggtaaccgggtaagggaacgggtaagggtaaacggttaaacggtaaccgttaaccgtaccggtttaccgttcccggtttaaccgttttacggtaccggttaccggggtaccggg

SEQ ID NO: 190972 - DNA, 739 bp, Homo sapiens
  misc_feature: GYAE6OF01A8O9A.42.42.D09.1.454.CMB.1.raw
  modified_base (141)..(141): a, c, t, g, unknown or other
  misc_feature (141)..(141): n is a, c, g, or t
tcagtgacgtatgtcacgaccggtgctcgatttagacacatacgcagggaaagggggcgatcatccaacaaccacatcccttctctacagaagcctctgagaggaagttcttcaccatggactggaccgtggtgggtcttntgcttccgtggctgtagctaccgaggtgctcactcccgaggtcgctaacgtggcgcacggtcgtgggggtctaggtaaggtagaaacggacgcggtcggggtcctagaggtaggtacggtttcccgagaccaagggtcacgttcgtacggtactaccgtaccgtacgaccgacgacctactacgtacgtacgacgtacggtggtacggaccgaccggacccgggacccgtaacggacggtacgtagggacggtaggtaaggtacggtaacctaacgtaacctaaccgtaaggtacggtacggtacgtaacgacgactacggacgaacgtaacggtaacggtacgacggacgtaacggtacggtaccgaccgacggtaccggacccggtaccgtaccggaccgaacgaccgacgaaccgtacgtaccgtagtacggtaggtacggacggacgtacgaggtacgagtaactagtaacgtacggacggtccggtaccggttcgttacgttgacggacgtacgggacggaagggtagtaacggtacgtacggtaccgttaccggttaccgttacgttaccggttacgtccggtagggtcccg

SEQ ID NO: 190973 - DNA, 794 bp, Homo sapiens
  misc_feature: GYAE6OF01CO8I6.42.42.D09.1.454.CMB.1.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (184)..(184): a, c, t, g, unknown or other
  misc_feature (184)..(184): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggaccttgtgggtcttntgcttcctggctgtacnctccgaggtcgctcacctccgaggtcnctacgtggtcgcgagtcgtggggctaggaagtagaagtacgcggtagggcctagagtagtaacggtttccagacgtaggctagtcgtacggtactacctaccttaccaaccgacggaccacctatagtcgccgtaggttgggacgaccggaccggacccgggaccccggaaaggtacgtaccgtaggtagtggacgtacggaactaacgtacctaacgtaagtacggtaggtacgaacgacgtaaccgtacgacaacggtaacgttaacgttacggacgggtacgtacggtaccggtcaccgtacggtaccggaacccggtaaccgtcccggtacgaacgacggtacctaaccgtacgtacccttaaggacggttacggtagttacggacggcgtaaggcgttaaggaacgtacgttacggtaccgaaccggtacgttacccgggtttcgttttaaacgtttccgggacgggcggttaaagggaggtaaaaccggggttaagggtaaccttaacgggttaaacccgttacccgtttacccggggttaccgtttttaacccggtttacccgttttaacggggaccggtttaacccgggggtaacccggggg

SEQ ID NO: 190974 - DNA, 634 bp, Homo sapiens
  misc_feature: GYAE6OF01EAQXJ.42.42.D09.1.454.CMB.1.raw
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgacaactggtgcagtcgtggggctaggaagtagaagaagccgtggggccctgaggtgtaacggtttccgngacaggcatcgagatacaccttcaccngcaccgatatgcagtgggtcgcgacgaccggaccccggacgaaggcttaggagtacgggagtacgggaactaacgtaacctaaaccgtaagtaacggtaggtaggacgaagacgtacgacaacgaagtacgtacgaggacagacgtcgacacggtacggacccgggaacacgtaccgaacgacgacgaacctagtacctagtagtacgggtagttacgacgtacgaggacgtggaactagtacgtagaaccggacgtacggtccgtttagtttactgggcggaacgaagggacggtaagggaactacgaaacgtaacctccggttacgttaccttccgtttagtacgtcggtaccgggg

SEQ ID NO: 190975 - DNA, 762 bp, Homo sapiens
  misc_feature: GYAE6OF01DONNM.42.42.D09.1.454.CMB.1.raw
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (492)..(492): a, c, t, g, unknown or other
  misc_feature (492)..(492): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctcaggtgctcacctccaggtgcaactggtgacagtcgtggggctaggaagtggaacgacgccggtggggtcctcgaagttggtaacgtttccngacgaaggctatcgngtaactactaccttcaccgacgtaccactatatcgcgacgtggggtcggacgaccggaccgggacccccggaagaacggtacttggaggttagggagtagggaaaccttagaacccgtaacctagtacggtaggtaagacgtaggactacgagaacgaaggtaccgtacggaaggcgtaacgagtccgaccgtagtaccgggacccggaactaccggacacggaacnctaacgacggttacctagtaacggtaggttaggtaacggcgtacgacgggtgtaacgagtacggtaacggtacgaaccggtacccggttcggttacccgttttagtttaacgtccgggtacgtaaacgggtacgggaaaagggggtaacggttaaacgtaaaccgggttaaacccggttaacccgttcccgggttttaaaccgggtttaccccctttttaccggggtttaaaccctccggggtttaaccggggggttaaaccccgggggg

SEQ ID NO: 190976 - DNA, 634 bp, Homo sapiens
  misc_feature: GYAE6OF01CBUVE.42.42.D09.1.454.CMB.1.raw
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctgaagtgaagaagccgtggggcctgagtgaaggtttccngcaaggcatctgatacacttcacagcaccatatgcagtgggtcgcgacgacggccccgaanaggacttgagtggagtcgggaactaagactaacctaagtaggtaggtaagacagactacgacacgaagtaacgtcgaggctagacgtcgacagtcggacccgggacacggtaccacgacgaccaacgtacgtactaacgtaagtggtaagttgacgtacgagggtctaggaagactagtacgaccggtacgtaccggtccgtttacgtttacgtcggacccggagtaaggtaacgggaaagggtaacgtaaaccgtaaaccgtaaaccgttcccggtttacggttaccccttttacccggttttacgtaaccggttacgggttaacccgggggg

SEQ ID NO: 190977 - DNA, 840 bp, Homo sapiens
  misc_feature: GYAE6OF01AOVR3.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcactcccaggtgactaacgtggtcgctagtcgtggggctagaaggtagaaagaacgtccgtaggggtccctacgtaggtaggtaacggtttccaggacgtaagggctattacgtaggtaactaccctaccgttaccaaccgacggaccaccgtaatacgtcgactacggtgggtacgaccggaaccgacccgggtacccccggaagtaacggtacgttaggaggtacggacgtacggtaactaacgtaaccgtaaaccgtaagtaggtacggtaacggacgacgtaacgacgactaacgaaggtaaccgtacggacgggacgacgaccggtaaccggacctacgggaacccggaccccgggaacctacccgggtaacccgaacgaccggaacctaaccggtacgttaaccgtaacgtacgggttaacggtacggttacggaacgtacggaacgggtaccgtaggtaacggttaaacgttacgggttaaccggaaccgttaccgggtacccgggtttacctttaacgggtttagtaccgggtacccggtaacgggtaaacggaaacgggtaacggggtaacgtaaaccgttaaaccggtaaacccggtttcccggttacggtttaccccgtttacccggttttaagaccccgggttacgggttaacccggggg

SEQ ID NO: 190978 - DNA, 813 bp, Homo sapiens
  misc_feature: GYAE6OF01BOPPU.42.42.D09.1.454.CMB.1.raw
  modified_base (180)..(180): a, c, t, g, unknown or other
  misc_feature (180)..(180): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactcccaggtncaacgtggtgcagtcgtggggctagaagtagaagaacgccgtggggcctcgagtgtaacggtttccagagaaggtctaagtccgtaggactaccgaccctttacgaccgaacggactaacccatagtacgactaccgttagggtacgacgaaccggtaccggacccccgggaacgaaacgggtaccgttaggacgggttacggtaagtacggggtaacttaaacgtacctaaacccgtaagtaggtggtacgaacgacgacgtacgacaacgtaagtaacggtccgacgggtacgaacgtacgttacggacgtacgacggtaaccccgggaacgtaccggtaacccgaacggaaccgcgtaaacgtaacgttaactaacgtacggtaacggtagggttaacgacgacgttagggacgtaggtaacgtaataacgggttacggaaaccggtacgtaacccgggggttactttaaccggttttacgggttaccggtacggaaacccgggtaagggtacggggtaaaaggtaccggttaaaacggaaacgttaaaccccggttaaaccggttcccggtttaacccgtttaccccggttttaacggttaacccggttacccgggttaacccgggggg

SEQ ID NO: 190979 - DNA, 793 bp, Homo sapiens
  misc_feature: GYAE6OF01EGW0Z.42.42.D09.1.454.CMB.1.raw
  modified_base (645)..(645): a, c, t, g, unknown or other
  misc_feature (645)..(645): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagctccgaggtcgctcacctcccgaggtcgacctaacgtggtcgcgacggttcgtggggctaggaaggtacggaaaggaacggccggtcgggggaccctagtaggttacggtaacggtttccgtaggaacgaaggcacgttacgtaggtaacttaaccgtaacccgttaccgaaccgaacggtaccctaaccgtaattacgtacgtaccgtacggttcggggtacgaccggaaccggaccccggggtaacccccggaaggtaaaccgggttacgtttaacgggacgggttacgggtacggtaacgggtaaacttaacgtaaccgtaaaacccgttaaggtacgggttaacggtaacggaacgtaacgtaccgtaacgaccgaaagtaacggtaacgttacccggagggtacgaacggtacgtccggactacggacccgggtaacccggtacaccggtaccgaacggtgaaccctagtaccgtacctaagngtacggtagtaggcgacgtggacgtacgaagtacgtacgacggtaaccgacggtccgtacgtttgtttaccgaggccgaggtacggaagtaaccgggattacgaacgtaccgtcgttacgtcccttaagttccgacgtcggtaacggg

SEQ ID NO: 190980 - DNA, 650 bp, Homo sapiens
  misc_feature: GYAE6OF01C716Z.42.42.D09.1.454.CMB.1.raw
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (503)..(503): a, c, t, g, unknown or other
  misc_feature (503)..(503): n is a, c, g, or t
tcagtgacgtatgtcacgaccggtgctcgatttagacacatacgcagggaaaggggacatcatccaacaaccacatcccttctctacagaagcctctgagaggaaagttcttcaccatggactggacctggtgggtcttctgcttcctggctgtagctccaggtgctcactcccaggtgcactggtncngtcgtgggctagagtgaagaagccgtgggcctgagtgtaacggttcctgacaaggctatcgtgactaccaccttccaacacggaccaaccaatactgacgacgtggtgccggaccgaccggaccccggagaacggtacctggaggtcggagtgggaactactaaccgaacctaagtaggtacggtaggacgaagtacctacgacacgagtaacgtcgagggacagacgtcgacacgtcggacccggacacgtaccacgacgacaagagtctagagttacgggtagttggacgacgtagcgtacggaataacgtntacggacgacgacgttccgttagtttatacggcccgtaggacgggaaacggtaagggtaaacgtaaccgaaacggttaaaccgtccggtttaacccggttacccttttaccggtttaaaccgtcccggttacggggtaaccccgggg

SEQ ID NO: 190981 - DNA, 859 bp, Homo sapiens
  misc_feature: GYAE6OF01A8ZQ3.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagctccaggtgctcactcccgaggtgcaacgtggtgcagtcgtggggctagaagtgaagacgccgtgggcctcgagtgtacggtttccgtgacgaaggctagtcgtaggaactacctacccttacacccgaggaccaaccgatagtcgctacggtgggtcgaccgaaccgaccgggtcccccggaacgtaacggtacgttaggagggtcggtaggtacgggtaacttaacgtaacctaaccgtaagtacggttaggtaacggaactacggtaacgtacgaaccgaacgtaacggtaacgttaccgggaacgggtacgaacggtacggtacccgaccgtaacggttacccgggaaccccggggaaccgtaaccccgggtacccgaaaccggtaacgaaccggtaacccgtaaccggttaacctaacggtaacggttacggggtaacggtttacgggaacgggtacccgggacgggtacgtaacggtaaacgtaacggttaacgggtaacggaacccgggtaaccgttacccgggttacccgtttttacggtttaacggtaccggtcgggaacccggtaaggggaaaccgggtaacggggtaaccgtaaaccgtaaacgggttaaaccccggttaccggtttaccgggttaccccgttttacccgggtttaccgttaacccggggttaccggggtaaacccggggg

SEQ ID NO: 190982 - DNA, 726 bp, Homo sapiens
  misc_feature: GYAE6OF01CWVH6.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccgaggtcgcaacgtggtgcgagtcgtggggctgaagtgaagagccgtggggcctcgtagtgtaaggtttcctggacaggctagtcgtaggtatacctaccttccaaccgaggcctaaccattacgtgccgtaacgtggggtacgaccggaccgacccgggacccccggaagtaacggacgttaggaggtacggtagtacgggtaactaaacgtacccgtaaccgtaagtacggtaggtaacgactaagaccgtacgacaacgagtaacgtccgaggacgagtacgtcgaccgagtaccggacccgactaccggtacacgacgactacgcgtactacgaggtgagttaggacgacggagtacggtagaacgtagtacgtacggaccggtaccgtacccgggttccgtttaacgttttcgacgggtaccggtagggaacgggtaacggggtaaaaggtaccgggttaaaccgtaacccggtaaaccggttccgtttacccgggtttacccttttacccgggttttacggaacccgggtttaacgggtacccggggg

SEQ ID NO: 190983 - DNA, 759 bp, Homo sapiens
  misc_feature: GYAE6OF01EKAWZ.42.42.D09.1.454.CMB.1.raw
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
tcagtgacgtatgtcacgaccggtgctcgatttagacacatacgcagggaaagggggcatcatccaacaacacatcccttctctacagaagcctctgagaggaaagttcttcaccatggactggacctggtgggtcttctgcttcctggctgtagctccaggtgctcactcccgaggtncaactggtgcagtcgtggggctggaagtgaagaacgccgtggggcctcgagtggtaacggtttccngacgaaggcatcgtaggtataccgaccttaccaccgaggccaccgtatagtcgactacgtggggtcgacggaccgtaccgggacccccggaacgaagggtaccgttagggagggtacgggtaacgtacgggtaaaccttaaacgtaacccgtaaaacccgttaaaggtacggtacgggtaaacggtaacgtaacgggtaaccgtaaccgacgtaaaccggtaaggtaaacggtttacccggaagggtaccgaaggtacggtaccgaccggtaagtacccgggaaccccgggtaacgaacccggtacccgtacggaacgaccgtaaccgtacggttaccaacgtaggtacggttaggttacggaacgtcgaacggtcgtacgaagtagttacgaaggtaccgaacgtaccggttactttcgtttagttcggcgtaaggagggaacggtaagggtaacgacgtaacgtaaccgtcgtcggttaccttcccgttacggtaccgttcgggtaccgggg

SEQ ID NO: 190984 - DNA, 805 bp, Homo sapiens
  misc_feature: GYAE6OF01D2TDJ.42.42.D09.1.454.CMB.1.raw
  modified_base (245)..(245): a, c, t, g, unknown or other
  misc_feature (245)..(245): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgacacgtggtgcagtcgtggggctggaagtgaaggacgccgtggggcctgagtgtaacggtttccgngacgaaggctagtcgtaggactacctaccttccgaaccgagaccaacctagttagcgacgtaccggtgggtcgaccgaccgaccgggacccccggtaagaacggtaccgttgacggtggtaacgtagggtaacctaacgtaacctaaacccgttaagttacggtacggtaacggactacggtaaccgtacgacgaacgtaacggtaacgttaccggagggacgaagtacggtaccgaccgtacgtccgggaaccccggacgtaccggtaccgacggtaacgacctaacgtaccggttacctaacgtaaggtcgggtaacggtaggacggaacggtaccgggtatacggaagttaacgtaggtaacccgaaccgggaaccggtaacccgggtttaccggttttaccgtttaaggttcccgggacggaccggggtaaagggtaaacggggtaaagggtaaccggttaaaccggaaaccggtttaaacccgtccggtttacccgggttacccctttttacccgggtttacggttaacccggttacccggggtaaacccggggg

SEQ ID NO: 190985 - DNA, 807 bp, Homo sapiens
  misc_feature: GYAE6OF01EAU6Q.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccgaggtgccaacgtggtgcagtcgtggggctaggaagtgaagaacgccgtggggcctcagtgaaggttttcctgacgaaggtcatcgaggtactaccacccttcaccgacggccaacctaatagtcgacacgtcgggtgaccgaacgacccgggacccccggacgtaacggtacgttaggacggtaggtaacgtagggtaaacctaaactaaccctaaaacccgttaaagtacggtaggttaacggaacgaagtaaccgtaacgaaccgaacgtaaaggtaaccggtttaccgaacgggacgtaaacggacgttaccgaccgtaacggttaaccgggaacccccggggtaacaccccgggttaaccccaaaccgggtacgacccgaaacggtaaccgtaccttaacgtagtacgggtaggtttacgaggacggtaacggcgttaaggagtaagtagtaccggtaaccggtaccgacccgggttaccgttttacgtttttaagtaccggtaccggaacgggtaggtaaaacgggtaagggtaacggtaaaccgtaaacggtaaaccccgttccggtttaccggttaccccgtttcccggttttaaaccggtcgttacccggggtaacccggggg

SEQ ID NO: 190986 - DNA, 852 bp, Homo sapiens
  misc_feature: GYAE6OF01BDDVM.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatgactggacctggtgggtcttctgcttcctggctgtagctccaggtgctcacctcccaggtgcaacgtggtgcagtcgtggggctagaagtgaagacgccgtggggtcctgagtagtaacgtttcctgacgaggctagtcgtaggaactaccaccgttaccaccgacggacctaacctatacgtcgaccgtacggtcggggtcgaccgaaccggtacccggggacccccggaagtaacggtacgtggaacggtaggacggtacggtaacctaaacgtaccgtaaaaccgttaaggtacggttacggaaacggtaccgaacgtaaccgtaaccgaaccgtaaacgtaaacggtaaccggttaccgggaacgggaacgtaaagggtaccgtaccggtacccggtaacggtaccccggggtaaccccgggtaaccgtaacccggttaccccggaaacggtaccgtaacccgtaaccggtaccgtacgttaaccgtacggttaagggtacgttacggacgggtaccgtagggtaacacgggtaaagtaacgtacgggtaacggaaccgttaaccccggttaccggtttacccgtttttagtttaacggttcgggaccgtaacgggaaagggtacgggtaaacgggaacgtaaaccgttaaccggttaaacccgtttacccggttaccggtttaccccgtttaaccgtttcgggttaaacccggtgggttaaccccggggg

SEQ ID NO: 190987 - DNA, 886 bp, Homo sapiens
  misc_feature: GYAE6OF01D4LWD.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccagtgcaacgtggtgcagtcgtggggctaggaagtgaacgaacgccggtaggggcctcgagtaggtaacggtttccgtgaccgtaacgggctatccggtaggtactacccgtaacccttaccgaacccgacggaccaacctaattagtcgaccgtacggtacgggggtcgacccggaaccggtacccggggaccccccgggaacggaacgggtaccgttaggacgggttagggacgttaacgggaacttaacgtacctaaacccgttaagttacggtagggtaacggaacgacgtaccgtaacggtaccaaacggtaacggttaaacggttaccgggaacggggtaaccgaacgggtacgtacccgggtaccgtaacgggtaaccccgggaaccccggggtaacccgtaaccggttaccccggaaaccgcggtaacccgaacgtaccggttaacctacggtaaggtaccgggttagggttacggaacggaccgtacgggtacgtaggaagtacgtaacgtcggtaacccgggacgttacccgggttccggtttaaccgtttttagtcgggtaacgggtaccgggaaggggtaacgggaaacggggttaacggtaaaccgaaacccgggttaaaccgttcccgggtttaccggtttaccccgtttacccggtttttaaccggtacccggttacccgggggtaaaccccgggggg

SEQ ID NO: 190988 - DNA, 936 bp, Homo sapiens
  misc_feature: GYAE6OF01BTEFC.42.42.D09.1.454.CMB.1.raw
tcagtgacgtatgtcacgaccggtgctcgatttagacacatacgcagggaaagggggtctaggtcatccgaacaaccacatcccttctctacagaagcctctgagaggaaagttcgttcaccatggactggaccctggtgggtcttctgcttccgtggctggtagcgtccaggtgcgtcactcccaggtcgcaacgtcggtcgctagtcgtggggctacggtaaggtgaaggaacggccgttcgggggcccttcaacggttcggtaacgggttttccctggaccaaacgggccagttaccgtagggtacttaaccgtacccgttttaccaacccgtaagggtacctaaccctaacttacttacggacctaacggttcggggtcgtaccggtaaccgacccggggaacccccgggaacgtaaaccggggtaacccgtttaggtaacggttaacgggtacgtacggggtaaacttaaccgttaccccgtaaaccccgttaacggttacggggttacgggttaaccggtaccgtaacgggtacccgttaaccggacccgtaaccggtacggtaaacccgggtttcgaaccggggaaccgtaaacgggtacgggtaccccgtaccgtaacgtacccggggaacccccggtaccggtaaccggttacccgaacggaccgccgtaactaacgggtaccgtaacgtaacgttcgggtaagttacggaacgtacgtaacggcgtaaggtaacgttagtaaacgttacgggtaaccgtaacccgaccgggtttacccgtttacgttttaaacggttccgtaccggtacggtaacggggtacgggtaaaacggggtaccgtaaaccggaaaacggtacccgtttaacccggttccggtttaccccgtttacccggtttacgaaaccggttaccgggtacccggggg

SEQ ID NO: 190989 - DNA, 728 bp, Homo sapiens
  misc_feature: GYAE6OF01C2BJE.42.42.D09.1.454.CMB.1.raw
  modified_base (179)..(179): a, c, t, g, unknown or other
  misc_feature (179)..(179): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
tcagtgacgtatgtcacgaccggtgctcgatttagacacatacgcaggggaaagggggcatcatccaacaaccacatcccttctctacagaagcctctgagaggaaagttcttcaccatggactggacctggtgggtcttctgcttcctggctgtagctcaggtgctcactcccaggtnacaacgtggtgcaggtcgtggggctaggaaggtgaagaagccgtgggcctacgagtagtaacggtttccngacgaaggcagtcgtaggaactaccaccttacaaccgaggaccaaccaatancgcgtacggtgggtcgaccggaacgaccgggtacccccggaagaaacggtcgtaggaggtagaagtaggtaactaataccgaaacctaagtaggaggtaagacaagacgtacgaactacgaagtaacgtcggaacggacgtaagacgtaccgcgtaacgtaccgggaacccgggaaccaccgtaccgaacggacgaacgaacgtacgtacctaacgtaggtaggtaacgttaggaagaccggaagggtacctaagggtaaagtaacgttaaggtaccggaaacggtacccgtaaccgggtttaccgtttacgttttaaggtcggacggtacggaaggaaacgggtaagggaaacgtaacgaaacgtaacccgtccgtttaccgggttaaccctttccgttttaacgaccggttaacgggtaccgggg

SEQ ID NO: 190990 - DNA, 675 bp, Homo sapiens
  misc_feature: GYAE6OF01B7VVE.42.42.D09.1.454.CMB.1.raw
  modified_base (239)..(239): a, c, t, g, unknown or other
  misc_feature (239)..(239): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgaaggtttccngcaaggcagtcgtggataccaccttcaccgaggacaccatatcgacacgtgggcgacgacgaccggccccgacgaacggacttaggagtggagtcgggaactacgtactaacccgtaagtaggtcggtaacgacgtacgacgtacgacgaacgtaaggtaacgttccggagggacctaggaacggttccgacgtagtaccggacccgggacgtaccgtacccgacggacgaccgacgtacgtactactacggtacggtagttagacgcgaaggtcgtagagaagttagtacggaccgtacggtaccgtaccgtttacgttttacgtcggacgtaccggtaaggtaaggaacggggtaaggtaaccggaaccgtaaaccgttacccgttcggttacccgtttacccgtttacggtaccggttaccgggtacccgggg

SEQ ID NO: 190991 - DNA, 737 bp, Homo sapiens
  misc_feature: GYAE6OF01CF90C.42.42.D09.1.454.CMB.1.raw
  modified_base (200)..(200): a, c, t, g, unknown or other
  misc_feature (200)..(200): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtccttctgcttcctggctgtagctccgaggtgcctcaccgtcccgagggtgacgtaacgtggtcncgaggtcgtggggctagaagtagaagacgccgtgggcctcgagtgtacggttccagacgagctagtcgtgtactactacctacacgacggcactatagcgcgacggtgggcaccggaccgaccggccccggaagaacggtacgtaggtacgaggtaacgtacggtaacttaactaacccgtaaaccgtaagtacggtaacggtaagaaccgtaacggtacctaacggacaacggtaagtaaccggtacggacggacgaaaggtcggacctaccgtacggtaccgggacccggtaaccgtacccggtaccgaacgacgtaccaacgtaccgtactaacgtaggtacgggtacgttgacgtagtacggactagggtaatacgtacgaggtacccaacggtcccgtttcgtttaacgtttcggtacccgggaggtccgtaaaaggggacggtaaggtaaccggtaacgtaaccggtaaacctttcgtacccggtttaccgtttacccggttaaacgttccggtaacgggttaacccgggg

SEQ ID NO: 190992 - DNA, 715 bp, Homo sapiens
  misc_feature: GYAE6OF01AJUUW.42.42.D09.1.454.CMB.1.raw
  modified_base (245)..(245): a, c, t, g, unknown or other
  misc_feature (245)..(245): n is a, c, g, or t
tcagtgacgtatgtcacgaccggtgctcgatttagacacatacgcaggggaaagggggcatcatccaacaaccacatcccttctctacagaagcctctgagaggaaagttcttcaccatggactggacctggtgggtcttctgtcttcctggctgtagctcaggtgctcactccgaggtgcaacgtggtgcagtcgtggggctggaagtgaagacgccgtggggcctgagtaggtacggtttccnggacaggcagtcgtggaactaccaccgttccaccgtacggccaacctatagtcgacgtacggtgggtcgaccgacgaccgggaccccggaacgtaacggtcgtaggacggtaggacgtagggtaacctaacgtaccaaaccgttaaggtacggtaggtaaccgagaacgtaccgaacgcgtaacgaacggtaacgtaccgagggacaggtacgttccgacgagtaccggaccgggtacaaccgtccgaacggacgtaccacgtacgtacctacggtagttcggtaggttacggcggaacgttacgggacgtaggagtaagtgtaacggacgtaaccggtccgtacggttttactttacggcggtaccggacggtaaaggggtaacgggaggttaaccggaactaaacggtaacccgttacggttccggttaccctttacggtttaccgtaacggtaccgggtacccgggg

SEQ ID NO: 190993 - DNA, 726 bp, Homo sapiens
  misc_feature: GYAE6OF01BVNXF.42.42.D09.1.454.CMB.1.raw
  modified_base (188)..(188): a, c, t, g, unknown or other
  misc_feature (188)..(188): n is a, c, g, or t
  modified_base (254)..(254): a, c, t, g, unknown or other
  misc_feature (254)..(254): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtncagtcgtgggctgaagtgaagagccgtggggcctcgagtagtaacggtttcctgacaaggcatcgnggatacgaccttcaccgaggccaccatacgcacgtggtcggcgacgaccggaccccggaccgtaacgacggttcgtaggtaggtacgtacggtacggtaactacgaaccctaacgtaggtacgggtacggtacgacgtaacgtacgtacgaaccgtacggtaaggtacccggtacgggacgacgtaggtaccgtaccgacgtaacggacccgggaaccggtaccgtaaccgtaccgaacggactaccggaacgttacgtacctaacggtagggtacgttaggaaccgtggacggccggtagacgtaaggtactcgggtaacgaccggtacgggtcccttacgtttaacgttcgtaaccggcggtaaaggaggtaaagggtaacgggtacgtaacggtaaacccgttaccgttacggttcccgttttacccgtttaccggttaaccgtccgggtttaccggggaacccggggg

SEQ ID NO: 190994 - DNA, 810 bp, Homo sapiens
  misc_feature: GYAE6OF01EX1A2.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccagtgcaactggtgcagtcgtggggctgaagtagaagaagccgtcggggcctcgagtaggtaacggttttccctagacgaaggctatccgtaggacttaccaccctttccaacccgacggaccaaccagtaacgtgccacggtacgggtcggaccgaccgaccgggcccccgggaacgaacggtacgtttacggaggtacgggtagtacggggtaactaactacctaaacccgtaaagtacggtaggtaacggaacgaagaaccgtacgaccgaaacgtaacggtaaacggtttacccggaacgggtacgaaggtacggttacccggaccgtaaccgttacccggggaaacccccggggtaacccgtacccggtaccccggaaaccggtaacggaaccgaaccgtacgttaaccgttaaccgtagggttaagggtacggttacggaagtaccggagggttacgtaagaacgtaagtacgtacggtacccggtaaccggtacccggttaccgtttacgtttacggttaggcggtaaccggaagggaacggtaaggggtaacgtaacggtaaaccgttaaaccggttccgttaaccgggtccctttacccgtttacgtaccggttacgggtaccggggg

SEQ ID NO: 190995 - DNA, 882 bp, Homo sapiens
  misc_feature: GYAE6OF01B34YC.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtcgctcacctccgaggtcacaacgtggtcgacgacggtcgtggggactaggaacggtaggaagaacggtccggtcggggtcctagaggttacggtaacggtttccgagacgaaggtctagttcgtaggtacttaccaccttaccgaccgacggaccaacctaattgacgcgtacggttgggccgaaccggacgaccccgggtaccccgaaagaacggtaccgtttagggaaggtaccgggtaaggttacgggtaaacgttaaactaacccggtaaaacccgttaaggtaacggttacgggtaaacggaaccgtaaccggttaaccgaaccggtaaccgaacggtaacgttaaacgggttacccggaagggttaccgaacggtacgtcccggaacgtacggaaccgggacccggaccaacccggtaccaccggagaacctaaccgtacgtcgtaacgtggttacccggtaaggtcgaaaccggcgggtacccggtataacgggaggtttaacgaacggtaccgtaaccgggtaaccccgtttacccggggttacttttacggttttaaccggacgggaccgggtaaaccgggaaggtaaacggggaaccggggtaaccgttaaacgtaaacccggttaaaccggtttccccgggtttaacttacccccgggtttttaaaccctttagggggaacccggtttaaacccggggggcccgggg

SEQ ID NO: 190996 - DNA, 691 bp, Homo sapiens
  misc_feature: GYAE6OF01ATRG9.42.42.D09.1.454.CMB.1.raw
  modified_base (594)..(594): a, c, t, g, unknown or other
  misc_feature (594)..(594): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccaggtgctcactcccaggtgcaactggtgcagtcgtggggctgaagtgaagagccgtgggcctcgagtgaaggtttcctgcaaggcatcgtggactaccaccttccaccgaggcaccatactgcacgtgggtacgcgacgaccggtcccccgagaacggtacttggacggtggagtagggactaactacccgtaaacccgtaagttacggtacgggtaacggacgtaacggtaccgtaacgaccgaacgtaacgtaaccggttccggaaggggacctaaggtaacggtcccgtaccgaacgtcccgggaacccccgggaacaccggtcccgaacgaacggccaacgtacgtactaacgaggtggtaggtgaacggcgtagggtcgtaggacgtaatcgtacggaaccgtacgtaccggtccgtttacgttttacgnggtaccgcggtaaggtacggagggtaccgtaacgtaaccgtaaaccgttccgtacggttaccctttacccgtttaggccgttaccggtaaccggggg

SEQ ID NO: 190997 - DNA, 849 bp, Homo sapiens
  misc_feature: GYAE6OF01E28ZH.42.42.D09.1.454.CMB.1.raw
  modified_base (596)..(596): a, c, t, g, unknown or other
  misc_feature (596)..(596): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctgggtgggtcttctgcttcctggctgtagctccaggtcgctcacctccgaggtcgacaacgttggtcgcgtacgtcggtcggggtcgtaggaaggtacggaaaggaacggtccggtcggggccttacgtacggttacggttaaacggttttccgtaggtacggaacggtactacgttcggtacggtaactaacccgtaacccgttaccgaacccgacggtacctaaccgtattaacgtccggtaccgtacgggtcggggtaccggaccggtaacccgggacccggaaccccgggaacggaacgggttacggttacggtacgggtagggacgtaacgggtaacttaaccgtaacctaaccgtaagtacggtaggacggtaacgacgtacgacgactaacgtacggtaacgtaccggacggacgtaagtacggtaccggacgtaaccggtaccggaaccccgggtaaccncgggtaacccgaaggaccgtacctaacgtaacggtacctaagacggttaagggttagtacggacggagccggttaggagtaacggtaagtacgaaccggaaccgtccggtacggttaccgttttggttacgacgggacggaacggtaaggaaaccggggtaggtaaccggtaaaccggtaaccgttaaccgtttccggttaccgggtttaccccgtttaacggtttccggtaacgttccgggggtaacccggg

SEQ ID NO: 190998 - DNA, 687 bp, Homo sapiens
  misc_feature: GYAE6OF01B2CB6.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtggtaacggtttcctgacgaaggcgactcgtggtaactaccgtaccttcgaccacggaccaccatatgcacgtggtcgcgacgaccggaccccgacgaaggtactaggagtggagtggaactactacaaccctaagtacggtaggtacgacagacgtacgacgaacgaacgtaacgtacgacgggacaaggacgtccgaccgtacgccgggaacccggacgtaccggtaccgaacggacgaccgaacgacgtacctaacgtagtagggtagttacggacgcggacggtcgtaggtaagtagtagtaacggaccgtacgtacccgggtaccgtttacgttttacgttcggaccggacggaacggtaagggaaagggtacgtaaacgaacggttaaacccgtaccggttcgggtttaacccctttacccggttttacgaaccggttccgggtaaccggggg

SEQ ID NO: 190999 - DNA, 680 bp, Homo sapiens
  misc_feature: GYAE6OF01DO0SS.42.42.D09.1.454.CMB.1.raw
  modified_base (249)..(249): a, c, t, g, unknown or other
  misc_feature (249)..(249): n is a, c, g, or t
  modified_base (472)..(472): a, c, t, g, unknown or other
  misc_feature (472)..(472): n is a, c, g, or t
tcagtgacgtatgtcacgaccggtgctcgatttagacacatacgcagggaaagggggcatcatccaacaaccacatcccttctctacagaagcctctgagaggaagttctcaccatggactggacctggtgggtcttcgtgcttccgtggctgtagctccgaggtgctacacctcccgaggtgaccaacgtggtgcgagtcgtggggctaggagtcgaagacgccgtgggcctgaggtgtaggtttccngacgaggcagtccgtaggactacctacctcaccgagaccacatagcgacgtacggtgggcgaccggaccgaccgggaccccggaagaacggtacgttggacggtaggagtacggaactaactaccgtaaacctaaggtacggtacggtaacgacggggaacacgacgacaacgtaacgacgtacgaggcgacgacgtcgacgaggtacccggaccggtaaccnccggtaccgaacggacgaccgacgtacgtacgtacgaggtacggtagtagacgacggagtacgagaacgtacgtagtaccggaacgtacggtacccgttacgttctttagacggccggaacgagggaccggtaaggaaccgtaacgaaccgttaccgtccggttaccggttactttacccgtggttaccggtaccgggtaacccgggg

SEQ ID NO: 191000 - DNA, 814 bp, Homo sapiens
  misc_feature: GYAE6OF01EZXT4.42.42.D09.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctggaagtagaagaagccgtggggcctnagtgaaggtttccngcaaggcatcgtggactaccaccttcaccgaggccaccatatgcacgtgggtgccggacggaccgggacccccgggaacgaacgggtaccgttaggacggtagggacgttacggggaactaacgtaccgtaaaacccgttaaagttacgggttacgggtaacggaacgtaacggtaaccgtacggaccgtaaaccgtaacggtaaaccggtttacccggaaacggggaccgtaacgggtaaccggttaccggaaccccgtaacggttaaccccggggaaacccccggggtaaccgtaaccccgggtaccccggaaacccggaaccgtaacccgaaaccgtaacggttaaccttaaccgtaacggttacgggtaacggtttacggacggtaccggtacgggactagggtaagtaacggttaacggtacgggtaaccggaccggttacccgggtaccggttttacttttaaggtaccggtacggacggtaagggtaacgggtaaagggtacgtaacgacgtaaccgttcggttaccggttcctttaccgtttacggtaccgtacgggtaccgggg

SEQ ID NO: 191001 - DNA, 730 bp, Homo sapiens
  misc_feature: GYAE6OF01CMSV3.42.42.D09.1.454.CMB.1.raw
  modified_base (188)..(188): a, c, t, g, unknown or other
  misc_feature (188)..(188): n is a, c, g, or t
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtncagtcgtggggctggaagtgaagagccgtggggcctgagtgtaacggtttccngacaaggcatcgtaggactaccnccttacaccgaggccacctatagtcgactacgtgggtcgaccggaccgacccggcccccggaagtaacggtacctttggaacggtggagtacgggtaaactaacgtaccaaaccgttaagtacggtaggtaacgaactaacggtactaacgaccgaagaacgggtaacttaccgggaagggtacaacgggtacgtacgacctacggtaccgggaacccgggaaccgtaccgtacccgaaacggaccgacgtaaccggtacgtaccgtaacgtaaggtcggtaaggtttacggaacggaccgtacgggtacgtaaggtaaccgtaagttacgtacggaaccgtacggtaccggtacgtttaccgttttagtcgaccgggtaacggtaaggagggtaacgggacgttaacgaccgtaaacgttcgtacgtttacccttaccgtttacgtaccgtacgggtacccgggg

SEQ ID NO: 191002 - DNA, 866 bp, Homo sapiens
  misc_feature: GYAE6OF01DBSH9.42.42.D09.1.454.CMB.1.raw
tcagtgacgtatgtcacgaccggtgctcgatttagacacatacgcagggaaagggggcatcatccaacaaccacatcccttctctacagaagcctctgagaggtaaagttcttcaccatggactggacctggtgggtcttctgcttccgtggctgtacgtctccgaggtcgcctccacctccccgagggtcgactaaccgttggtacgcgtacggtcggtcggggtctaggaaggtacggaaacggaacggtcccgggtaccgggggtcccttacggtaaggttacgggtaaccgggttttcccgaggaccgaaacgggtctacgttccggtaaggtaacctacccgtacccttaccgaaccgaccggacccaacctaagtacgtcgccgtaacggtcggggtaccggaaccggaaccggaccccggggaacccccggaaacggtaaccggtaacggttggaacgggtagggtaacgttacgggaaaccttaaccgtaaacccgtaaacccgttaaggttaggggtaacggtaacgaaccggtaacgtaaccggtaccgaaacgtaaaccggaacggttaaccgtaccgggaggaccgtaacggtacgtacccgacgtacggtaccccgaaccgggtaccgacccgtaccgaacgtaccacgtacgcgttaccgtaagtcggtacgggtgtacggcgacgtagggacgtaggataaacggtcgtaacggaacccggacggttacccggttccgtttacggttacgtcgggaccgggtaaagtaacgggaacggtaagggaacgtactaaccggtaccgtcggtttaccggtaccctttacggtttacgcgggttacccgggacggg

SEQ ID NO: 191003 - DNA, 782 bp, Homo sapiens
  misc_feature: GYAE6OF01DD3UN.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcactcccaggtgcaacgtggtgcagtcgtggggctgaagtgaagaagccgtcggggcctcgaggtgtaacggtttccgtgacgaaggctagtcgtaggaactaccacccttccgaaccgacggaccaaccattagtcgacgtacgtggggtcgaccggaccgaaccggacccccggaagaaggtacgtggaggtaggagtacgggaactaactaccaaaccgttagtaacggtaggtaacggaccgaagtaaccgtacgtaccgaacgtagtaacggttccgaagggtacgaaggtaccgtaccggacccgtaacggtacccgggaacccccggggtacaacccgtacccgaacggacgaaccgtaaccgtacgttaccctaaggtaacggtcgggtaaggtttacggacgggacgtacgggtaccgtaagtaaccggttaagtaacgggtaccggaaccgaacccggtacccggttccgttttacgttttaacgtcgggaccgggtaggaaaccgggtaagggaaacgggtaacggtaaacggtaaccgtaaaccgttcccggtttacggttaccttttacccgtttagggtaccgttccggggtaaccgggg

SEQ ID NO: 191004 - DNA, 732 bp, Homo sapiens
  misc_feature: GYAE6OF01ECIFX.42.42.D09.1.454.CMB.1.raw
  modified_base (242)..(242): a, c, t, g, unknown or other
  misc_feature (242)..(242): n is a, c, g, or t
tcagtgacgtatgtcacgaccggtgctcgatttagacacatacgcagggaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctggaagtgaagacgccgtggggccctgagtgtaacggtttccngacgaggcatcgtggataccaccttcaccaggaccaccatatgctacggtgggtcgacgaccgacgggaccccggacgaacggtacttaggacgtaggagtacgggtaactaacgtacccgaaacccgtaagtaggtaggtaacggaacgtaaggaccgtaccgaccgtaacgaacggtaacgttacccggacggggtacaacgggtaccggtaccggacctacggtaccgggaaccccgggtaaccgacccggtaccgaaccgtacgaccacgtacggtacctacgtaggtacggtagttggaacgtcggaagtcgtagaagtacgttacgaccggacggtaccgtaaccggtcccgttttacgtttacgtcggtacggacggtaaggaacgggtaaggggtacgtaaaccgaacggtaaaccgtcccgggtttaccggtttacccgtttacccgtttacggttaacccggtcgggtaaccccgggggg

SEQ ID NO: 191005 - DNA, 613 bp, Homo sapiens
  misc_feature: GYAE6OF01ATANP.42.42.D09.1.454.CMB.1.raw
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
tcagtgacgtatgtcacgaccggtgctcgatttagacacatacgcagggaaagggggcatcatccaacaaccacatcccttctcgtacagaagcctctgagaggaaagttcttcaccatggactggacctggtcgggtcttctgcttcctggctgtagctccaggtgctcactcccaggtgcaactggtgcagtcgtggggctgaagtgaagaagccgtgggcctcagtgaacggtttccngacaaggcatctggatacgaccttcaccaggcaccgatatgcacgtgggtgcgacacggcccccgganaaggactggacgtggatgggactaatccaaccctaatagtaggtaggacaagactacgcacagaacgttaccgagggacagagcgaccgagtacgacccggacacgtccacgacgcgacacgtctaacagtacggagttggacgtcgaggtcgtagaacgatacgtaggaaccgtaccggaccggtcccgtttacgttttagtcggtcgacggtacggaacggtaaaggggaggttaaccgaacggtaaacctcccggtacggttacccttacccgtttttcgaaccgttacggttaccggggg

SEQ ID NO: 191006 - DNA, 779 bp, Homo sapiens
  misc_feature: GYAE6OF01BQOCG.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctaggaagtggaagaagccgtaggggcctcgagtaggtaaggtttcctgacgaaggcatcgtggatacaccttccaccgaggcaccagtatgcacgtgggtcgacggacgacgggcccccggaacgaaggtacttggaggttggaaggtacgggaacttaactaccgtaaacccgttaagtacgggttacgggtaacggaaccgtaagggtacctaaccggtaccgaaccgtaaggtaaacggttacccggaaggggtaccaacgggtaacgtcggaccccgtaggtacccgggtaaccccgggaaccgtacccggtaccgaaaccgacggaccgaaccaacgttactaccgaggtacggtagttagacgtacggacggtcgtagagtaagtacgttacggaaccgaccggtaaccggtccgtttacgttttaacgtcgggtaccgagggtaacgggtaaacgggaagggttaacggtaaacccgtaaacgggttaaaccgttaccccggtttacggtttaccccgttttaaaccccgttttacggtaacccggttaaccgggttaaccccgggggggg

SEQ ID NO: 191007 - DNA, 581 bp, Homo sapiens
  misc_feature: GYAE6OF01BX1K3.42.42.D09.1.454.CMB.1.raw
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctnagtgaggttccngcaaggcatctgatacaccttcaccaggcaccatatgcacgtgggtgcgacgaccggcccccggacaagggacttgaggtggagtggggaactaatccaaaccctaagtagtaggtaggacagcctagcacagagtcgaggcagngtcgcagtcgaccggacacgtccacgagcacacgtctanagtggagttgagcacgggntggagatacgtgaaccgacgtaccggtccgtttacttttcgttagccggtacggaggaagggtaagggacgttaaagaaccggtaaaccgttcgttaccgggtactttaccccgttttacggtaacgttcccgggtaccggggg

SEQ ID NO: 191008 - DNA, 703 bp, Homo sapiens
  misc_feature: GYAE6OF01DKVTJ.42.42.D09.1.454.CMB.1.raw
  modified_base (82)..(82): a, c, t, g, unknown or other
  misc_feature (82)..(82): n is a, c, g, or t
tcagtgacgtatgtcacgaccggtgctcgatttagacacatacgcagggaaagggggcatcatccaacaaccacatcccttntctacagaagcctctgagaggaaagttcttcaccatggactcggcctggtgggtcttctgcttcctggctgtacgctccgaggtcgctcaccgtcccgtaggtcgctacgtggtgcgcgtcgtggggctaggagtgaagacgccgtcgggcctgtagtggtacgtttccagcgagcatcgacgtactactacctaccgacgacgacctactagtacgtacgcgtacggtcggtacgaccggaccggaccgggacccggtaacggtacggtacgtaggtacggtaggtacgtacggtaacgtactaccgtaacgtaggtacggtacggtacgacgtacgacgacgacgtacgtacgtacggggggtacaggacgacgtcgacgacgacggtaccggaccggtacgtaccgacgacgacgacgtacgacgtacgtagtaggtcggtagtcggacggacgtaggtacgtagtaacgtacgtacggtaccggtacgtacgttacggttcgtttagttacggtcggtacggacggtacggtaacggtaacggtaaccggtaacgtaccgttaccgttaccggttaccgttaccgtttaccggttacggtaccggtcgggtaccggg

SEQ ID NO: 191009 - DNA, 679 bp, Homo sapiens
  misc_feature: GYAE6OF01BNBNB.42.42.D09.1.454.CMB.1.raw
  modified_base (241)..(241): a, c, t, g, unknown or other
  misc_feature (241)..(241): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccaggtgcaactggtgcagtcgtggggctgaagtgaagaacgccgtggggcctcgagtgtaaggtttccngacgaaggcatcgtggatacaccttcaccaggccaccatatcgcacgtggtgcgacgaccggccccggagaacggtcttgagtggagtacgggaactaactacctaaaccctaagtacggtaggtaacgacagtaactacgacaacaggaacgttaccgagggacaggtaccggtacgaccgtaagtccgggaacccgggtacgacccgtacggacccgacgaccgaacgacgtacgtacgaaggtaggtacgtaggtacgacggacggtacgtacgtaaggagtaacgtacggaacgtacccgtaacgggtcccgttttaacgtttgtaggcccggtacggaaggaagggtaaacgggagggttaaaccgaaacgtaaacccgttacgtccggttaccccggtttaccgtttacgtacgtacggttaaccccggggg

SEQ ID NO: 191010 - DNA, 909 bp, Homo sapiens
  misc_feature: GYAE6OF01BHRUZ.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcacctcccgaggtcgcaacgtggtcgctagtcgtggggctaggaagtgaagacggccgtgggcctagagtaggtacggtttccgtggacaaggctagtcgtaggtactacctacccgttcaacccgacggaccaacctataacgtcgacctacggttcggggtacgaccgaaccggaccccgggaccccccgggtaacgaaaccgggttacgttagggtacggtacgggtaacggttacggggtaaacctttaacgtaacccgttaaaacccgttaaggtacgggttaacgggtaacggaaccgtaacggtaaaccgttaaccgacgaaaccgtaacggttaaaccggttacccggaacgggtacctaacgggtaccggttacccggaacccgtaagggttaccccgggaaacccccgggtacccgtaaccggtaccccgaaacccgggtaccgaacccgtaaccgttaaccggttaaccccgtaacggtaagggtttaccggggtaacgggtttagaacccggtacggttaccgggtacgttaaggaacggttaacgtaggtacccggaaaccggttacccgggtaaccggtttccccgttttttaagttacggaccggtaccgggtaacggaaacggggtaagggtaaacgggtacgtaaaccgtaaacggttaaccccgtcggttacccgggtttacccttttacccgtttacggtaaccgggtacccgggtaaccgggg

SEQ ID NO: 191011 - DNA, 724 bp, Homo sapiens
  misc_feature: GYAE6OF01BYFN9.42.42.D09.1.454.CMB.1.raw
  modified_base (246)..(246): a, c, t, g, unknown or other
  misc_feature (246)..(246): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcacctccgaggtgcacgtggtgctagtcgtgggctagagtacgaagacgcggtgggcctgagtagtaacggtttccgngacgaaggctagtccgtggtaactacctaccttacgaccgacggcctaaccgtagtagtcgacgtacggttggggtacgaccggaaccgacccgggtacccccgaaggtaacggtcgtttacgggaacggtggtaacggtacgggtaaccttaaacgtaccgtaaacccgttaaggttaacggtacggtaacgaacgtaacggtaccgtaacgacgaacgtaacggtaacgtacccggagggactacggtcgtacccgtcgtaacggtcccggaaaccggaccgtaccggtaaccgaggtaaccgtacgaacgtacgttacctaagtcggtaagtaggttagacgtagacggtctaaggtaactagtacgtcggaaccgacgttccggtctttacgtttgcggacgacgtaggaggtacggtagtacgacgtaaccgtcgttacgttcgttacccgttaggaccgttcgggtaccggg

SEQ ID NO: 191012 - DNA, 739 bp, Homo sapiens
  misc_feature: GYAE6OF01BMTAC.42.42.D09.1.454.CMB.1.raw
  modified_base (252)..(252): a, c, t, g, unknown or other
  misc_feature (252)..(252): n is a, c, g, or t
  modified_base (547)..(547): a, c, t, g, unknown or other
  misc_feature (547)..(547): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcaggtcgtggggctagaagtgaagaacggccgtggggcctacgaggtaggtaacggttttccngacaaggctatcgtaggactactacctacaccgaggccaaccgatatcgcgtacgtgggtcgcgaccggaccgggaccccggaacgaacgggtacgttacggaggtgggtagtacgggtaacgtaactaccgaaccttaagtagggtaggaaggacagtaactacgacaagaacggtacgtacgagggacgaaggacggtccgaccgtacgtacccgggaacccgggacctaaccggtacccgaaccggaacgaccacgtacgtactaacgacggttaggtggtaggacggacgngggtacgtaggagttagtacgttacgggaacctaccggtaccgggttaccgttttactttacggtacggtccggaaacgggaggtaaacgggaagggtaaacggtaaccgtaaacggttaacccggttaccgttccgggtttacccgttttacccggtttaacggtaccggttcccgggggtaaaccggggg

SEQ ID NO: 191013 - DNA, 845 bp, Homo sapiens
  misc_feature: GYAE6OF01EJFG1.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagctccgaggtgctcactcccgaggtgaccaacgtgggtcgacgtacgtcgtggggtctaggaagtaggaaacgacggtccgtggggcccttaggtagtacggttaacggtttccgtagacggaacggtactaacgttcgtaggtactacctaccttaccgaaccgacggacctaactaatacgtacgaccgtacggtcgggtaccggaccggaaccggacccggggaaccccggtaacggtaaccgggtacgtagggtaacgggtacggtacggtaaccgggtaactaaccgtaaccgtaaaccgtaaggttaacggtaacggtacggaacgtaacggtaaccgaacggtaacgtaaacgtaacggtaacggtaccgggacgggtaacgtacggtaccggtaccggtaccgtaaccgggtacccgggaaccccggtaacgtaacccggtaaccgaacggaacgtaccgtaacgtacgtacgtaacggtacggtacgggtacggtacggacgacggtacggtagtaacgaagtacgtacgtacggaaccggtccgtaccgggttacgtttacggtacggtacgggacgtaagggtaacggtaaagggaagtaacggtaacggtaaaccgttaaccgttcggttaccggtttacccgtttaccggttacggtaaccggtcggggtaacggg

SEQ ID NO: 191014 - DNA, 666 bp, Homo sapiens
  misc_feature: GYAE6OF01C0NSH.42.42.D09.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagctccgaggtgctcactcccaggtcgcaacgtggtgctagtcgtggggctgaagtgaagagccgtgggcctagagtgtaacgttcngacaaggntatcgtaggtaatacctaccttcaccgaacggaccacctaatactcgcgtacgtgggtcgaccgaaccgaacccgggcccccggaacgaaacgggtcgttaggagggtggaagtcggggaaacttaacaccgtaaaaccgtacgtaaggtacggtaagaaccgaagaccgtacgactaacgaagtacgtacgacgggcaagtacgccgccagtacccggacccggtaacgacgtaccgaacgaacgacgtaaccgagtacctaacgtaggtaggagttaggacgtacgagtgacgaagtactaggacgtacgacgtacggtacttcgttagtcgcgaagtacgggaaagtagggtactaaacgaacgttaaccgttcgttagttacccgttacctttacggacgtgggtaaccggg

SEQ ID NO: 191015 - DNA, 689 bp, Homo sapiens
  misc_feature: GYAE6OF01C1LUG.42.42.D09.1.454.CMB.1.raw
  modified_base (159)..(159): a, c, t, g, unknown or other
  misc_feature (159)..(159): n is a, c, g, or t
  modified_base (173)..(173): a, c, t, g, unknown or other
  misc_feature (173)..(173): n is a, c, g, or t
  modified_base (187)..(187): a, c, t, g, unknown or other
  misc_feature (187)..(187): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (336)..(336): a, c, t, g, unknown or other
  misc_feature (336)..(336): n is a, c, g, or t
tcagtgacgtatgtcacgaccggtgctcgatttagacacatacgcagggaaaggggcatcatccaacaacacatcccttctctacagaagcctctgagaggaaagttcttcaccatggactggactggtggtcttctactctggctgtagctcgaggtnctcactccgaggtncatgtgctagtcgngggctagaagtgaagtaggccgtggggcctntagtagtacgtttcngacaaggctagtcgtaggaactaacctacccttacgaccgacggaccaacctaattaagtcgacgtaacggtggacgccgtaaccggaccggaccccggtaanacggtactagaggtaggacgtaaggtaacctaaacgttaccaaaacgttaagtaggtaaggtacggaacagtaacacgtacaaagtacggaacttaccggaggaccttaggaacgtccgaacgtacgaaccggacccggtaactaccgaggaacccgagaccgtaacgtactacctgtacggtaagggtactggaacggctaagggtataggtaacgtatacgaacgtaccggaccggtaagttcccttttagtttacggacgtccggaacgaaggtaacggaagggttacaacgtaaactaaccgtcgttaagtcccgtttaaacgtttgaaacccgtgggtcggaaaccgg

SEQ ID NO: 191016 - DNA, 685 bp, Homo sapiens
  misc_feature: GYAE6OF01CA78U.42.42.D09.1.454.CMB.1.raw
  modified_base (196)..(196): a, c, t, g, unknown or other
  misc_feature (196)..(196): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgnggggctgaagtgaagagccgtggggcctcgagtgtaacggtttcctggcaaggcagttcgtggatacgaccttccgaccaggcaccatatgcacgtggtcgcgacgaccggccccgagaacggtacgtgagtggagtcgggactaacgtacctaaacccgtaagtacggtaggtaacgacgagaactaccgacacgaacgtaacgtccgagggcaaggacgtcgaccgacgtcggacccggacgaccgtaccgacggacgaccacgacgtcctaacgtagtacgggtattaggtacgcggtacggtcctaggaaggtagtaacgtggaaccggtaacgtaaccgggtcccgtttaacgttttagtccggtacggtacgggaaaggtacgggtaaagggtaaccggtaacgtaacggtaaaccgttacccggttacggtttaccccgttaccggtttttacggaacccgtttccggggttaacccggggg

SEQ ID NO: 191017 - DNA, 614 bp, Homo sapiens
  misc_feature: GYAE6OF01B8BGQ.42.42.D09.1.454.CMB.1.raw
  modified_base (290)..(290): a, c, t, g, unknown or other
  misc_feature (290)..(290): n is a, c, g, or t
  modified_base (478)..(478): a, c, t, g, unknown or other
  misc_feature (478)..(478): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcgagtcgtggggctgaagggtgaagaacgccgtggggcctcgagtaggtaaggtttcctgacgaaggcatcgtggataccaccgttcaccaggccaccatangcacgtgggcgcgacgaccggccccggagaaggacttgagtggagtgggactaagacaacccgtaataggtggtacgacagtactacgacacagtaacgtcgaggacagacgtcgacacgtcggacccgggacaccggtaccgacgacgacaacgagtaccgactagtggtagttagacgcgacggtntagaagtagtagtacggaacgacgaccggtcgtttactttagtcgaccggaggaggaagggtaagggaacgtaacgtaacggtaaaccttccggtacgtttacccgttacctttacggtagtccgggtaccggggg

SEQ ID NO: 191018 - DNA, 699 bp, Homo sapiens
  misc_feature: GYAE6OF01AYJPM.42.42.D09.1.454.CMB.1.raw
  modified_base (548)..(548): a, c, t, g, unknown or other
  misc_feature (548)..(548): n is a, c, g, or t
  modified_base (564)..(564): a, c, t, g, unknown or other
  misc_feature (564)..(564): n is a, c, g, or t
  modified_base (611)..(611): a, c, t, g, unknown or other
  misc_feature (611)..(611): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtaggggctgaagtgaagaagcctggggcctcagtgaacgtttcctgacaaggcagtctaggactacctaccctttacaacccgagggacccaacctaagtacgtcgtaccgtacgtcggggtcgaccgaaccggaccgggaccccccggaacgaaacgggtaccgtttacgaagggtacggagtacggggtaactaacgtaccgtaaaacccgttaaagtacggtaggtaacggaaccgaagtacccaacgaccaacgtaaggaacgtttacccgaagggaccaacggtacgacccgacgtacgtaccggacccgggaactaccggtacccgaacgacgaccaacgcgttaccnaggttcgagttggacncgagcgtagacgtagtatacgacgaacgtcgggtccttacgttttancgtcgacggaagtacgaagggacgtaacgaacgtaaacccgttccgtacgttaccctttaccggttaacgttcgtacgggtaccgggg

SEQ ID NO: 191019 - DNA, 805 bp, Homo sapiens
  misc_feature: GYAE6OF01BQR5B.42.42.D09.1.454.CMB.1.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcacctcccgaggtgcaacgtggtgcagtccgtggggctgaagtgaagaacgccgtggggcctacagtcggtaacggtttccnggacaagggctacgtccgtagacgtacctacccttacaaccgagaccacctatagtacgccgcgtcggtcgccgaccgaccggaccccggacgtaacacgggggggggggttanaggtacggtaggtacgggtaacttaacgtaccgtaaaccgtaacgtacggtacgggtaacggtaacgacgtaacccgtaccggaaccgtaaccgaaggttaaccggtaccggaacgggacgtaacggtacggtaccgaccgtacggtacccgggaacccgggtacccgtaccggacccgtaccggaacgacgaaccgtaccggttacctaaccgtacggtaggttacggttaggtaacggaccggtaacgggtacgtaggtaacgtaacgttaacgtacggtaaccggtaaccggtacccgggtttcccgttttacgttttacggtacggtaccggaaccgggtaagggtacgggtaacgggtaacggtaacggtaaaccgtaacgttaccgttaccggttaccgtttacccggtttacgtaccggttacgggtaccgggg

SEQ ID NO: 191020 - DNA, 796 bp, Homo sapiens
  misc_feature: GYAE6OF01C3FIS.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagcctccgaggtgctcacctcccgaggtgcacgtggtcgcaggtcgtggggctaggaaggtagaaaggacgccgtcggggcctacgaggtggtaacggtttccgagacgaaggctagtcgtaggtaactaaccgtaccttccgaaccgacggaccaaccatactcgacgtcgggttgggacgacgaccgacccgggccccggaacgaaacggtcgtggacggtaggaggtacgggtaactacgtaactaaaccttaagtacggtacggtaagacgaacgaacgtacgacgaacgaagtaacggttaccggagggacgaagtaccggtaccggactaacggtacccgggaacccggaccgtaccgtacccgaacggaccgtaacaccggtaactccgtaagtggtacgggtagttacggacgacgggagggtcgttaagggaacgttaacgtaagttaacccgggaaccggggtacccgtaacccgggtttaccgttttaaccggtttttacgttacgggggaccccgaagggtaaacgggtaaaaggggtaaacgggtacggtaaaccgtaacgggtaaaccttccggttacggttacccctttacccgggtttatacccgggtttacgggaacccggggg

SEQ ID NO: 191021 - DNA, 756 bp, Homo sapiens
  misc_feature: GYAE6OF01ED3V3.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcactcccaggtgacaacgtggtgcgagtcgtggggctaggaagtgaagaacgtccgtgggccctagaggtaggtaacggtttccgagacgaaggtcatcgtaggactaccgtaccttccaaccgacggaccacctaatatacgctacggtcgggtcgaccgaaccggacccgggacccccggaagaacggtacgtaggaggtacggtagtagggaactaactaaccgtaacccgtaagtaggtaggtacgaacgtacggaacctacgacaacgtaagtaacgtaccggagggacgaagtacggtaccacgacgtaccggacccggactaccggtaccgaacgcgacaacgtcgtaccgtaagacggttaggtacgtacggacgacgtagggacgtagtaaacgtacgttaggaacccggtaacggaaccggttacccgggtacgttttacggttttacgacgggaccggtaacggaagggttaaacgggaaacggggtaacgttaaaccgaaacggtaacccggtttaccgttacgggtttaccccttttaaccggtttaccggtacggttacccggggtaacggggg

SEQ ID NO: 191022 - DNA, 895 bp, Homo sapiens
  misc_feature: GYAE6OF01DSR73.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgctaacgtggtgcagtcgtggggcgtagaagtgaagacgccgtgggcctgagtaggtaacggttccgtgacgaaggtctacgttcgtaggtaactaaccctaacccttaccgaacccgtacggtacccaacccttaattaacgttacgacctaacggttcgggggttcggaccggaaccggaaccccggggaccccccgggaaggaaaccggggtttacgttcgggtaaggggttacgggtaaggttacgggtaaaccgttaaccgttaaaaccccgtaaaaaccccggtttaaggttaaacgggttagggtaaaaccggtaaccggtaaacggtaacccgtaacccggtaacgaaaccgtaaacggtttaaaccgtaccccggggaagggttaccggaagggtaaccggtaccgtaccggtaagtcccgggaaaccccgggtaccgacccggtacccgacggacgtaccaacgtcgtaccgtacgtaagtacgggtagttacggaggtaccgtggtcgtaagtagtaacgttaacgtaggaaccgacccggttaaccgggttccgtttttacgttttaagggcccgttacgggtaacggaacgggtaaagggtaaacgggggttacttaaacccgggaaacttaacccggttaccgtttaccggttttaccccggttttccgtttaacggtacccggtttacggggtaacccgggg

SEQ ID NO: 191023 - DNA, 848 bp, Homo sapiens
  misc_feature: GYAE6OF01DD1O8.42.42.D09.1.454.CMB.1.raw
  modified_base (406)..(406): a, c, t, g, unknown or other
  misc_feature (406)..(406): n is a, c, g, or t
  modified_base (462)..(462): a, c, t, g, unknown or other
  misc_feature (462)..(462): n is a, c, g, or t
tcagtgacgtatgtcacgaccggtgctcgatttagacacatacgcagggaaaggggcatcatccaacaaccacatcccttctctacagaagcctctagagagaaagttctcacatgactgacgtggtggtcttctgtccttccgtggtctgtacgcctcgaggtcactccacgtccgagtcgcgaacgtggtcacgtggtcggtggggcttaaggaagtacgaaacggtacggtccgggtcggtacctgtaacggttacggttaaccgttccgacggacggaacggtctcgtacggtacggtaactaccctacctaccgaaccgactactaacctgtacgtcgacgtccggtaggccggaccggaccgtaccccgggaacctaacggtaacgtggtggttaacggngttacgtaacggtaactacctaaccggtaacgtaagggttaacggcggtaaaccgngttaacccgtaacgcccgtaataaacggtacggtaaactacccgggaggtaacgaccggtaccgacggacgaaccggtacccgggaacccgtaacctaccggaccgaacgtacgaaccgtacgtacggtacgtaaacgtcggtaacggttagggtaacgtcgaacgtacggtaggaacggttaattacgggtaccgaacggtaacccgggttaccgtaaccgggttttaccgtttcgggttaaacggttcgggaaccggaaagggtaaccgggtaacggggtaaaggtttaacccggtaaggttaaaaccggttacccgtttacgggttaccgtttaacccgggttttaccggtaaccggttaccgggtcggggttaaacccgggg

SEQ ID NO: 191024 - DNA, 717 bp, Homo sapiens
  misc_feature: GYAE6OF01BSU0D.42.42.D09.1.454.CMB.1.raw
  modified_base (188)..(188): a, c, t, g, unknown or other
  misc_feature (188)..(188): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtncagtcgtggggctagagtgaagagcgtgggcctgagtgtaacggtttcctgacaaggcatcgtggtataccgtaccttcaccaggccaccatatgcacgtggtcgccgaccgaccggacccccggaagaacggtacttacggaggtaggtacgtagggtaacctaaactacccgtaaacccgttaagtaggtacgggtaaggaaccgaagtaaccgtaacggactaacgaacgtaacggttcccggaagggaccaaggacggtaccgtacctaggtaccgggaacccccgggaccgtaacccggtcccgaacggacggacctaaccgacggttaccgtaactaaggtcgggtaagttgacggacgtagggacgtagaaggtacgtagtacgaccggtacggccggttacgtttacgttttacgtggtaccggacggtaagggtaacgggaagggtaagtaccggaaacggtaacccttcgggttaccttaccccgtttacgtttaccgtacggtaccgggtaccggggg

SEQ ID NO: 191025 - DNA, 807 bp, Homo sapiens
  misc_feature: GYAE6OF01BD2OB.42.42.D09.1.454.CMB.1.raw
  modified_base (178)..(178): a, c, t, g, unknown or other
  misc_feature (178)..(178): n is a, c, g, or t
  modified_base (208)..(208): a, c, t, g, unknown or other
  misc_feature (208)..(208): n is a, c, g, or t
  modified_base (623)..(623): a, c, t, g, unknown or other
  misc_feature (623)..(623): n is a, c, g, or t
tcagtgacgtatgtcacgaccggtgctcgatttagacacatacgcagggaaagggggcatcatccaacaaccacatcccttctctacagaagcctctgagaggtaagttcttacaccagtggacgtcggaccgtggtgggttcttctgtccttccgtggtctgtacgcctcgaggtcnctccaccgtcccgaggtcgactacgtggtncgtagtcggtgggctaggaacgtagaacggacggtccggtacggggtccttacgtagggttacggttaacggtttccgtaggaacggtaggctagtacgtacggtactacccgtacctaccgaaccgcgaccctatatcgacgaccggtacggtggtaccgaccggaccggacccggacccggaaggtaacggttacggtaggacgggttaggaacggttacgggtaactaaccggtaacctaaacggttagtacgggtaggtaacaccggagaccggtacaaccggtaacgtaagtaaccggtaccgggaggtaactacgggaccttaccgggaaccgttaacggggaccccggtaacccggaccgtaccgggtaacccgacgtaccgacaaacggtcgtaacgtagtacgggngttacgagtcggacgtaaggcgttaagagtacgaacggtaggacccgttacgtaccggttacctttgttacggtccgacgggtaacgggaggtaaaccggggtataacgggtaaccctaacgggttacccttcgggttaaccttcccggttttaaggacccggttacgggaacccggtacgggg

SEQ ID NO: 191026 - DNA, 707 bp, Homo sapiens
  misc_feature: GYAE6OF01DIW6A.42.42.D09.1.454.CMB.1.raw
  modified_base (191)..(191): a, c, t, g, unknown or other
  misc_feature (191)..(191): n is a, c, g, or t
  modified_base (248)..(248): a, c, t, g, unknown or other
  misc_feature (248)..(248): n is a, c, g, or t
  modified_base (333)..(333): a, c, t, g, unknown or other
  misc_feature (333)..(333): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcacctcccaggtgcaacgtggtncgagtcggtggggctagaaggtgaagaagccgtggggcctcgagtgtacggtttccngacgaaggcatcgtagtactacctaccttccaccgacgccaccatagtgacacggtggtcgaccgaccgaccgggaccccggaanaacggtactggaggtaggagtacggtaactaactacctaaccgtaagtaggtaggtacggacgaacgtaccgtacgactaacgaagtaacgtccggacgggacaaggtacgtaccgaccgaggtacccggacccgggtaccgaccgtacccgaacggacgtaccgaacgtacgttacctacgtacggtaggtacggttacggacggacgaagggtcgaaggtaagtaacgttaaggtacggaaccgtaaccggtacgggtttaccgtttacgtttaccgttgggaccgtacgggaaggtaaacggggaaggtacgtaaacggaacgtaacctcgttaccggttacctttccgttacgtccgtcgggtaaccggg

SEQ ID NO: 191027 - DNA, 732 bp, Homo sapiens
  misc_feature: GYAE6OF01AX03P.42.42.D09.1.454.CMB.1.raw
  modified_base (172)..(172): a, c, t, g, unknown or other
  misc_feature (172)..(172): n is a, c, g, or t
  modified_base (627)..(627): a, c, t, g, unknown or other
  misc_feature (627)..(627): n is a, c, g, or t
  modified_base (638)..(638): a, c, t, g, unknown or other
  misc_feature (638)..(638): n is a, c, g, or t
tcagtgacgtatgtcacgaccggtgctcgatttagacacatacgcagggaaagggggcatcatccaacaaccacatcccttctctacagaagcctctgagaggtaaagttcttcaccatggactggacctggtgggtcttctgccttccgtggctgtacgcctccgaggtcncctcacctccgaggtcgactacgtggtcgcgacggttcggtcggggtctaggtaaggtagaacggtaccggccggtacgggtcctacggtaggttacggttaacgtttcccgagaccgtacggtctacgtcggtaggtaccttaacctacccgtaccgaccgacgtacctacgagtacgtcgccgtacggttggtaccgaccggaccggacccgggaaccccggtaagtaacggttccgtagggtcgggtaacggtaacggttaccgggtaaacttaacccgtaacccggtaaaccggttaaggttaacggggtacggtaacggtaaccgaggtaacccgtacgaccgtaacggtagtaccggtacggacggtcaacggttcgaccgacgtcggtacccgggacccgtacacccggcgaagccgacacgtacgtccaaggtgtaggtacgtgcgngtacgcgtaanacgttacgcgtacgccgtacgtcgttactgtgcgacgaagcgtaggacgttcaacgtacgtccttcggtactccgttagtcgtacgtcggacgg

SEQ ID NO: 191028 - DNA, 860 bp, Homo sapiens
  misc_feature: GYAE6OF01C0GIY.42.42.D09.1.454.CMB.1.raw
  modified_base (165)..(165): a, c, t, g, unknown or other
  misc_feature (165)..(165): n is a, c, g, or t
  modified_base (667)..(667): a, c, t, g, unknown or other
  misc_feature (667)..(667): n is a, c, g, or t
tcagtgacgtatgtcacgaccggtgctcgatttagacacatacgcagggaaagggggcatcatccaacaaccacatcccttctctacagaagcctctgagaggaagttcttcaccatggactggacctggtgggtcttctgcttccgtggctgtagctcgaggtnctcacctcccgaggtcgacacgtggtgctaggtccggtggggctaggaagtaggaaaggaacggccggtcggggcctacgtaggttaggtaacgttttccgacgacgaacggctacgtcgtacggaaccttacctacccttccgaaccgaggacctaacctatacgtcgacgtacggtcggggtcgacccggaccggaacccggggtacccccggtaacggaaacgggttaccggttagggtacgggtacgggtaggttaacgggtaaccttaaaccgtaacccgtaaaacccggttaaggtttacgggttaagggtaaacggacgtaaacggtaaccctaaccggaacgtaacggtaacggttaacggtaccggagggtacgaaacgggtcggtaacccgtacgtacggaaccccgggaacccgggtacgtaaccccggaccgacggaaccgcctaaaccgggtactacgtaacgtacgggtaggtacgttaggaaccggnggtacggtcgtaagtaaggtacgtaacggtaccggtaacggacccgtttaacccggggtttactttacggtttaggtacccgggcgggtaaggaacgggtaaacggggggaaacgtacggtaacgaaaccgggttacccgtttccgtacggtttaccctttcccggttaaggtcggtaccgggttaccggggg

SEQ ID NO: 191029 - DNA, 759 bp, Homo sapiens
  misc_feature: GYAE6OF01EZBZH.42.42.D09.1.454.CMB.1.raw
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggaccctggtgggtcttctgcttcctggctgtagctccaggtgctcactcccaggtgcaacgtggtncagtcgtggggctgaagtgaagaacgccgtggggcctnagtgtaaggtttcctgacaaggctagtcgtagatacaccttcaccgagcaccatatgactacgtgggtcgcgacgacgggaccccggacgaaggtacttgagtggagtacggactaatacctaaccctaagtagtaggtaacgacgaacgtactacgacaacgaacggtaacgttaccgaagggtacgaacggtaacggttacccggacccgtaagtacccgggaaccccggggaaccgtaaccggtacccgaaaccggtaacgtaacccgaacgtaaccggttacctaacgtaaacgggtacggtaacggttagggtaacggccgtaacgggtcgttaacggaaagtaagttacggtaacgggtaacccggaaaccgttacccgggtaccgttttacgttttacgttaccggacggaaccgggtaaggaacgggtaaaggggtactaacgaaaccggttaaacccgtacccgtttaaccgggttccctttaacccggttttcgtaacccggttaacggggtacccggggg

SEQ ID NO: 191030 - DNA, 767 bp, Homo sapiens
  misc_feature: GYAE6OF01BWL7T.42.42.D09.1.454.CMB.1.raw
tcagtgacgtatgtcacgaccggtgctcgatttagacacatacgcagggaaaggggcatcatccaacaaccacactcccttctctacagaagcctctgagaggaaagttcttcaccagtcgacgtcgtaccgtggtggttcttcgtcgtcttcgtcggtcgtgtacgtcctccggtaggtcgtcctacctacccgtaccgtaggtcgaccgtaacggttggtcaccgtaggtcggtcggggacttaggaagtagaacggtaccgtccgggtcggtcctagtaggttacggttaccgttcgagacgaagtctagtacgacgtactaccgtacctaccacgtacgcctactatacgcgtacgtaggtcggccgacgaaccggtacccgggacccgaagtaccggttagtagtaggaaggtacgtaaggtaacctaacgtaaccttaaaggtagtacggttaaggactaagacgtactacgaacgtacgtaacgtacggtacggagactacggtacgaccgacgtacggtacccggaaccgaccgtaccgtaccgaacgaccgaccgtaagtccgtaacgtagtaaggtacggtagacggacgtaggaccggtagtaacgagttacacggtacgaaccggttacgtccggtttaccgtttacggttccgacgtacgggtaaggttaaagaacgggttaagaaccggtaaccgtaacggtaacgttccgttaccggttacctttacgtacgttacccggtgggtacccggg

SEQ ID NO: 191031 - DNA, 843 bp, Homo sapiens
  misc_feature: GYAE6OF01C03QJ.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcacctcccaggtgcaacgtggtgcaggtcgtggggctgaagtagaagaacgccgtcggggcctcgaggtaggtaacggtttcctgacgaaggctagttcgtaggaactacctaccctttacccgaacccgaacgggcccaaccctaattatcgacgtacggtgggggttcgccggaaccgacccggggaccccccggaagaaacggtaccgttggacggtgggtaacgtcggggtaaacctaacgtaacccgtaaaccccgttaaagttaacggttagggtaacggaacgaacggtaaccgtaaccgacctaacggaacggtaaacggttcccgggtaaagggaccgtaaggaccggttaccggaccgtaacggtaacccgggaccccgggtaacccgtaacccggtacccgaaccggacgacgaaaccgtacgttacgtacgaagttacgggtacgtttaggacggacgaggtcgtaggagtaagttacgtacgacggaaccgtaccgggttccgttaagtttttacggtcgaccgggtaccgaaaggggtaacgggtaaagggtaacggtaaaccggaaaccggttaaacccgttacccggtttaccgggttttaaccccttttacccggtttttaccgggaaaccggtttcccggggttaaacccggggggg

SEQ ID NO: 191032 - DNA, 1021 bp, Homo sapiens
  misc_feature: GYAE6OF01AXG8Q.42.42.D09.1.454.CMB.1.raw
  modified_base (123)..(123): a, c, t, g, unknown or other
  misc_feature (123)..(123): n is a, c, g, or t
tcagtgacgtatgtcacgaccggtgctcgatttagacacatacgcgagggaaagggggcgatcatccaacaaccacatccctctctacagagcctctgagaggaaagttcttcaccatggacnggacctggtcgggtcttcgtcgcttccgtggtcgtgtagcctccgaggtcggctcacctccctaggtcgcacgtggtgcctagtccgtggggcgtagaaggtgaaaggaacgtccgtacggggtccttacgagttacgggtaacggttttcccgttagggcctaaacgggggtactaacgttaccgggtaacgggtacttaacccgtaacccgttttaaccgaaccccgggtaaggtacccggtaaacccctaaggttaaaccttcgggaccgttaaccggttagggggttacccggaccgggaacccggaacccggggtaacccccccgggtaacggtaaaaccggggttacccgtttagggggtaacgggttacgggtaaacgggttaccggggaaaaccggtttaaaaccgtaaccccggttaaaacccgtttaaaacggttaacggggtttaacggggtaaaccggggaaaccgttaaaccgggaacccgttaaaccggtaacccggtaaccgggtaaaaccggtaaacggggtttaaaccccgggtaacccgggggaagtaaccccggggtaagggttaccccggaaaccgggtaacccgggttaccgggttaaaccccggggaacggtaaccccggtaccccggtaaccgggtaaaccgccctaacgtaaaccgggtaccttaaacgggtaccggtacggtacggttaacgggtacggacgtacggtaacggttcgaacgggtaagtaacgtcgaaaccgggtaccgtaccggttactacccggtttatcggacggaccgtaaggtaacgggtacggtacgggtaactaacggtaaccgttacggttaccggtaccgtttaccgttaaccggttcggtaacggtacccgggg

SEQ ID NO: 191033 - DNA, 677 bp, Homo sapiens
  misc_feature: GYAE6OF01EJWKJ.42.42.D09.1.454.CMB.1.raw
  modified_base (151)..(151): a, c, t, g, unknown or other
  misc_feature (151)..(151): n is a, c, g, or t
  modified_base (249)..(249): a, c, t, g, unknown or other
  misc_feature (249)..(249): n is a, c, g, or t
  modified_base (519)..(519): a, c, t, g, unknown or other
  misc_feature (519)..(519): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggntgtagctccaggtgctcactcccgaggtcgcaacgtggtgcgagtcgtggggctgaagtagaagacgccgtgggcctcgagtacgtaacggttttccngacaacggctatcgtgactaccaccgttccgaccgacggtacccacctatagtcgcgtacggtgggtcggacccggaaccggacccgggacccccggaacgtaaggtaccgtaggacggtaggacggtacggtaacctaacgtaacctaaccgtagtacggtaggacgtacgacgtacacggcaagtacgtacgtacgaggcgagacgtcgacgagtaccggaccggacacgtaccgagacgacacgtactgtactacggaggtgtacgnggacgaggtcagtagacgtagcggtaaccgaccgtaccgggttcctttacggttttacgtcggacggtaacggtaaggaagggtaagggtactaacgaaccgttaaccgttcggttaccgttccctttacgttttcggaaccgttcggggtaaccggg

SEQ ID NO: 191034 - DNA, 753 bp, Homo sapiens
  misc_feature: GYAE6OF01DCLWU.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctggaagtgaagaacgccgtggggcctcgaggtgtaacggtttcctgacgaaggcatcgtggtaactacaccttaccacgacgcaccatatcgcacggtgggtcgaccgaccgaccgggacccccggaagaacggtacgttggaggtgggaagtacgggtaaacctaacgtacccgtaaacccgtaagtacggttaggtaacggaacgaacgtaccgtaacggacacgaaggtaacgttaccggagggtacgaaggtacggtaccgaccgtaacgtacccgggaaccccgggaaccgtaccggtacccgaacgtacgacaacgtacggtactaacggacggttacgggtaggttacggaacggacggtacgggtacgtaaggtaagtaacgttagtacgggaccgtaacccgtaccgggttaccgtttacgtttagttccggacggtacggaagggtaaacggaaggggtaacgtaaaccggtaaaccgttaaccgttccggttacggtttaccctttacccggttttacgaacccggttcgggtaaccggggg

SEQ ID NO: 191035 - DNA, 775 bp, Homo sapiens
  misc_feature: GYAE6OF01EPBZ6.42.42.D09.1.454.CMB.1.raw
  modified_base (165)..(165): a, c, t, g, unknown or other
  misc_feature (165)..(165): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtnctcactcccaggtgcaactggtgcagtcgtggggctgaagtgaagaacgccgtggggccctcgagttaggtaacggttttccctggaccgaagggctaatcgtggaatacctacccttcaaccgaggccaaccatatcgactacgtgggtgaccgacgaccgggaccccggaacgaaggtacctaggaggtggacgtagggaactaacgtaccaaacccgtaagtaacggtaggtaaggtaacgacgtaacgtacgactaacgaaggaacgttaccgagggcgtagacgtcgaccacgtacggaccccggacaccgtaccaacggagaccaacgacgtactacgtaagtggtagtcggacgacgacgggtcgtaagtaacgtagtaggtacggtaaaccgaaccgtaccgggttacccgttttacgttttaacgttaccgggtaccggttaaaccgggaaacggtaaacggggtaaaacgggggtaacgggttaaacccggttaaaacccggtaaaaccggttaaccccggtttccgggttttaacccccttttaccccgggttttttaacgggttaccccggttaaaccggggttaaccccgggggggg

SEQ ID NO: 191036 - DNA, 830 bp, Homo sapiens
  misc_feature: GYAE6OF01DKX28.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgactcactccaggtgcaactggtgcagtcgtgggctagaagtgaagaacgccgtcggggcctagagtaggtaacgggtttcctgacgaaggctagtccgaggaactacctaccttccgaaccgaacggaccctaaccgtaatatcggactaacggtgggtacgaccgaacgaccgggacccccggaagaacggtacgtggaaggttggaacgttacgggaaacttaacgtaacccgaaaaccgttaagtaacggtacgggtaaacggtaacgaaacgtaaccgttaacgaacccgtaaacgtaacgggtaaacgggttacccggaaacggggacgtaaacgggtaccggttaacccggacccggttaaaacggtaacccggggaacccccggggtaaaccggtaaccccgttaaaccccggaaacccggtaccgaaacccgttaaacccgtaacggttaacccgtaaccgttaggtaacgggtaaggtttacggaacggtaccggtaagtaccggtaaagacgtaacgtacgtaacggaaccgtacgtaccggttaccgttagttttaacgtacggcggtaacgaaggtaaacgggaaggtaacggtaacgaaacgtacgtacgttcggttacctttaccgtttacgaccgttacggtaaccgggg

SEQ ID NO: 191037 - DNA, 701 bp, Homo sapiens
  misc_feature: GYAE6OF01EQAF8.42.42.D09.1.454.CMB.1.raw
  modified_base (219)..(219): a, c, t, g, unknown or other
  misc_feature (219)..(219): n is a, c, g, or t
  modified_base (272)..(272): a, c, t, g, unknown or other
  misc_feature (272)..(272): n is a, c, g, or t
  modified_base (465)..(465): a, c, t, g, unknown or other
  misc_feature (465)..(465): n is a, c, g, or t
tcagtgacgtatgtcacgaccggtgctcgatttagacacatacgcagggaagggggcatcgatccaacaaccacatcccttctctaccaggaagcctctgacgaggaaaggtcttcaccatggactggacctgggtcggtcttctgcttcctggctgtagctccaggtgctcactcccaggtgcactggtgcagtctaggggctgaagtgaagaagccnggggcctcgagtcgaaggtttcctgccaaggcatcgtgatcgaccttcgaccnggcaacgatagtagctacgtggtcgcgacgtaccggccccggaacaacgggtacttggagttggacgtacgggaacttaactccgaaaaccttagtaacggttcgggtaaacggacaaacgggtacctaaccggcgtaactacggtaacgttaccgagggtacaggtacgtacacgtagaccggacccggaanaaccgtccgtaacgacgacctaacgtacgtactaaccgtagtacgggtagttacgacgtacgaaggtcgtaacgtaaggacgttacgtacgaaccgtacgaccgtacgttacggttttacgtcgtaccggtagtacgggtaacggaaggggtaacgtaacgggaaccgttaaacgttcccggttacgggtttaccctttaccccggttttcggaacgtttacccgggacccggggg

SEQ ID NO: 191038 - DNA, 641 bp, Homo sapiens
  misc_feature: GYAE6OF01D53FB.42.42.D09.1.454.CMB.1.raw
  modified_base (241)..(241): a, c, t, g, unknown or other
  misc_feature (241)..(241): n is a, c, g, or t
  modified_base (480)..(480): a, c, t, g, unknown or other
  misc_feature (480)..(480): n is a, c, g, or t
  modified_base (547)..(547): a, c, t, g, unknown or other
  misc_feature (547)..(547): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagagccgtggggcctcgagtgtaacggtttccngacaaggcatcgtaggatacctaccctttccaaccgtaggccaaccctatagtgccacgtgggtgcgacgaccggcccccggaagaacggtactgaggtggagtcgggaactaataccaacctagtagtaggtacgacagactacgcaacgagtaacgtcgaggcaggacgtcgcgagtccggacccggacacgtccgacgacgcacgacgtactacgtagtcggtattggacgacggngggtacctaggaacgtattacggtacggaacccgtaccgggtacggttcccgtttacgtttttacgnggtacccgagggtaaggaacgggtaagggaactaccgaaggtaaacccttcgttacggttccctttaccgtttcgaccgtcggttaacccgggg

SEQ ID NO: 191039 - DNA, 638 bp, Homo sapiens
  misc_feature: GYAE6OF01C3QCX.42.42.D09.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (590)..(590): a, c, t, g, unknown or other
  misc_feature (590)..(590): n is a, c, g, or t
  modified_base (603)..(603): a, c, t, g, unknown or other
  misc_feature (603)..(603): n is a, c, g, or t
tcagtgacgtatgtcacgaccggtgctcgatttagacacatacgcagggaaagggggcatcatccaacaaccacatcccttctctacagaacgcctctgagaggaaagttcttcaccatggactggacctggtgggtcttctgcttcctggctgtagctccaggtgctcactcccaggtgactaacgtgggtgcgagtcgtggggctgaaggtagaagaacgccggtcggggccctagaggtaggtaacggtttccngcgaaggcatcgngactacctacctcacacgcaccatancgagcgtggcgcgaccgaccggccccgagaacgcgttggagtggagtggtaactacgtaaccgaaaccgtagtaacggtaggtacgaacaacggtacacgacaacgtaagtacgtcgaggcgaagcgtaccgtcaacggtccggaacccgggtcaccggtccaacggcgaactaacgacggttacctagtacggttgggaagttacggacgtcgaagggtcgtaagagtaacgttagtaccgaaccggttaacgtccggtacctttgtttagcgacgtagaggtaggaacggtnaacgaacttacgngttaccgttacttccgtttacgcgtcggtacgggg

SEQ ID NO: 191040 - DNA, 836 bp, Homo sapiens
  misc_feature: GYAE6OF01D5WZN.42.42.D09.1.454.CMB.1.raw
tcagtgacgtatgtcacgaccggtgctcgattttagacacatacgcgagggaaagggggcatcatccaacaaccacatcccttctctacagaagcctctgagaggaaagttcttccaccatggactggacctggtgggtcttctgtcttccgtggctgtagctccaggtcgctcacctcccgaggtgctaacgtggtcgacgagtcggtggggctaggaaggtagaagacgccggtggggccctgagtgtaacggtttccagacgagcatcgtgactacctacctacacgacgaccactatacgtgctacggtgggtacgacgaccggacccggaccccggaagaaggtcgttaggagggtaggtacgtacggtaactacctaccgtaaaccgttaagtaggtacggtaacggtaacgaagtacccgtaacgaccgtaaacgtaacggtaaccggtttacggaacgggtagaccggtaacggtcccggaccgtacgggtacccgggaaccccgggtaccgtaccggtacccggaacggtaccgaccgtaaccgtaacggtaccgtaacctaggttacggtaggttacggacgtacggtacgggtacgtaaggtaagtagttaccgggtaaccgggaacccggttaacccgggtttaccggtttaccggtttttaccgtttacggtccgggaaccggttaaacggggaacggggtaaacggaaccggggttaacggtaaacggttaaacccgttaacccgtttacccgggtttaccccggtttccccgttttaacccggtttaccgggtaaccgggttacccggggtaacccggggg

SEQ ID NO: 191041 - DNA, 905 bp, Homo sapiens
  misc_feature: GYAE6OF01A1PCJ.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctccaggtcgcaacgtggtgcgtagtcgtgggctagaagtgaagagcgtgggcctcgagtaggtaacggtttccgtggacgaaggctagttcgtaggtaactacctaacccgtttccgaacccgacggacccaacctaagttacgtacgaccgtacggtcggggtcgaccggaaccgaccgggacccccggtaacgaaacgggtaccgttagggacggtaggaacggtacgggtaaaccttaacgtacctaaaacccgttaaaggtacggttaacgggtaaccggaacgtaacggaaccgtaaccgaccgaaacgtaacgggtaaaccggttccggaacgggtaaccgaggtaccgggtacccggtaccgtaacggtacccggaaaccccggggaacctaaccccggtacccggaaacggaaccggaccgtaaacgtaccggttactaaaccggtagggtacgggttaaaggttcggaacggtagggaaccgggtcggtaagtaaggtacgttaacgggtaagggaacccgtaccgggttaaaccggggtccccggtttttaacgttttaccgggttaccgggaccgggttaacggggaacggtaaacggggtaaacggggtaaccgtaaaacggttaacccgggttaaaccctttacccgggttacccgggttttaccccttttaaccccgggttttaacgtaaacccggggttttacccgggtaacggggggg

SEQ ID NO: 191042 - DNA, 737 bp, Homo sapiens
  misc_feature: GYAE6OF01A6BYF.42.42.D09.1.454.CMB.1.raw
  modified_base (168)..(168): a, c, t, g, unknown or other
  misc_feature (168)..(168): n is a, c, g, or t
  modified_base (498)..(498): a, c, t, g, unknown or other
  misc_feature (498)..(498): n is a, c, g, or t
  modified_base (650)..(650): a, c, t, g, unknown or other
  misc_feature (650)..(650): n is a, c, g, or t
  modified_base (724)..(724): a, c, t, g, unknown or other
  misc_feature (724)..(724): n is a, c, g, or t
tcagtgacgtatgtcacgaccggtgctcgatttagacacatacgcagggaaaggggcatcatccaacaaccacatcccttctctacagaagcctctgagaggaagttcttcaccatggactggacctggtgggtcttctgtcttcctggcttgtacgctccgaggtcncctacacctcccgtaggtcacctaacgtggtcacgtacgtcggtggggactaggaaggtacggaaagtacgtcccggtggggtccctagtaggttacggttaacggttcccaggacgtaacggctagtccgtaggacctaccgtacccttacgaccgacggacctaacctgttacacgcgtacggtcggtcgaaccggacggtacccggacccgaagaacggttcgtaggtacggagttacgacggtaactaacctacgtaaacctaggtaggtacggaacgtacgacgtacaccgacgaacgtacgtaacgccgtaaggacacggtacnccgtacgacggtaccgacccggtaacgaccgtacgacacgtacccagtaacgtccaggtaaccggtaggtacgacgagtcgggaatccgggataaaccggagttaccggaaccgttaaccggaaccggttcccgttacgttattacccgggngaaccgggagttaacggacgttaaggacccgtaataacccgggtacctcgttaacgtcccgtttagtacccggngttacgggaccgg

SEQ ID NO: 191043 - DNA, 825 bp, Homo sapiens
  misc_feature: GYAE6OF01DGQ8C.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttccgtggctgtagctccgaggtgactcacctcccgaggtcgacacgtgggtgcgagtcggtggggtactaggaagtagaaggaacgtccggtcggggcctacgtaggtacggttaacggtttccacggacgaacggtctagttcgtaaggactacctaccttaccgacgacggaccaacctatatcgcgacggttcggtacgaccggaaccggacccggacccccggaaagtaacgggtacgttaggtaaccggtgggtaacggtacgggaaacttaaccgtaaccgtaaaccgttaaggtacggtacggtaacgggtaacaaacggttaaccaaccgacgtaaacgtaacggtaacgttacggacgggtacgacgtagtcccgacgaacggtaccggacccggaacgtacccgtaccgaacgtacgaaccgtaacgtaacgttaccgtaacgacggttacggtaacgtacggacgtacggtaccgggagttagggaactaggtaaccgtaggaccgtacggaccggtttccgttacgtttcgtaccggggagttacgggaaacgggtaacgggaaacggggttaactaaacccgggtaaacggttaacccgtttaccggttaccgttttaacccccgtttaggttttaacccggtaacgggtttcccgggaaacccggggg

SEQ ID NO: 191044 - DNA, 766 bp, Homo sapiens
  misc_feature: GYAE6OF01DFLH9.42.42.D09.1.454.CMB.1.raw
  modified_base (191)..(191): a, c, t, g, unknown or other
  misc_feature (191)..(191): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagtgacgtatgtcacgaccggtgctcgatttagacacatacgcagggaaagggggcatcatccaacaaccacatcccttctctacagaagcctctgagaggaagttcttcaccatggactggacctggtgggtcttctgcttcctggctgtacgctccgaggtgctcactcccgaggtgcaacgtggtncgacgtcgtggggctagaagtgaagacgccgtcgggcctgagtcgtaacgtttccngacgtaaggcatcgaggtactacctaccttacacgtacggaccaacattancgtacacggtggtcgaccggaccgaccgggacccccggtaagaacggtcgttggtacggtggtaacgtagggtaactaactacccgtaaccgttagtagggtcggtaacggactaacggtacctacggacgtaaacgacggtaaccgttcggaggacgtaacgacggtaccgacgaacggttacccgggaacccggtacgtacccgtaccgaacggacgtacccgaaacgttacggtaccgtacgtaaccggtttggggtaaacgttcgggtaacgacggacgggtacaacggtagtaacgtacgtacgacccgtaaccgttacccgggtcctttttacggtttacgacgtaccggggtactaagggaaacgggtaaacgggtcgttaaaacgaaccggttaaccgttcccgggtttcccgttacctttaaccgggttttaaccgccgggtttacgggaccccggggg

SEQ ID NO: 191045 - DNA, 714 bp, Homo sapiens
  misc_feature: GYAE6OF01D8Z3K.42.42.D09.1.454.CMB.1.raw
tcagtgacgtatgtcacgaccggtgctcgatttagacacatacgcgagggaaagggggcatcatccaacaaccacatcccttctctacagaagcctcgtgagaggaaagttcttcaccatggactggacctggtgggtcttctgcttcctggctgtagctcaggtgctcactccaggtgcatggtgcagtcgtgggctgaagtgaagagcgtgggcctgagtgtaacgttctgacaaggctatcgtgtatacaccgttcaaccgaggaccacatacgtgctacgtggtcgacgacgaccgggaccccggagaggacgtggtaggacggtagtagggacttaacgtaccaaccttaaggtaggttcggtaacgacgacgtaacgtaccgacgaacgtaggtaaccgttccggacgggtacaacgggcggtaccgaccgtagtcccgggtaaccccgggactaccgacgacgacggaccaagtaccgtacacgtagtagggagttcgagacgtaccggagttggaagtagtactaacgggacctacgtaccgggttacccgttttcgtttaacggtcggttaccggaagggtaaaccggaaggggttaacgggaacggtaaacccgtaaccggggttaaaacccttcccggggttacgttttacccccgtttaccggttttaacccggtagggttaaccgggttaaccccgggggg

SEQ ID NO: 191046 - DNA, 713 bp, Homo sapiens
  misc_feature: GYAE6OF01BFDWO.42.42.D09.1.454.CMB.1.raw
  modified_base (142)..(142): a, c, t, g, unknown or other
  misc_feature (142)..(142): n is a, c, g, or t
  modified_base (147)..(147): a, c, t, g, unknown or other
  misc_feature (147)..(147): n is a, c, g, or t
  modified_base (157)..(157): a, c, t, g, unknown or other
  misc_feature (157)..(157): n is a, c, g, or t
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (536)..(536): a, c, t, g, unknown or other
  misc_feature (536)..(536): n is a, c, g, or t
tcagtgacgtatgtcacgaccggtgctcgatttagacacatacgcagggaaagggggcatcatccaacaaccacatcccttctctacagaagcctctgagaggaattctcacatggactggactggtggtcttctgcttcgngctgngctcgaggtnctcacctccgaggtcgactacgtgtcgcgtacgtcggngggtacgtaggaaggtaaggacggaaccgtccgggtcgggtactacgtaggtacgtaacggttccgtgaacgacgctagtcgtacgacttacctacctacgaccgacgtaccactanacgttcgcgtacggtggacgtaccggaccggcccggtacccgaagacggtacgtagtacgggtagacggtacgtaactaacgtaccgaaccgttaggtacggtacggtacgaactacgacctacgacaacgtacgaggtccgaggactaggtacgtcacgacggtcccgagaccgtacgacgtanacctacgactntaccgagtacggtagtacggtgacggtnacgggtataacggtacgtaagaccgtagtacccgtaacgtcggtttacgttccgtaggttacgaccggtaaggacgggtaaggtaacccggttaacgtaaaccgggacttaaacccggttcgttaaccgggttccttttaaacccggtggtttaacccggccggggttaaacccggg

SEQ ID NO: 191047 - DNA, 720 bp, Homo sapiens
  misc_feature: GYAE6OF01B4XDW.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccagtggactggaccgtggtgggtcttctgtcttccgtggctgtacgctccgaggtcgctcacctcccgaggtgaccaacgtggtgcgagtcgtggggctgaagtagaagacgccggtgggacctagaggtaggtacggttccgagacgaacggctagttcgtaggaactacctacccgttaccgaccgaggaccaacctatacgtacgccgtaggttcggggcgaccggaccgacccgggaccccggaacgaacggtcgtaggagtacggagtacggaactaacgtaccgtaaaccgtagtaggtaggtaaggacgacgactacgacaacgagaacgtacgaggacgagacgtacgccgacgtaccgaccggccacggtaccaacggacgacaacgtactaccgtaacgacggtaggtacgtggacggtacgacgggtacgtaagaagtacggttaacggacggaacccgacggttaacccggttcgttaaccgttttggtaccggacggtaacggaagggtaacggaagggtacgtaagaaccgtaaccgtttccgttacgtttacccgttccggtttaacggtacccggtacgggtacccgggg

SEQ ID NO: 191048 - DNA, 921 bp, Homo sapiens
  misc_feature: GYAE6OF01A38TZ.42.42.D09.1.454.CMB.1.raw
tcagtgacgtatgtcacgaccggtgctcgatttagacacatacgcagggaaagggggcatcatccaacaaccacatcccttctctacagaagcctcgtgagaggaaagttcttcaccatggactggacctggtgggtcttctgcttcctggctgtagcctccgaggtcgctcacctcccgaggtcgacaacgtgggttcgcgtacggttccggttcgggggctaggaaaggttcggaaacgggtaaccggtcccggttacggggggccccttacggtaacgggttacgggttaaaacggggttttcccccgttagggaaccggaaacgggtcctacgtttaccggtaacgggtaactttaaccccgtaacccgtttaacccgtaaccgaacgggtacccaacccggtattaaccgtcgaccgtacggttaggggccgacggtaacccggacccgggaccccccggaagtaaacgggtccgttcggaaccggttaggacgttacgggtaacctaacccgttaaccgtaaaacccgttaggtaacggtacgggtaaccggtaacctaagggtaacctacccgacaaacgggtaacggtaacccggttaccggacggggaacctaggtaccggtacccgtacggaaccggtttacccgggaaccccgggtaccgtacccgggtaccgaacggtacggtaccgtaacgtaccggttacgtaaccgtaggtacggtaacggtacgtagaaccggtacggaccggttagaacgtaccgtagggtaccgtaaccgtaccgggttacctccggtttaacttcggttaggaccggtaacgggtacgtaaacgggacgggtaacggtacgtaaccggttaaccgttccgttacgtaccccgtttaagttccggtacggtcggtaaccgggg

SEQ ID NO: 191049 - DNA, 795 bp, Homo sapiens
  misc_feature: GYAE6OF01EECPR.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtcgctcacctcccgtaggtgctaacgtggtgcgtagtcgtggggctaggaagtaggaagaacggccgtcgggtcctacgagtaggttaacggtttccgaggacgaaggtctacgtcgtacgtacgtacctaccttaccgaaccgacggaccaactacgtagtcgacgtacggtcgggtcggaccgaccggacccgggaccccggtaacggaacggtcgttaggaggtacggtacggtacgtaactaacgtaaccgtaaaccgttaagtacggtacggtaacgaacgaacgaacgtaccgacgtaaacgtaacggtaaccggttaccggacgggaacgaacggtacgtaccgaccgtaacggtacccggtaaccccgggacgtaccggtaacccgaacgacgactaacgtacgtaaccgtagtacggtaggtagtaacggacgacggtacgtacgtaggtacaagtacggaccggtaaccggtacggtaccggttaccgtttacgtttaggtacccggtaggaacggtaacgggtaaacgggtaacgggtaacgtaaaccggtaacgttaacccgttaccggtttacgggttacccttttaccgggtttacgtaaccggtggggtaacccggg

SEQ ID NO: 191050 - DNA, 873 bp, Homo sapiens
  misc_feature: GYAE6OF01B8O5M.42.42.D09.1.454.CMB.1.raw
  modified_base (168)..(168): a, c, t, g, unknown or other
  misc_feature (168)..(168): n is a, c, g, or t
  modified_base (184)..(184): a, c, t, g, unknown or other
  misc_feature (184)..(184): n is a, c, g, or t
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctaccagaagcctctgagaggaaagttcttcaccatggactggacctggtgggtctctgcttcctcggctgagctccaggtgctnactcccaggtgcaacnggtgcgagtccgtggggactgaaggtgaacggagcgtggggctcgagtcggaaggtttcagacaagggcagtctaggactacgtaaccttcaaccgaggtacgacctaagttaacngactcgtagggtcgtaccgaacgacggacccccgttaaagaaccggtgtttaggaggttacggagttacgggaactaacgtaacgaaacccttaaaggttacggttacggacgggaacgtaacggtaaacctacggaacctaaccgaacggtaacgtttacccgaaggggacaacggtaaccggttccggaccgaacgtacggtaaccccggggaacctaacccggtaccgaaaccggacgtaaccgaaaccgaccgggtacctaaccgtaaaggtccgggttaaggttacggtaaacgccggttaaacgggaccggttacgaaaggttacgtaacgtttaaccgggtaaccggaaaccgggtttaaccccgggttaccccggtttaactttttaacccgggtcggtttaaaccgggtcccgggaaaagggttacgggggttaaaacggaaacccgggttaaccgggtaaaaaccgtaaaaacccggttttccccggttaaccggggtttaccccgtttaaccccgggtttttttcgtaaaaccccgggtttaacggttaaccccgggggggg

SEQ ID NO: 191051 - DNA, 782 bp, Homo sapiens
  misc_feature: GYAE6OF01BEXYC.42.42.D09.1.454.CMB.1.raw
  modified_base (253)..(253): a, c, t, g, unknown or other
  misc_feature (253)..(253): n is a, c, g, or t
  modified_base (669)..(669): a, c, t, g, unknown or other
  misc_feature (669)..(669): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagctccgaggtgctcacctcccgaggtcgcacgtggtgcagtcgtgggctagaagtagaagacgccgtaggggcctacgtaggtcgtaacggtttccngacgaaggtcacgtcgtaggactaaccaccgttacgaccgtacggaccaacctagtacgtcgaccgtacggtgggtacgaccgaaccggacccgggtaccccggaagtaacggtcgttacggaggtacggacgtacgggtaaccttaacgtaccgtaaaccgttagtagggtacggaacgtaacgacgtacgtaccgactaacggtacgtaacgtccggagggtacgaagtaccggaccgtaccgtaaccggtacccgggaaccccgggtacgtacccggacccgacggaaccggtaccgaaccgttaacggtacctaaccgtaaggttacggacgttacggaacggacggtaacggtactaaggaacggtgtaacgtacggaaccggtacgtaacccgggttcgttagtttacgngggtaacccgtagggtagggaacggtaaggaacggtaaccgaaccggttaaacgtccggtttaacccggttccgtttaaccggtaccggtaccggttaccgggtaacccgggg

SEQ ID NO: 191052 - DNA, 676 bp, Homo sapiens
  misc_feature: GYAE6OF01AO6RR.42.42.D09.1.454.CMB.1.raw
  modified_base (267)..(267): a, c, t, g, unknown or other
  misc_feature (267)..(267): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgtaaggtttcctgcaaggcatctggatacaccttcaccgnggcaccatatcgcacgtggtggcgacacggcccgacaggacttggacgtggagtcgggactaacgtacctaaaccctaagttacggtaggtaacggacgtaacgacgtaccgtacgaacgaacggtaacggttacccgagggtacaacgggtacgtccgaccgagtacccgggaccccggtacgaaccgtccgaaccggacgaccaactacggtaccacgtagtggtacggttagacggtcagggtcgttaggaacgtacgtagtacggaaccggaacgtaccggtccggtttacttttacgtacggccgtaaccggaggaacgggtaagggtacgaacgtaacggtaaacccgttccgttaccggtttacccgttaccgtttacgtaccgggttacgtacccgggggg

SEQ ID NO: 191053 - DNA, 711 bp, Homo sapiens
  misc_feature: GYAE6OF01BCCDT.42.42.D09.1.454.CMB.1.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcactcccaggtgacaacgtggtgcagtcgtggggctagaagtagaagacgccgtgggcctcgagtgacgttccngacaggcagtcgngactacctacctacaccgagtaccacctatgtagacctagtgggtcgaccgacggacccggaccccggtaacgaacggtaccgttaggacggtaggacgtagggtaaacctaacgtacccgaaaacccttaggtaaggtacggtaacggaacaacggtaaccgtaaccgacgtaaacgtaacgtaacggttacccggaaggggtaccagggtacgtaccgacgtacgacccgggacccggaacgtaccgtacccgacggacacgtacgacgtctacgtacggtagtagtcgaagccgaggtcaagagtataagtcggaaccgtaccgtaccggtctttaacgttacgtacggacggtaacgggtagaacgggttaagggaacgttaacgaacggttaaccgttaccggttacggttacccgtttaacccttcggtaccgggtacgggtacccgggg

SEQ ID NO: 191054 - DNA, 994 bp, Homo sapiens
  misc_feature: GYAE6OF01ETAJN.42.42.D09.1.454.CMB.1.raw
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtcgggtcttctgcttcctggctgtagctccagtgctcactcccagtncaactggtncagtctggggctgaagtgaagaacgcccgtggggcctacgtagtacggtaacggtttcccnggtaacgaagggtcctaagtcgtacggacttaaccgtaccctttaccgaacccgtacggtaccctaacccgtaagtaacgttaccggtaccgtaacggttacggggttacggaaccggtaaccggaaccccggggacccccccccgggtaagtaaaaccgggtacccgttttagggtaacgggttacggggtaacgttacgggggtaaacctttaaaacggtaccccgtaaaaccccgtttaaaggttaaccggttaacgggtaaccgggttaacctaaacgggttaaaccccgttaaccggaaccgtaaccggaaaccggttaaaaccgggtcccgggtaaacgggtaaccggtaaacggtaccgggttacccggtacccggtaacgtttaaccccggggaacccccggggttaaccgaacccggttaccccggaacggtaacccgtaaccgtaaccgttaaaccggtacccgtaaccgtaaacgggtttaggtaaccgggtttacgaacgggtacccggaaccggttacggttaacggaaacgtacgttaacggtaacccggtaaccggttaaaccccggaccggtttaccccgtttacgtttacggtttacccgggaccggtaacgggtacggtaaagggaaacccggggttaagtaacccggtaaccgggtaaccctttaccgggttcccggtttaacctttaccccggtttacgtaacccggttaccgggttacccggggg

SEQ ID NO: 191055 - DNA, 732 bp, Homo sapiens
  misc_feature: GYAE6OF01AEAQS.42.42.D09.1.454.CMB.1.raw
tcagtgacgtatgtcacgaccggtgctcgatttagacacatacgcgagggaaagggggcatcatccaacaaccacatcccttctctacagaagcctctgagaggaaagttcttcaccatggactggacctggtggttcttctgtccttccgtggctgtacgcctccgaggtgcctccacctcccgaggtcgaccaacgtggtgacgaggttcggtggggctaggaaggtagaaagacgccggtggggcctcgtaggtaggtaacggtttccgaggacgacggtactacgtcgacgtactacctaccgtaccaccgacgaccactatagcgtcgtacggtcggtcgaccggaaccggacccggacccggaacggaacggtacgtagggtacggtaggtacggtacggtaactaaaccgtaaccgtaaaccgtaaggtagggtaacggtaacggaacgaacgtaccgacgaacgaacgaacggtacgtacggacggacgacggcgtaccgacgacgaccgggacccggaccgaccgaccgacgaccgacacgtacgtacgtacgacggtagtacgtacgacgcgtacgagtagaacgtagtacgaccgtaccgtaccggtaccgtttacgtttacgttcggacgtcggtaggaggaacggtaaggtaacgtaacgaacgttaccgttaccgttacgtttacccgtttaccgttacggtccggtacgggtacggg

SEQ ID NO: 191056 - DNA, 713 bp, Homo sapiens
  misc_feature: GYAE6OF01ETMY1.42.42.D09.1.454.CMB.1.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctagagtgaagaagccgtggggcctcgagtgtaaggtttccngcaaggnatcgtggataccaccttcaccgaggccaccatatcgacacgtgggtgccgacgaccgggacccccggacgaaggtaccgttggaggtggatgggaacttaactaaccaaacccttaagtcggtacggtaaggacaacggactaacggcctaacgaagtaaacggttccgaagggccgaacggtaacggtcgacccgaacggttaccgggaacccccggggtacctaaccgggtacccgtacggaccgacaacgacgtacctaacgagtacggtaggttcgaacggcagggctaggaagagtagtaaccgacgtaccggtacgttaccggtttacgtttacgttcggaccgtaacggtaggtaaagggtaaacggggtacgtaaacgtaaacggttaaacccgtcgggtttaaccgtttccccgttttaccgttttacggtaaccggttaaccgggtacccggggg

SEQ ID NO: 191057 - DNA, 815 bp, Homo sapiens
  misc_feature: GYAE6OF01CJ22V.42.42.D09.1.454.CMB.1.raw
  modified_base (193)..(193): a, c, t, g, unknown or other
  misc_feature (193)..(193): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttcgtgcttcctggctgtagctcgaggtgctcacctcccgaggtgacacgtgggtncgagtcgtggggctaggaagtagaaggacgccggtcgggcctagtaggtacggttaacggtttccagtacgaaggctagttccgtaggtactaacctaccttaccgaacgtacgaccacgtatacgtcgactggtacggcgaccgaccgacccgggacccggaacggacgtacgtaggaggtacggtagtacgggtaactaacgtaccgtaacgtacgttaaggtacggtaacgacgtaacgacgtacgaaccgacgtaacgtaacgtaccggaggtacgtacggtacgtaccgaccgtacggtaccggaccggtaccgaccgtaaccgaccgacgtacgtaacgtccgttaacgtacgtaaggtcggttaacggtgaaccgggtacgggtaacggtacggtaagacggtaagtaaccgtaacgggacccgtaaacggttacccgggttaccggttttaacgttaccgggttaccgggtacggttaacggggaacggaacggggtaaacggttaacggaaaccggttaaaccggtaacccggtttaccgggtttacccggttttaacccccgttaccgggtttaacccggttaaacccgggttcgggggtaaaccccggggg

SEQ ID NO: 191058 - DNA, 922 bp, Homo sapiens
  misc_feature: GYAE6OF01B6AL0.42.42.D09.1.454.CMB.1.raw
  modified_base (180)..(180): a, c, t, g, unknown or other
  misc_feature (180)..(180): n is a, c, g, or t
  modified_base (327)..(327): a, c, t, g, unknown or other
  misc_feature (327)..(327): n is a, c, g, or t
  modified_base (779)..(779): a, c, t, g, unknown or other
  misc_feature (779)..(779): n is a, c, g, or t
tcagtgacgtatgtcacgaccggtgctcgatttagacacatacgcaggggaaagggggcatcattcaacaaccacatcccttctctacagaagcctctgagaggtaaagttcttcaccatggactggacctgggtgggtcttctggtcttccgtaggcgtggtacgctaccgagggttcncctacacctcccgaaggtcgacgtaacgttgggtcgaccgtaggttacggtcggggtctaagggtaaaggtacggaaaacggtaaccggtccgggttaccgggggccttaccggtaagggttacgggtttaaacccgggttttcccngggtaaacccgtaaacggggtacttaccgttacggtaacggtaacttaaccccggtacccttttaccgaacccgtacgggaccctaaccgtaacgttacggtacccgacggttaaccgggttacggggtacccggaccggtacccggggaccccggggtaaccccggtaacggtaaaccggttccggttaagggtacggggtacggtaacggttaacggtaaaccgttaacggtaaccttaaaacccggttagttaacggggtttcggaaaccggtaacggttaacgaaccgttacggacccgtaaacgtaggggtaaacccgtcgggaacggtacggtaacgtaaccggtccgaccgttaacggacccggacccgtacgtaccggtaccacgggacgtacaccgtaaggttccaaccggttaggttacggagtacgacgggataccgggtnagggttaccagtccgtaaggtaccggtaaccgttacggttcgttacttaacgccgggacgacgggtaagaacggaccgggtacttaccacggttaaccgtcgttaccggttctaacccggttggaacccggtggtaaccgggg

SEQ ID NO: 191059 - DNA, 631 bp, Homo sapiens
  misc_feature: GYAE6OF01A0LC6.42.42.D09.1.454.CMB.1.raw
  modified_base (239)..(239): a, c, t, g, unknown or other
  misc_feature (239)..(239): n is a, c, g, or t
  modified_base (461)..(461): a, c, t, g, unknown or other
  misc_feature (461)..(461): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaacgtggtgcaggtctggggctgagtgaagagccgtgggcctcgagtgtaggtttccngacaaggcatcgtaggataccacccttcaccgaggccaaccgatagtcgcacgtgggtacgcgaccggaccggacccccggacgaacggtaccgtggaggtgggagtgggaactaacgtaccaaacccgtaagtaggtaggtacggacgaggacgtacgacaacagtacgttcgacggcgagcgtaccgtcgagtaccggacccgggacaccggtccacggngaccgacgagtcgtacagtaggtagttgagcgaggcgtggatagtagacggacgacggtaccggtacgtttcgttagtcggacggacggtaaggtaggaacgggtaagtacgaaacgtacccttccggtacggtttcccgttacgtttacgccgttacgggtaccggggg

SEQ ID NO: 191060 - DNA, 763 bp, Homo sapiens
  misc_feature: GYAE6OF01AHZQM.42.42.D09.1.454.CMB.1.raw
  modified_base (557)..(557): a, c, t, g, unknown or other
  misc_feature (557)..(557): n is a, c, g, or t
  modified_base (602)..(602): a, c, t, g, unknown or other
  misc_feature (602)..(602): n is a, c, g, or t
tcagtgacgtatgtcacgaccggtgctcgatttagacacatacgcagggaagggggcatcatccaacaaccacatcccttctctacagaagcctctgaggaggaagttcttcaccatggactggacctggtggtcttctagcttcctggctgtagctccaggtgctcactccgaggtgcacgtggtcacagtcgtggggctagaggtagaaggtacgtccggagggccctacgaggttacggttaacgggtttcctggacgaacggtcctagtaccgtaggtaactacctccttaccgaccgacggaccaccgtatacgtcgtaccgtaggttcgggacgcccggtaaccggaccccgggtaccccggaacgacggtacgttacggaggtggtacggtacggtaacgttaactaccgtaaaccggtagtacgggtaggaacgtacgtacgaacgtacacgtaacgaaggtacggtaccggagggtaactaggaccgggtcgtaaccgacggttaccgggaacccgggtacgtaccccgtaccgacgtacggtaaccncgtaacggtaccttaaggatcggggatcggtacgacggtacgggntagggaacttacggagtacgggaaccgacgttacgggtttacctttacggttgtaccggtagggtacgaacgggtaggggaacggtacgtaacccgtaccgggtaccttccgggttacctttaccggttcccggttacggtcccggtaggggtacccgggg

SEQ ID NO: 191061 - DNA, 747 bp, Homo sapiens
  misc_feature: GYAE6OF01CFRL5.42.42.D09.1.454.CMB.1.raw
  modified_base (400)..(400): a, c, t, g, unknown or other
  misc_feature (400)..(400): n is a, c, g, or t
  modified_base (613)..(613): a, c, t, g, unknown or other
  misc_feature (613)..(613): n is a, c, g, or t
  modified_base (633)..(633): a, c, t, g, unknown or other
  misc_feature (633)..(633): n is a, c, g, or t
tcagtgacgtatgtcacgaccggtgctcgatttagacacatacgcgaggggaaagggggcatcatccaacaaccacatcccttctctacagaagcctctgagaggaaagttcttcacatggactggacctggtgggtcttctgcttcctggctagtacgctccgaggtgccttcactcccgaggttacgctaacgtggtgcaggtccggtggggactaggaagtagaacgacgtccgtggggccctagtagtgtaacggtttccagacgaggtcactacgtagtactaccgtaccgtaccacgacgccaaccgattgcggctacgggtggcgacggaccgacccggtaccccggaagtacggtactaggtacgggtaggtacgtacgggtaaccttaaanacccggtaaaccgttaagtacggggttacggtaacggaccaacgggtttaacacccggaagaaccggtaaacggttaccggttaacggacgggttacgacgggtaaacggtccaccgtaacgtacccggggaacccggaccgttaacgccccgaaggtccgaacgactacggtactacgtagtccggaagttcggactacggtagtcgagtanaacggtctaagacggtaacncggttacctttgtttacgcggtacggacgaaggaccggtaaagtacggacgttaacgtacccgttacgggtttccgtaccgtttacctttaagggtcccgtacgggttaccggg

SEQ ID NO: 191062 - DNA, 817 bp, Homo sapiens
  misc_feature: GYAE6OF01EFWZZ.42.42.D09.1.454.CMB.1.raw
  modified_base (82)..(82): a, c, t, g, unknown or other
  misc_feature (82)..(82): n is a, c, g, or t
tcagtgacgtatgtcacgaccggtgctcgatttagacacatacgcagggaaagggggcatcatccaacaaccacatcccttntctacagaagcctctgagaggaaagttcttcaccatggactggacctggtgggtcttctgcttccgtggctgtagctccgaggtcgctcacctcccgtaggtgacctaacgtggtcgacgtagtcggtggggcgttaggaaggtagaaggacggccgtcggggtacctacgaggttaggtaacggtttccgtagacgaaggtccagttcgtaggaacttacctacccgttacaccgaacggacctaacgtattagtcgtcgtaacggttcgggcggtaaccgaccgggacccgggaccccggtaacggacgggtacgttagggtacggttaggacgtacgggtaacctaagtaccgttaaaccgtaagtagggtaggtacggtacgaacggtaccgtaacgcggaaacgtacggttaagtcggacgggactacggtacgtccgaccgacggtacccggacccgggtacgaccggtaccgaacggaggaccacgtacgtaccgtaacgtagttacgggtagttcggaacgtacgggtaggtacgttaaggacgtacggtaacgtacggaaccccgttacgggtacccggtttacccgttttgtttaaccgggtacggtccggaaacgggttcggtaaaaggggtaaccgggtaagttaaaaccgtacccggttaaacctttccgggttaccgtttaccctttaacgggttaccgtgggttaacggggtacccgggg

SEQ ID NO: 191063 - DNA, 693 bp, Homo sapiens
  misc_feature: GYAE6OF01CLJWN.42.42.D09.1.454.CMB.1.raw
  modified_base (167)..(167): a, c, t, g, unknown or other
  misc_feature (167)..(167): n is a, c, g, or t
  modified_base (182)..(182): a, c, t, g, unknown or other
  misc_feature (182)..(182): n is a, c, g, or t
  modified_base (238)..(238): a, c, t, g, unknown or other
  misc_feature (238)..(238): n is a, c, g, or t
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
tcagtgacgtatgtcacgaccggtgctcgatttagacacatacgcgaggggaaagggggcatcatccaacaaccacatcccttctctacagaagcctctgagaggaaagttcttcaccatggactggacctggtgggtcttctgcttcctggctgtagctccaggtnctcactcccgaggtncactggtgcagtcgtggggctgagtgaagacgcgtgggcctgagtgtaacggttcngcaaggcagtctgatacactcacagcacatgcgcngtggcgcgacgaccggtcccgaagaggtacgtagagngagtacggaactaagtacctaaccgtaagtacggtacggtaacgaactaggaacctacgcgtaacgaacggtaacgtaccggaggtacgaagtacggtaccgacgtacggtaccgggaacccgggaccgaccggtacccgaacggtacgaccgaacggtacgtacctaaacgtaggtcgggtaagttacggacgtaccgaagggcgttaaggaagtaacgtagtaccgggaaccgacgggttacccgttccgttttaccgtttagtcggacccggtaggaagggaaacggaaggggtaacgtaacgtaaaccggttaacccgttccggtttaccgggttaccctttcccggttttaacggaccgttacccggggtaaccgggg

SEQ ID NO: 191064 - DNA, 849 bp, Homo sapiens
  misc_feature: GYAE6OF01EFHWX.42.42.D09.1.454.CMB.1.raw
  modified_base (673)..(673): a, c, t, g, unknown or other
  misc_feature (673)..(673): n is a, c, g, or t
  modified_base (681)..(681): a, c, t, g, unknown or other
  misc_feature (681)..(681): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtacgctccgaggtgctcacctcccgaggttcgactaacgtggtgacgtaggtcgtggggtactaggaaggtagaaaggacgtccggtcggggcctagtagtagtaacggttttccagacgaggcagttcgtaggacttaccgaccgttccgaaccgacggtaccaaccgtaatacgttacgaccgtaacggtcggggttacgaacccggaaccggaacccggggacccccggtaaacggtaaacgggttaccggttaggtacgggttacgggtaacggttaacggggtaaccttaaacgtacccgtaaaacccgtaaggttaacggttacggtaacgacgtacgtaaccggtccgtaaaaaaaaccgcgtaaaccgtaacggttaccggaaacgggaccgtaaggtaccggtaccgtaccgttaacggtacccgggaaaccccggtaacgacccggttaacccgaacgtaacgtacctaacgtacggtaccgttaacgtaggtaggtaacgtcggaacgnggtacggntaagggagttaacacggtaacggaaccgaccggttacggttacccgtttaacgtttccggaacggtccggtaacggtacggaaagggtaaggtacgttaacgaaacgttacccggtaaccgtttcccggttaccctttacgttaccggtaacgtcggggtaacccggg

SEQ ID NO: 191065 - DNA, 724 bp, Homo sapiens
  misc_feature: GYAE6OF01CCXDX.42.42.D09.1.454.CMB.1.raw
  modified_base (196)..(196): a, c, t, g, unknown or other
  misc_feature (196)..(196): n is a, c, g, or t
  modified_base (579)..(579): a, c, t, g, unknown or other
  misc_feature (579)..(579): n is a, c, g, or t
tcagtgacgtatgtcacgaccggtgctcgatttagacacatacgcagggaaagggggcatcatccaacaaccacatcccttctctacagaagcctctgagaggaaagtttcttcaccatggactggacctggtgggtcttcgtcgcttccgtggctgtacgctccgaggtcgctcacctccgaggtcactagtggncgagtcgtggggctaggagtagaaacgcgtccggtagggccttagaggttacgtacgttcagacgagctagtcgtaggtactaccgtacctacgacgacgactactagtacgacgtacgtggtacggacgaccggaccggacccgggtacccggtaaggtaacggtacgtacggtaggtacggtaacgtacggtaactaacgtaaccgtaacgttaggtacggtaggaacgaacgaacgtaccgtacgacgtaacgtaaacggtacggtaccggacggacgacgtaccgaccgtaccgtaccggaccgggtaccggacgtaccgaccggaacgtaccgtacgaacgtactacgtacggtaggtacggtgtaacggacgtacgnggtacgaggtaacgtacgtacgacgtaccggtaccgttaccggttacgtttacgtcgacggtacgagtaacgggacggtaaggtaccgtaacgaaccgttacgtccggtttacgttaccttaggtaccggtcggtacggtacggg

SEQ ID NO: 191066 - DNA, 999 bp, Homo sapiens
  misc_feature: GYAE6OF01D41DI.42.42.D09.1.454.CMB.1.raw
  modified_base (172)..(172): a, c, t, g, unknown or other
  misc_feature (172)..(172): n is a, c, g, or t
tcagtgacgtatgtcacgaccggtgctcgatttagacacatacgcagggaaagggggcatcatccaacaaccacatcccttctctacagaagcctctgagaggaaagttcttcaccatggacgtggaccgtggtgggtcttctgtcttccgtggctggtagcctccgaggtnctcgacctcccgtaggtgactacgtggtcgacgtagtcggtggggtactaggtaaacggtaggaaacggaacggtccggtacggggtacctacgtaggttacggtaaccggttttcccgaggaccgtaaggccgtacgttcggtaggtaaaccttaccctaacccttaccgaaccggacgtaccaacctattagccggtaccgtacgggttacgggcggaaccggtacccggaaccccggggtacccccggtaaaggtaaccgggttacgttaacgggacgggtagggtaacgggtacgggttaaaacctaaccgtaaacccgtaaaaccgtttaagggttaaggttaaccggggtaaacggtaaaccgtaacggtaacccgtaacgtacccgaaacggttaaaccgggtaacggttacccggaaacggggtacctaaagggtacccggttaccccgaaccgtaaccgggttaaccccggggaaccccgggtaacccgaacccggttaacccggaaccggtaaccgaacccgtaaccggtaaccggtttaaccctaagggttacgggtaaacgggttaccgttgggaaaccggtacgggtaacggacggttagggtaaagccggttaacggtaccggaacggtacccgggttacgggttaccgttttaggttaacgggtcggaaccgggtaaccggtaaagggggaaacgtaaacgggggttaacccgtaaacgaaacccggttaaccggttttacccgtaccgggttttaacccccgtttttacccgggttagggttaaaccccggcgggggttaaacccgggggg

SEQ ID NO: 191067 - DNA, 820 bp, Homo sapiens
  misc_feature: GYAE6OF01CXLFZ.42.42.D09.1.454.CMB.1.raw
  modified_base (191)..(191): a, c, t, g, unknown or other
  misc_feature (191)..(191): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctcgaggtcgctcacctcccaggtgacacgtggtncgagtcgtggggctagagtgaagacgccgtgggcctacgaggttacggtaacggtttcctagtacgaaggctacgtcgaggtaactaccgtacccttaccgaaccgacggacctaacctagttacgcgtacgtacggttcggtacggaccggtaacccgaccgggtacccccgaagtaaacggtacggttacggtaggtacgaggtacggtaacctaactacccgtaaacgtagtaggtacggtaacgacaacggtaccgtacggaactaacggaacggttaacgtaccggagggtaccgaggtaccggtaccgaccgtacgggtaacccgggccccggtaaaccggtaccgtaaccgaacggtaccgtaccgaaacgttccggtactaacgtggtacggttaggtacggaacgtacgggtaccggtagtagtaagtaacgtacggggtaccgaacggttaacccggttccggttaccgtttttacgttaccgggttaccggcgggtaacgtaaggggtaaaccgggtaaggtaacccggttaaccgaacggttaaaccccgtttccggttccggtttaacccgtttcccgggttttaacggtacccgggttccgggggtaacccgggg

SEQ ID NO: 191068 - DNA, 508 bp, Homo sapiens
  misc_feature: GYAE6OF02I6BF4.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttgagtggatggggactaatcaaccctaatagtggtaggacagactacgcacagaagttccagggcaggagtcgccatcggacccgggacaccgtccacgagccacagtctacagtggagttgagcaggctgagatatgacgacacggcttctttatgcgcgagagaggatacagaactctggtcctcctttgactgtcggg

SEQ ID NO: 191069 - DNA, 515 bp, Homo sapiens
  misc_feature: GYAE6OF02ILDVW.42.42.D09.1.454.CMB.1.raw
  modified_base (440)..(440): a, c, t, g, unknown or other
  misc_feature (440)..(440): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaaggtttcctgcaaggcatctggatacaccttcaccaggcaccatatgcactgggtgcgacaggcccccggacaagggacttgagtggatggggactaatcaaccctaatagtggtaggacagactacgcacagaagttccagggcaggagtcgccatgacccgggacacggtccacgagcacagtctacatggagttgagcagggctgagatangacgacacggccgttcttttatgcgcgagaggaagggagtacagaaactctggtcctcctttgactacgtcgggg

SEQ ID NO: 191070 - DNA, 540 bp, Homo sapiens
  misc_feature: GYAE6OF02IIJA9.42.42.D09.1.454.CMB.1.raw
tcagtgacgtatgtcacgaccggtgctcgatttagacacatacgcaggggaaagggggcatcgatccaacaaccacatcccgttctctacagaagcctctgagaggaaagttcttcaccatggactggacctggtgggtctttcgtgcttcctggcttgtagctccaggttgctcactcccaggtgcaactggtgcagtctggggctggaagtgaagagcctggggcctcgagtgaaggtttcctgccaaggcatctggatacaccttcacccaggcaccatactgcactgggtgcgacgacgggcccccggacgaaggaccttggacgtggatggggacttaagtcaaccctatagtggtaggacagactacgcacagagttccaggcagacgtcgcacgtcgacccgggcacgtccacgacgcacagtctacatggattgagcaggctgagactatcgacgacacggcttctttatcgcgcgagtagaaggagtacgagaactcgtacggttactcccgtttaggacctacgtcgggg

SEQ ID NO: 191071 - DNA, 512 bp, Homo sapiens
  misc_feature: GYAE6OF02F62G8.42.42.D09.1.454.CMB.1.raw
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggttcctgcaaggcatctggatacaccttcaccaggcaccatatgcactgggtgcgacaggcccccggacaaggacttgagtggatgggactaatcaaccctaatagtggtaggacagactacgcacagaagttccagggcagagtcgccatgacccgggacacgtccacgagcacagtctacatggagttgagcaggctggagatatgacgacacggccgtntttatgcgcgagnggaagggagtacgagaacgtctggtcctccttttcgacttagtcggg

SEQ ID NO: 191072 - DNA, 723 bp, Homo sapiens
  misc_feature: GYAE6OF02H125R.42.42.D09.1.454.CMB.1.raw
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagagccgtgggcctcagtgaaggttcctgcaaggnatcgtggatacaccttcaccaggcaccatatgcacgtgggtgcgacgacggcccccggaanaacggaccttagaggtcggataggggactaagtccgaaacctaagtagtaggtaggacaggactacgacaacagagttaccagggacagaacgtccgccagtcggaccccgggacgaccgtccaacgacgacgaaccaggttcctaaccgagttacgggtagttacgggaacgtcgaacggggtaccgttagggaaaggtaacgtttaagtaccgggaaaccgggtaaacccgtaacccgggggtacccggtttacccgttttttttaaggtaccggtaccgggttacccgggaaaggtaaggggtaaacggggtaacggggtaacctaaaccgggtaaaacccgtttcccggtaacgggtttccccgttttacccgggtttttacccgtaccgggtttaacccggttaacccggggggg

SEQ ID NO: 191073 - DNA, 515 bp, Homo sapiens
  misc_feature: GYAE6OF02F3Y2G.42.42.D09.1.454.CMB.1.raw
  modified_base (391)..(391): a, c, t, g, unknown or other
  misc_feature (391)..(391): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcattgggtgcgacacggcccccggacaaggacttgagtggatgggactaatcaacctaatagtggtagacagactacgcacagaagttccagggcagagtcgccatgacccggganacgtccacgagcacagtctacatggagttgagcaggctgagatatgacgacgacggtccgttcttttagtgcgcggaggaggaagggagtacgagaactctggtcctccttttgactagtcggg

SEQ ID NO: 191074 - DNA, 513 bp, Homo sapiens
  misc_feature: GYAE6OF02I9UKL.42.42.D09.1.454.CMB.1.raw
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaagggacttgagtggatgggactaatcaaccctaatagtggtaggacagactacgcacagaagttccagggcagagtcgccatcgacccggganacgtccacgagcacagtctacatggattgagcaggctgagatatgacgacacggccgttntttatgcgngagagaagggntacagaactccgtaggtcctccgtttgacctagtcgggg

SEQ ID NO: 191075 - DNA, 518 bp, Homo sapiens
  misc_feature: GYAE6OF02IS73B.42.42.D09.1.454.CMB.1.raw
  modified_base (300)..(300): a, c, t, g, unknown or other
  misc_feature (300)..(300): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (453)..(453): a, c, t, g, unknown or other
  misc_feature (453)..(453): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggacttgagtggatgggactaatcaaccctaatagtggtaggacagactacgcacagaagttccagggcagagtcgcatgacccgggacacggtccacgagcacagtctanatggagttgagcaggctganatatgacgacgacggccgtnttttatgcgtcgagaagaagggagtaacagaaactccgtggtccttccttttgactcgtacgggg

SEQ ID NO: 191076 - DNA, 515 bp, Homo sapiens
  misc_feature: GYAE6OF02FNHUJ.42.42.D09.1.454.CMB.1.raw
  modified_base (454)..(454): a, c, t, g, unknown or other
  misc_feature (454)..(454): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactggtgcgacaggcccccggacaaggacttgagtggatgggactaatcaaccctaatagtggtaggacagactacgcacagaagttccagggcagagtcgccatcgacccgggacaccgtccacgagcacagtctacatggagttgagcaggctgagatatgacgacacggccgttntttatgcgcgaggaggaagggagtacgagaactcgtggtccttcctttgactacgtcgggg

SEQ ID NO: 191077 - DNA, 543 bp, Homo sapiens
  misc_feature: GYAE6OF02G2F2B.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaaggacttgagtggatgggactaatcaaccctaatagtggtagacagactacgcaacagaacgtccagggcagagtcgccagtcgacccgggacacgtccacgagcacagtctacagtcggagttgagcaggctagagatagtgacgacgaccgggtccgtttactttagtgcgcgaggaaggaagggataacgaagaaccgtccgtggttccttcccgttttagaccttacggtaccgggg

SEQ ID NO: 191078 - DNA, 532 bp, Homo sapiens
  misc_feature: GYAE6OF02GE7QC.42.42.D09.1.454.CMB.1.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (379)..(379): a, c, t, g, unknown or other
  misc_feature (379)..(379): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagtgacgtatgtcacgaccggtgctcgatttagacacatacgcagggaaagggggcatcatccaacaaccacatcccttctctacagaagcctctgagcgggagttgtcacgacgtcgactaggactgtggtctctgctcctgctgtagctccaggtgctcactccaggtgcactggtgcagtcgtgggctgaagtgaagagcctgggcctnagtgaaggtttccngcaaggcatctggatacnccttcaccaggcacatctgcncgtggcgcgacacggccccgagaagcttagagtggatggactactcaacctatagtggtagacagactacgcacgagacgtccgaggcagacgtcgacagtcggacccgganacgtccagagctacgacgtnacagtcggagtcgagcaggctgagntacgtgacncgacgtttccgtgtttatcgcgacgtaggaaggaggtacgtacgaacgtaacgttcccgtcggttccgttaccccgtttagtacccgttacgaccgggg

SEQ ID NO: 191079 - DNA, 534 bp, Homo sapiens
  misc_feature: GYAE6OF02FHKRA.42.42.D09.1.454.CMB.1.raw
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggacttgagtggatgggactaatcaaccctaatagtggtaggacagactacgcacagaagttccagggcagagtcgcatgacccgggacacgtccacgacgcacagtctacatggagttgagcagggctagagatatgacgacacggtccgttcttttatgacgcgaggtaggaagggagtaacgagtaaaccgtccgtaggttccttcccgttttagaccttacgtcgggg

SEQ ID NO: 191080 - DNA, 562 bp, Homo sapiens
  misc_feature: GYAE6OF02H1D1N.42.42.D09.1.454.CMB.1.raw
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctgggctgaagtgaagaagcctgggcctcagtgaaggtttccngcaaggcatctggatacaccttcacaggcaccatatgcactggtgccgacacggcccccgganaaggacttgacgtggatgggactaagtacaaccctaatagtggtagacagactacgcacagacgtcaggcagagtcgcagtcgacccggacacgtccacgagacacgacgtcacgagtaggagttgagacgacggctagacgtatacgtagacgacgacggtccgttacttttacgtcggacgtacggaggaacggtaagggtacgtaacgaacgtaaaccgtccgtacggtccttacccgttttgaccgttaccgtacggggg

SEQ ID NO: 191081 - DNA, 523 bp, Homo sapiens
  misc_feature: GYAE6OF02H95AS.42.42.D09.1.454.CMB.1.raw
  modified_base (284)..(284): a, c, t, g, unknown or other
  misc_feature (284)..(284): n is a, c, g, or t
  modified_base (446)..(446): a, c, t, g, unknown or other
  misc_feature (446)..(446): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtncggacacggcccccggacaacggacttgagtggatgggactaatcaaccctaatagtggtaaggacagactacgcacagaagttccagggcagagtcgccagtcgacccgggacacgtccacgagcacagtctacatggagttgagcgaggcgtgagatagngacgacaccggccgttcttttagtgcgacgaggaaggaagggagtaacagaactcgtgtcttcctttgactgtcggg

SEQ ID NO: 191082 - DNA, 614 bp, Homo sapiens
  misc_feature: GYAE6OF02H7WUD.42.42.D09.1.454.CMB.1.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttccngcaaggcatctggatacacttcaccnggcaccatatgcactgggtncgacaggcccccgganaaggacttgagtggatgggaactaatcaacctaatagnggtaggacaagactacgacacgaagtaacgttccagggccagagtccgccaagtcggaccccgggacacgtccaacgagccaacgagtctaacagtaggagtttagagcgaggctaggaagtatagtgaaccgacgaaccgggtccgttaccgtttttaagtcggaccgtaccgggaaggtacgggaaaggggtaacgtaaccgtaaacggaaaccctttccggtacgggttccccttttacccggtttttaggacccgttaccgggttaccggggg

SEQ ID NO: 191083 - DNA, 607 bp, Homo sapiens
  misc_feature: GYAE6OF02IEJ0Z.42.42.D09.1.454.CMB.1.raw
  modified_base (303)..(303): a, c, t, g, unknown or other
  misc_feature (303)..(303): n is a, c, g, or t
  modified_base (485)..(485): a, c, t, g, unknown or other
  misc_feature (485)..(485): n is a, c, g, or t
tcagtgacgtatgtcacgaccggtgctcgatttagacacatacgcagggaaagggggacgatcatccaacaaccacatcccttctctacagaagcctctgagaggaaagttcttcaccatggactggacctggtggggtcttctgcttcctggctgtagctccaggtgctcactcccaggtgcaactggtgcagtctggggctgagtgaagaagctggggcctcagtgaaggtttcctgcaaggcatctggatacaccttcaccaggcaccatatgcatgggtgcgacacggccccccggaanaacggaccttgaggtggatggggaacttaagtccaaacccttaagtaggtaggtaacggacaaggactacggacaacgagaacgttcccgagggacagaggtccgccagtcggacccgggacaccggtaccacgaacgccgaaccagtcctaaccgaagtcggaagttgagaccgaggttcnggagaatagtgaacgacaccgggtcttcctttagtcggacgcggtacggaaggagggacgttaacgaacgtaaccgttctacgggttcccttacccggttttagaccttaacggtccggggg

SEQ ID NO: 191084 - DNA, 560 bp, Homo sapiens
  misc_feature: GYAE6OF02I84DB.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctgggcctcagtgaaggtttcctgcaaggcatctggatacacctcaccaggcaccatatgcactgggtgcgacgacggcccccggacgaaggactgagtggagtggacgtaatcaaccctaatagtaggtagacagactacgcacgagtagtccgagggcagagtcgccagtcggacccgggtacaccgtaccacgacgcacagtcacagtggagttgagcgaggctagagtactagtacggacgaacgtaccgggtccgttactttttagtcgacgccggaggaaggaagggacgtaacgaagaaccgtcttacgggtcttaccccgttttgacctacggtcgggg

SEQ ID NO: 191085 - DNA, 519 bp, Homo sapiens
  misc_feature: GYAE6OF02HLGKQ.42.42.D09.1.454.CMB.1.raw
  modified_base (456)..(456): a, c, t, g, unknown or other
  misc_feature (456)..(456): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttgagtggatgggactaatcaaccctaatagtggtaggacagactacgcacagaagttccagggcagagtcgccagtcgacccgggacacgtccacgagcacagtctacgatggagttgagcaggctgagatatgacgacgacggccgtnttttagtgcgcgaggagaagggagtaacgagaactctggtccttccctttgactacgtcgggg

SEQ ID NO: 191086 - DNA, 752 bp, Homo sapiens
  misc_feature: GYAE6OF02JEO7F.42.42.D09.1.454.CMB.1.raw
  modified_base (238)..(238): a, c, t, g, unknown or other
  misc_feature (238)..(238): n is a, c, g, or t
tcagtgacgtatgtcacgaccggtgctcgatttagacacatacgcagggaaagggggacgatcatccaacaaccacatcccttctctacagaagcctctgagaggaaaggttcttcaccatggactggacctggtggtcgttctgcttcctggctgtagctccaggtgctcactcccaggtgcaactggtgcagtctggggctgaagtgaagaagctgggcctcagtgaaggtttccngcaaggcatctggatacaccttcaccaggcaccgatatgcactgggtgcgacacggcccccggtacaagggtaccttgggaagtcgggaatcgggggaacttaaacgtccgtaaaaccctaaagtaggtaggttagggaacctaaggaaccttaaccggacaacaacggtaaacggtttacccgacggggacgaacgaacggttccggacccacgttacggaacccccggggtagaacccggttacccgaaccggacgccaaacgtacgtacgtaaccgagtacgggtaacgtttagggaacgtaccgaggggtccgtaaggtaacggaacgtaagtttacggaaccgtaaccgtaacccggggacccgttttcgttttttaaagtcggtcgtaccgggtaacggaaggggtaaaacggggtacggtaacgtaaacggaaaacccggtttcccgtaggggtttaccctttccccgggttttttaacccggagtttttaaaccccgggcgggggg

SEQ ID NO: 191087 - DNA, 509 bp, Homo sapiens
  misc_feature: GYAE6OF02GS97Y.42.42.D09.1.454.CMB.1.raw
  modified_base (448)..(448): a, c, t, g, unknown or other
  misc_feature (448)..(448): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttgagtggatgggactaagtcaaccctaatagtggtagacagactacgcacagaagttccaggcagagtcgccatgacccggacacgtccacgagcacagttacagtggagttgagcgaggctgagatatgacgacacgctntttatgcgcgagaggaaggagtacaagaactcctggtctccgtttgacttacgtgggaccg

SEQ ID NO: 191088 - DNA, 591 bp, Homo sapiens
  misc_feature: GYAE6OF02HLUM6.42.42.D09.1.454.CMB.1.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (303)..(303): a, c, t, g, unknown or other
  misc_feature (303)..(303): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagcctgggcctnagtgaaggtttccngcaaggcatctggatacaccttcaccaggcaccatatgcacgtgggtgcgacgacggcccccgganaaggacttgagtggagtgggactaatccaacctaatagtggtacgacagactacgcacagtacgtcgagggacagagtcgaccagtcggacccgggacaccgtccacgacgacacgagtctacagtggtacgttgagcaggctaggagatagtcgaacgtaccgaaccgggtccgttacgttttagtcggccggacgtaggaaggtaacgggtaagtacggtaacggtaaaccgttccggttacgggttcccctttacccgttttacggaccgttacggtaccggggg

SEQ ID NO: 191089 - DNA, 515 bp, Homo sapiens
  misc_feature: GYAE6OF02JFJMS.42.42.D09.1.454.CMB.1.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacnggcccccgganaaggacttggagtggatgggactaagtcaaccctaatagtggtagacagactacgnacgagaagttccagggcagagtcgccatcggacccggganaccgtccagngcacagtctacatggattgagcaggctgagatangacgacncggtccgttntttatgcgngagaggaaggagtaacagaactctaggtccttcctttgactgtacgggg

SEQ ID NO: 191090 - DNA, 565 bp, Homo sapiens
  misc_feature: GYAE6OF02H30FB.42.42.D09.1.454.CMB.1.raw
  modified_base (306)..(306): a, c, t, g, unknown or other
  misc_feature (306)..(306): n is a, c, g, or t
  modified_base (418)..(418): a, c, t, g, unknown or other
  misc_feature (418)..(418): n is a, c, g, or t
  modified_base (510)..(510): a, c, t, g, unknown or other
  misc_feature (510)..(510): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggttcctgcaaggcatctggatacaccttcacaggcaccatatgcacgtgggtagcgaacgacgggccccccggaanaacgggactttgaggtggagtggggaactaatccaaaccctaatagtggtaggacagactacgcacagtaagtccagggcagagtcgacagtcgacccggacacgtccagancacagtctacagtggagttagagtcgaaggctaggaagactagtgacgacaccgggtcttactttagttgccgtacggagaaggaaacgggntaacgaacgtaacgtccgtacggtccttaccgttttaggacttacggtaccgggg

SEQ ID NO: 191091 - DNA, 513 bp, Homo sapiens
  misc_feature: GYAE6OF02HPG60.42.42.D09.1.454.CMB.1.raw
  modified_base (300)..(300): a, c, t, g, unknown or other
  misc_feature (300)..(300): n is a, c, g, or t
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggacttgagtggatgggactaatcaaccctaatagtggtaggacagactacgacacagaagttccagggcagagtcgccatcgacccgggacacgtccacgagcacagtctacatggagttgagcaggcnggagatatgacgacacggccttntttatgcgngagaggagggatacgagaactcgtggtccttcctttgactacgtcgggg

SEQ ID NO: 191092 - DNA, 518 bp, Homo sapiens
  misc_feature: GYAE6OF02IFTHI.42.42.D09.1.454.CMB.1.raw
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtncgacaggcccccggacaaggacttggagtggatgggactaatcaaccctaatagtggtaggacagactacncacagagttcagggcagagtcgcatcgacccgggacacgtccagacgcacagtctacatggagttgagcaggctgagatatgacgacgacgtcgtntttagtgngcgtagaggaaggagtacgagaaactcgtaggttcctaccgttttcgactacgtcgggg

SEQ ID NO: 191093 - DNA, 807 bp, Homo sapiens
  misc_feature: GYAE6OF02HR61I.42.42.D09.1.454.CMB.1.raw
  modified_base (235)..(235): a, c, t, g, unknown or other
  misc_feature (235)..(235): n is a, c, g, or t
tcagtgacgtatgtcacgaccggtgctcgatttagacacatacgcagggaaagggggcatcatccaacaacctacatcccttctcttacagaagcctctgagaggaaagttcttcaccatggactggacctggtgggtcttctgcttcctggctgtagctccaggtgctcactcccaggtgcaactggtgcagtcgtgggctgaagtgaagagctgggcctcagtgaggtttccngcaaggcatctggatacaccttcaccaggcaccatatgcacgtgggtgccgtacgacgggtccccccgggagaaacgggtaccgttaggacgtgggaagttcggggtaacttaaacgttaccgtaaacccgttaaagttaggtacgggttacgggaacaacggaccgttaacggccgaaccgtaacggtaacggttttacccgaagggggtacctaacgggacggtttacccggaccctaaggttacccgggaaaccccggggtaaaccgaacccggtttaccccggaaccggaaacgggacccctaaaccgtaacgggtaccttaaaccgtaacgttaccgggaaagttttcgggaaacggtacgaacgggtaccgtagggaacggtaacgttaacgtacgggaaccggtaaccgtaacccgggggtttacgtttaccgttttttagtacggtaccgggtaccggtaagggtaacgggtaacgggtaacgttaaccgaaacggttaacccgtaccggtttcggtacccgttttcccggttttaacggtaccgttaccggttacccgggggg

SEQ ID NO: 191094 - DNA, 588 bp, Homo sapiens
  misc_feature: GYAE6OF02HCNCW.42.42.D09.1.454.CMB.1.raw
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
  modified_base (446)..(446): a, c, t, g, unknown or other
  misc_feature (446)..(446): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttccngcaaggcatctggatacaccttcaccaggcaccatatcgcacgtgggtgcgacgacggcccccgganaaggacttggacgtggagtcgggactaatacaaaccctataggtagtaggacagactacgcacagaagtcaggcagagtcgcagtcgacccggacacgtccacgagacacgacgtctacagtggagttgagcgaggcagganagtagtacgacgacgaccggtccgttacgtttttagtcggtcgtacggaaggtaaggaacggggtaagtaacgaacgtaaaccgttcccgttagggttccctttaccccggtttttacggaccgttaccggtacccgggggg

SEQ ID NO: 191095 - DNA, 642 bp, Homo sapiens
  misc_feature: GYAE6OF02GNAA8.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtgggcctcagtgaaggtttcctgcaaggcatcgtggatacaccttcaccaggcaccatatgcacgtgggtgcgacgacggcccccgagaacggtctggagtggagtgggaactaataccaaaccctaataggtaggtaagacgagactacgacacagaacgttacgaggacgagacgtcgaccacgtacggacccgggacaccggtaccacggacgaccacgtacgtactaacgagtagggtagttagacgacggaaggcgttaggaagtagttaagtacggaaccgaaccgtaccgggtacccgtttagtttttaacgtcggtaccgtacggaaggaacgggtaaagggtacggtaaacgaacggtaaacccgttccgttacggttaccctttcccggttttacgtacccgttacggtacccgggg

SEQ ID NO: 191096 - DNA, 606 bp, Homo sapiens
  misc_feature: GYAE6OF02H8LHH.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggataccaccttcaccaggcaccatatgcacgtgggtgcgacgacggcccccggaacgaacggacttgaggtggagtgggactaatacaacctaagtagtaggtaggacagactacgacacgagagtacaggcagagtcgcatcggacccggacaccgtcccaacggagaccgaacgagtacctaacgaagtggagttagagacgaggctaggagtataagtaggaaccgtacgaccggtccgtttatttttacgtggccgtacggtaaggaaggaaagggtacgtaaccgaaagaaacccgttccgtacgggttaccctttaccccgtttttaggacccgttaccggttaccggggg

SEQ ID NO: 191097 - DNA, 756 bp, Homo sapiens
  misc_feature: GYAE6OF02JL8Z7.42.42.D09.1.454.CMB.1.raw
  modified_base (243)..(243): a, c, t, g, unknown or other
  misc_feature (243)..(243): n is a, c, g, or t
  modified_base (313)..(313): a, c, t, g, unknown or other
  misc_feature (313)..(313): n is a, c, g, or t
  modified_base (439)..(439): a, c, t, g, unknown or other
  misc_feature (439)..(439): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagccgtggggcctcaggtcgaagggtttccngacaaggcatctggatacaccttcacctaggcaccgatactgcactgggtacgcgacacggcccccgganaggacttggacgtggagtgggactaataccgaaacccgtaataggtacgtaggacacgaacgttacacgaacagtaaacggttcccaaggggtcaaggagtaccgccaagtcggaccccgggtaanaacccggttaccaccggacgaccgaaccaggtacctaacgacgttacgggacgtttggaacgtcaaacgggtcttaacgggacggaaacgtttacgtacgggaaacccgtaacccggtaaccggggttacccggttttaaccttttttaacgggttacccgggttaccgggacccgggtaacgggttaaaaggggaaccgggggttaaggtaaaccgtaaccgggtaaaaacccgtttccccgggttaaggggttttacccccttttaaccccggtttttaaccggggttaccgttaaaccgggtttcccggggggg

SEQ ID NO: 191098 - DNA, 643 bp, Homo sapiens
  misc_feature: GYAE6OF02J090W.42.42.D09.1.454.CMB.1.raw
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctgggcctcagtgaaggtttccngcaaggcatctggatacaccttcaccaggcaccatatgcactggtgcgacgacggccccganaaggcttgagtgatgggatatcaacctaatagtggtaggacagactacgcacagaacgttccgagggcagagtcgacagtcggacccgggacacgtaccacgtacgcaactagtctacagtgggagttgacgtcgaggcgtacgagtacttagtacggaacggtacgtaaccggtccgtttacgtttttaacgcggtaccgtaccggtaaggaaacgggtaacgggggttaaaccggtaacccgttaaacggtaaaaccccgtttccccgggtttagggtttaacccccgttttaccccggtttttaacgggtaaccccggtttaacgggttaaccccgggggggg

SEQ ID NO: 191099 - DNA, 524 bp, Homo sapiens
  misc_feature: GYAE6OF02G1XJ3.42.42.D09.1.454.CMB.1.raw
  modified_base (284)..(284): a, c, t, g, unknown or other
  misc_feature (284)..(284): n is a, c, g, or t
  modified_base (457)..(457): a, c, t, g, unknown or other
  misc_feature (457)..(457): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtncgacacggcccccggacaacggacttggagtggatgggactaatcaaccctaatacgtaggtaggacagactacgcacagagtcaggcagagtcgccatcgacccggacacgtaccgacgagcacagtctacgatggagttgagcaggctgagatatgacgacacggccgttntttatgcgacgagaggaagggagtacgagtaactcgtggtccttaccctttagacctacgtacgggg

SEQ ID NO: 191100 - DNA, 533 bp, Homo sapiens
  misc_feature: GYAE6OF02G9RH3.42.42.D09.1.454.CMB.1.raw
tcagtgacgtatgtcacgaccggtgctcgatttagacacatacgcagggaaagggggaatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaacggacttgagtggatgggactaatcaaccctaatagtggtaggacagactacgcacagaagttccagggcagagtcgccatcgacccgggacacgtcccacggagcacagtctacagtggagttgagcaggctgagatatgacgacacggccgttcttttatgcgcgagaggaagggatacgagaaacgtccgtggttccttcccgttttggacttacgtggggtaaccgg

SEQ ID NO: 191101 - DNA, 589 bp, Homo sapiens
  misc_feature: GYAE6OF02I2KE1.42.42.D09.1.454.CMB.1.raw
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcagtgaaggtttcctgcaaggcatctggatacaccttcaccgaggcacatatgcactggtgcgacgacggcccccggacgaacggacttgaggtggagtgggactaatcaacctaataggtggtagacagactacgacgacagaagttccgaggacgagacgtcgcagtacggaccggacacgtccgacgacgcacgacgtactactagtgtagttaggacgcgaggctaggaacgtagtagtacgacgaccgtaccggtccgtttacgttttagtcgcgtacggaaggtaaggaacgggtaagtaacgaacggtaaccgtccgttacggttacctttcccggtttacgtaccgtcggttaaccgggg

SEQ ID NO: 191102 - DNA, 554 bp, Homo sapiens
  misc_feature: GYAE6OF02FU1FB.42.42.D09.1.454.CMB.1.raw
  modified_base (438)..(438): a, c, t, g, unknown or other
  misc_feature (438)..(438): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtgaaggtttcctgcaaggcatctggatacaccttcaccaggcaccatatgcactgggtgcgacgacggcccccggacaacggacttgaggtggagtgggactaatcaaccctaatagtggtaggacagactacgcacagaagttccagggcagagtcgccagtcggacccgggacacggtccacgacgacacagtctacagtggagttgancggagctgagatagtgacgacgacggtccgttcttttagtcgcgcgaggaaggaagggacgtaacgaacgaacgtccgtcgttccgttcccgtttagtaccgttacggtaccgggg

SEQ ID NO: 191103 - DNA, 832 bp, Homo sapiens
  misc_feature: GYAE6OF02H72KY.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaactggtgcagtcgtggggctgaagtgaagaagcgtggggcctcgagtggtaaggtttcctgacgaaggcatcgtggactacctaccttacaccgacggacaccaatatgctacgtggtgacgacgaccggaccccggaaccgcggtaaaaaaaaaaaaaaaaaacgttggaggtacgggtaggtacgggaacgttaaacgtaaccgtaaacccgttaaacgttaacggttaacgggttaacgggtaacgtaacggtaaccgttaaccgaaccgaaacgtaaacggtaacggttaacccgtaacggggtaccggaacggtaacggtacccggtacccgtaacggtacgggaaccccggggaacccggtaaccggtacccgaaccggaacggaccgaaccgtaacggtaaccgttaaccgtaacgttacgggtaggttacggtaacggacggtaacgggtcggtacggaaggtaacgtaacgtacggtaaccggtaaccggtaaccgggtaccggttaccgttttaacgttcggtacggtacggtaacgggtaagggtaacgggtaacggtaacggtaaaccgtaaaccgttaccggttaccggttacccgttttacccgttttacggttacccgttaccggttacccgggg

SEQ ID NO: 191104 - DNA, 538 bp, Homo sapiens
  misc_feature: GYAE6OF02HMN00.42.42.D09.1.454.CMB.1.raw
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacgacggcccccggacgaaggacttgagtggagtgggactaatcaaccctaatagtaggtagacagactacgcacagaagttccgaggcagagtcgaccatcggacccgggaacacgtcccacgacgcacacgtctacatggagttgagcgaggctagagagtanagacgacacggtccttnttttatgcgacgaggaagaaggagtacgaacgaactcgtacggtccttaccgtttagactacgtacgggg

SEQ ID NO: 191105 - DNA, 522 bp, Homo sapiens
  misc_feature: GYAE6OF02I2J1E.42.42.D09.1.454.CMB.1.raw
  modified_base (298)..(298): a, c, t, g, unknown or other
  misc_feature (298)..(298): n is a, c, g, or t
  modified_base (389)..(389): a, c, t, g, unknown or other
  misc_feature (389)..(389): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctgggcctcagtgaaggtttcctgcaaggcatctggatacaccttcaccaggcaccatatgcactgggtgcgacaggcccccgganaaggccttgagtggatgggactaatcaacctaatagtggtagacagactacgcacagaacgttccagggcaagagtcgccatgacccgganaccgtccacgagcacagtctacagtggagttgagcagactggagatagtgacgacacggccgttntttatgcgngagaggaagggagtacaagtaaactccgtaggttccttcccgtttgacttacgtcgggg

SEQ ID NO: 191106 - DNA, 571 bp, Homo sapiens
  misc_feature: GYAE6OF02HE2JT.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaacggacttgagtggagtgggactaatcaacctaatagtggtaggacagactacgcacagaagtcaggcagagtcgccgagtcggacccgggacacgtccgacgacgcacacgtctacagtggtagttgagcgaggctagagtatagtcgacgaccgacgggtccttacgttttagttcggcgacggtaggaacggaagggtaacgtaacgaacggtaaaccgttccgttcggtaccgttccccgttttggtaccgttacggtaccgggg

SEQ ID NO: 191107 - DNA, 549 bp, Homo sapiens
  misc_feature: GYAE6OF02F105D.42.42.D09.1.454.CMB.1.raw
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggcttgagtggatgggactaatcaacctaatagtggtagacagactacgcacagaagttccagggcaggagtcgccagtcggacccgggacaccgtccacggacgcacagtctacatggagttgagcagggctgagatagtgacgacgaccggtccgttacttttagtggacgcggaggaaggaagggagtacaaggtaaaccgtcgtacggttccttcccgttttagaccgttacggtaccggggg

SEQ ID NO: 191108 - DNA, 521 bp, Homo sapiens
  misc_feature: GYAE6OF02GP99P.42.42.D09.1.454.CMB.1.raw
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggacttgagtggatgggactaagtcaaccctaatacgtaggtaggacagactacgcacagaagttccagggcagagtcgcatcgacccgggacacgtccacgagcacagtcacatggagttgagcaggctggagatatgacgacacggccttactttatgcgcgaggaggaaggagtagaacgaactcgtacggtcttcccttttagactacgtcgggg

SEQ ID NO: 191109 - DNA, 514 bp, Homo sapiens
  misc_feature: GYAE6OF02F6XD4.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggccccccggacaaggaccttgagtggatgggactaatcaaccctaatagtggtagacagactacgcacagaagtccagggcagacgtcgaccatcgacccgggacacgtccacgagcacagtctacatggagttgagcaggctgagatagtgacgacacggcttctttagtgcgcgagaggaaggagtaacagaactcgtggtcctcctttgactacgtcggg

SEQ ID NO: 191110 - DNA, 642 bp, Homo sapiens
  misc_feature: GYAE6OF02I5WME.42.42.D09.1.454.CMB.1.raw
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtgggcctcagtgaaggtttcctgcaaggcatcnggatacaccttcaccaggcaccatatgcacgtggtgcgacgacggccccgagaacggactgagtggagtcgggaactaagtaccaaacccttaagtacggtggtaacggacaagacctacgcaacgaagtaacgttccgaagggccaaggtacgtaccgaccgaagtaccggaaccccggggacctaccggtaccgaaccggacgaccaaccgtacgtaccgtaacgagtacgggtagttcggacgcgaggacgtaggagtagtagtacgaaccgaccgtaccggtccgtttacgttttagtacggcgacggtaacggaagggtaaacgggagtaacgaacgtaacttccggttcggttaccctttccggtttacggaccgttcggtaccgggg

SEQ ID NO: 191111 - DNA, 586 bp, Homo sapiens
  misc_feature: GYAE6OF02HJTSB.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttcctgcaaggcatctggatacaccttcaccaggcaccatatgtcactgggtgcgacaggcccccggacaaggaccttgagtcggagtgggactaatcaacctaatagtggtagacagactacgcacagaagttccagggtcaggagtcgaccagtcggacccggacgaccgtccgacgagccacagtctacactggaacgttggagacgaggacttggaacgtagtagtagacgtaccgaaccgggtccgttacgttttactggccgtacggaggtaaggaaggggtacgtaacgaacggtaaaccgtccgtacggttcctttcccgttttagtaccgtagttacccggggg

SEQ ID NO: 191112 - DNA, 506 bp, Homo sapiens
  misc_feature: GYAE6OF02IZG18.42.42.D09.1.454.CMB.1.raw
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttggagtggatgggactaatcaaccctaatagtggtagacagactacgcacagaattccagggcagagtcgcatgacccgggacacgtccacgagcacagtctacgatggagttgagcaggctgagatangacgacacggcttntttatgcgngagaggaggagtacgagaactctggtccttccgtttgactcgtcggg

SEQ ID NO: 191113 - DNA, 607 bp, Homo sapiens
  misc_feature: GYAE6OF02IIUKC.42.42.D09.1.454.CMB.1.raw
  modified_base (305)..(305): a, c, t, g, unknown or other
  misc_feature (305)..(305): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggcaccatatgcacgtgggtgcgacgacggcccccgganaacggcttaggacggtgggactggggactaatccaaaccctaagtaggtggtaaggaacaggaactacggcaacagaagttcagggcagacgtcgacatcggacccggacacggtaccacgaagtcacagtcanagtggattcgagcagctagagtatangtaacgacgtaccggtccgttagttttaacgtgacggacggacggaaaggaacggggaacgttaaaccgaaacgtaaccgttacccggttagggttacccgtttaccccgtttttaggaacccgtttacggtaaccgggggg

SEQ ID NO: 191114 - DNA, 600 bp, Homo sapiens
  misc_feature: GYAE6OF02IPXLW.42.42.D09.1.454.CMB.1.raw
  modified_base (241)..(241): a, c, t, g, unknown or other
  misc_feature (241)..(241): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagccgtggggcctcgagtgaaggttttccnggcaaggcatcgtgatacaccttcaccaggcaccatatgcactgggtgcgacgacggccccggacaaggacttggagtggagtgggactaactcaacccttaatagtaggtacggacagaccgtacgcacgagtaacgttccgagggcaggacgtccgccagtcggaacccggacgaccgtccgacgacgcacacgtactacatggagttgagcaggctgagatatgacgacgacggtccgttacgttttagtgtacggtcgaacggaggaaagggtacggtaaccgaagggtaaaacccttccgggttacggtttaccgttaccccgttttaggtaacccgttaccgggtaaccgggg

SEQ ID NO: 191115 - DNA, 595 bp, Homo sapiens
  misc_feature: GYAE6OF02IOXJC.42.42.D09.1.454.CMB.1.raw
  modified_base (237)..(237): a, c, t, g, unknown or other
  misc_feature (237)..(237): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagcctgggcctcagtgaaggtttccngcaaggcagtctggatacaccttcaccaggcaccatatgcacgtgggtcgcgacacgggcccccggagaacggacttgaggtggataggggtactaaacgtaccaaacccgtaaataggtaggtagaacgagactacgacaacaagaacgttccgagggcagacgtcgacagtcgaacccggacacgtaccacgagaccaacacgtactaacgagtaggagttggaagcgaggtccgtaggaagtatagagaaccgacgacggtccgttacttttagtcgaccggtagaggaagggtaagggagtacgaagtaaccgtcgtacggttccttcccgtttagtaccgtacggtaccgggg

SEQ ID NO: 191116 - DNA, 524 bp, Homo sapiens
  misc_feature: GYAE6OF02IKPLH.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactggggtgcgacacggcccccggacaaggaccttgagtggatgggactaatcaaccctaatagtggtagacagactacgcacagaagttcagggcagagtcgccatgacccgggacacgtccacgagcacagtctacatggagttgagcaggctgagatatgacgacgacggtcgtcttttatgcgcggaggaagagggagtacaagaaactccgtaggtccttacccgtttgacctagtaccgggg

SEQ ID NO: 191117 - DNA, 592 bp, Homo sapiens
  misc_feature: GYAE6OF02HY1BV.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtgaacggttttcctgcaaggcatctggatacaccttcaccaggcaccatatgcacgtgggtgcgacgacggcccccggagaacggacttgagtggagtgggaactaagtacctaacctaagtaggtaggtaggacagactacgacacaagaacgtaccgaggcagagtcgacagtcggacccggacgaccgtccgacgagcacacgtacacagtggagttgagtcgaggctggaagtagtagtagaccgacgtaccggtcgttacgttttacgtggtaccgacggtaggaagggtaagggacgtaaccgaagtaaccgttccgttacggttcccttacccgttttagtaccgttacggtacgggg

SEQ ID NO: 191118 - DNA, 556 bp, Homo sapiens
  misc_feature: GYAE6OF02HC8RA.42.42.D09.1.454.CMB.1.raw
  modified_base (232)..(232): a, c, t, g, unknown or other
  misc_feature (232)..(232): n is a, c, g, or t
  modified_base (424)..(424): a, c, t, g, unknown or other
  misc_feature (424)..(424): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagagctgggctcagtgaaggtttccngcaaggcatcgtgatacacttcaccaggcaccatatcgcacgtgggtcgcgacgacggcccccggaacgaaggacttaggagtggatcgggactaactccaacctaagtagaggtagacagactacgcacaagacgttccgagggcaaggatcgaccagtcggacccggacacgtccagacgcactagctanagtggagttgagcgaggctaggaagtagagtacggacgacgacggtcgtagttttagtcgacgcgacggaggaagggactacgaacgtaacctcggtacgtaccgttacccgtttagaccgtcggtacgggg

SEQ ID NO: 191119 - DNA, 651 bp, Homo sapiens
  misc_feature: GYAE6OF02FJ08C.42.42.D09.1.454.CMB.1.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagtgacgtatgtcacgaccggtgctcgatttagacacatacgcaggggaaaggggcatcatccaactaaccgaccatcccgttacctctacgaaccgaagcctcctgacgtacggtaaacgtttccttccaccattcggacctgggaccctcggtgggtccttctagaccttcccgtggacttgtagtctccgagtgtctccacgtcccacggtgctaactggtcgacgagtctcgggctgacgtgaagagccgtgggcctcagtagtaacgtttccagacagctagtctggactacgaccttcaccaggcacctntactgctacgtggtcncgacacgcccganacggcgttcgagtggactcgggtactactaccaaccctaagtacgtaggtacgacgaggactacgcgtacgacggtaacgtcgacggtcacgcgtcgcacgtacgacccggacaccggtcgacggacgaccgacacgtctacgagtagtagtgtacgcgagtctaggtagtagtagtacgaccgtaccgtacggtccgttacgttttacgcggtaccggacgtacggaacggaagggtacgtaaacgtaggtaaccgttccggtacggttacccttaccgtttacgtaccgttacggtaccggg

SEQ ID NO: 191120 - DNA, 611 bp, Homo sapiens
  misc_feature: GYAE6OF02H7AOS.42.42.D09.1.454.CMB.1.raw
  modified_base (296)..(296): a, c, t, g, unknown or other
  misc_feature (296)..(296): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagagctgggcctcagtgaaggtttcctgcaaggcatctggatacaccttcaccaggcaccatatgcactgggtgcgacacggccccgganaaggacttgagtggatgggactaatacaacctaataggtaggtacggacagactacgacgaacaagacgttccagggcagagtccgacagtcggacccgggacacgtaccgacgacgacacacgtactaacgagtggagttagagccgaggcctaggaagagtagtacggaaccgaaccgaccgggtaccttacgtttttacgtcgtacggtacggtaaggaagggaacgggtaagtaaccgaaacggttaaacccgtcccgttacgggttaccctttacccggtttttacgtacccgggttacgtacccggggg

SEQ ID NO: 191121 - DNA, 737 bp, Homo sapiens
  misc_feature: GYAE6OF02IWAJC.42.42.D09.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (683)..(683): a, c, t, g, unknown or other
  misc_feature (683)..(683): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctgggtgtagctccaggtgctcactcccaggtgcaacgtggtgcagtcgtgggctgaagtgaagagccgtgggcctgagtgacggtttccngcaaggcatcnggatacaccttcaccagcaccgatagtgccacgtgggtcgacgaccgaccggaccccccggacgaaacggtccgtaggacggtagggtagttacggggaacttaacgtaccgaaaaccccgttaaagtacggttaggggttaaacggaacgaacggtaacccgttaacggaccgtaaacgtaaaagggtacggttaacccgggaacgggtaccgaaggtaacggtccgacccgtagaccgggaccccgggtaacacccggttacccgaaggaccgaccgaaccgtacgttaccgtaaccgaggttacgggacgttacggtacgacgttacgggacgtaggacgtaattacggacgaacgacgtccggttacgttccgtttaagtccggacgtacggaggtaaggaacggggtaacgttaacaaccgggttaacnccggttacgttaccgtttacccgtttagaaccggttacggtcgggtaacccggg

SEQ ID NO: 191122 - DNA, 599 bp, Homo sapiens
  misc_feature: GYAE6OF02HHY22.42.42.D09.1.454.CMB.1.raw
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
  modified_base (502)..(502): a, c, t, g, unknown or other
  misc_feature (502)..(502): n is a, c, g, or t
tcagtgacgtatgtcacgaccggtgctcgatttagacacatacgcagggaaagggggcgagtcatccaacaaccacactcccttctctacagaagcctctgagaggaaagttcttcaccatggactggacctggtggtcgttctgcttcctggctgtagctccaggtgctcactcccaggtcgcaacgtggtgcgagtctcggggctaggaagtagaaggaacgtccgtgggggccctcgaggtaggtaacgggtttcctgacgaaggcatcgtggactacaccttcacgacggcaccaatactncaacgtgggngcgaacgacggccccccgaagtaagaccgttgaggttggatagggactaataccaacctaataggtcgaagganaggactacgacgacagaacgttccgagagcgaagtcaccagcgaaccggacgacgacccaggacacgacctaggtacctagactggacttgagacgtggactagacgataagngacgagtacggcccttatttagcgtacgcggaaggacgaagggacgtaagaacgaatccgtgggtaccttcccggttttaagaccctagggtacggg

SEQ ID NO: 191123 - DNA, 536 bp, Homo sapiens
  misc_feature: GYAE6OF02I8JN3.42.42.D09.1.454.CMB.1.raw
  modified_base (301)..(301): a, c, t, g, unknown or other
  misc_feature (301)..(301): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaaggtttcctgcaaggcatctggatacaccttcaccaggcaccatatgcactgggtgcgacgacggcccccgganaacggacttgaggtggagtgggactaatcaaccctatagtggtaggacagactacgcacagaacgttcagggcagagtcgcagtcgacccgggacaccggtaccacgagcacacgtctacgntacggattgancagggctgagtatatgacgacgacggccgttactttattcgcgacgagaggaaggtagtacgagaacgtcgtacgtccttccgtttagaccgttagtcgggg

SEQ ID NO: 191124 - DNA, 673 bp, Homo sapiens
  misc_feature: GYAE6OF02HRMUV.42.42.D09.1.454.CMB.1.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
  modified_base (653)..(653): a, c, t, g, unknown or other
  misc_feature (653)..(653): n is a, c, g, or t
tcagtgacgtatgtcacgaccggtgctcgatttagacacatacgcaggaaaggggacgagtcatccaacaaccacatcccttctctacagaagcctctgagagaaagttcttcaccatggactggacctggtgggtctttctgtcttccgtggtctgtagctccaggtgctcacctcccgaggtgccaatcggtgcgagtccgtgggctgaagtgaagaagcgtggggcctcgaggtgtaacggtttccngacgaaggnatcgtggactacgtaccttccacaggaccaccatagtcncacgttgggtgccgagaccggacccccggaacgtaacggtcttacggaggtcggaagtaggaacgtaactaccaaccgtaagtacggaggtacggaacaacgaacgttacgacgaacgaacgtaacgttacccgaagggaccgtaaggacgtaccgactaacgcggaacccgggacctacgacccgaagacgactaaccgagtactaacgagttggacgttgaagcgaacggcgtaagtaacgataacgcaacggacgacccggtagtttacccgtttatcggaccgtaggtaagaacgggtaaggaacgtacgaaacggtaaccttcggtacggttaccgtttacccgttttanacccggtagttacccggggg

SEQ ID NO: 191125 - DNA, 573 bp, Homo sapiens
  misc_feature: GYAE6OF02G5VWP.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccggacaaggacttgagtggatgggactaatcaaccctaatagtggtaggacagactacgcacagaagttccagggcagagtcgcatgacccgggacacgtccaacgagcacagtctacatggagttgagcaggcgtgagatagtgaacgacgaccggccgttacttttactaggcgtacgaaggtaggaaaggggtaaggttaaccgaaggtaaaccgttcccgttaggggttacccctttaccccgtttttaggtacccgttaacggttccgggggg

SEQ ID NO: 191126 - DNA, 511 bp, Homo sapiens
  misc_feature: GYAE6OF02FPYQ6.42.42.D09.1.454.CMB.1.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (387)..(387): a, c, t, g, unknown or other
  misc_feature (387)..(387): n is a, c, g, or t
  modified_base (493)..(493): a, c, t, g, unknown or other
  misc_feature (493)..(493): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttnaccaggcaccatatgcactggtgcgacaggcccccgganaaggcttgagtggatgggactatcaaccctatagnggtagcagactacgcactagaagttccaggggcagagtcgccatgacccggganacgtccacgagcacagctacatggagttgagcagggctgagataatgacgacgtacgccgtcttttatcgcgcggagaggaacgggagtacagaactctaggtccnccttttgactctacgggg

SEQ ID NO: 191127 - DNA, 522 bp, Homo sapiens
  misc_feature: GYAE6OF02ILLY3.42.42.D09.1.454.CMB.1.raw
  modified_base (300)..(300): a, c, t, g, unknown or other
  misc_feature (300)..(300): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggcttgacgtggatggggactaagtcaaccctaatagtgtagggactagactacgcacagaagttccagggacagagtcgcatggacccgggacacgtaccacgacgcacagtctacgatggagttgagcaggctagagtatagtggacgacacggccgttcgtttatgcgcgagagaaggagtacagaactcgtggtccttcctttgacctagtacggg

SEQ ID NO: 191128 - DNA, 655 bp, Homo sapiens
  misc_feature: GYAE6OF02G8H92.42.42.D09.1.454.CMB.1.raw
  modified_base (242)..(242): a, c, t, g, unknown or other
  misc_feature (242)..(242): n is a, c, g, or t
  modified_base (494)..(494): a, c, t, g, unknown or other
  misc_feature (494)..(494): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgtaacggtttccngcgaaggcatcgtaggataccaccttcaccaggccaccatatcgctacgtggggtcgccggacgaccgggaccccccggacgaacgggtacttggaggtggaagtacgggaactaacgtaccaaaccgtaataggtaggtaaggacagactacgacgaacagtaacgtccgagggacaggacgtcgacgagtacggacccgggacaccgtaccgacgacgacacgacgtactacagtacgggtagttgacgngaacgggtctaggtagtagtagtacggacgtaccgtacggtcccgtttagttttagtcggcggtacggaaggaagggaacgggtacgtaaccgtaagtaacccgttcggttaccggtttacctttacccggttttaggtaccggttaccggtaaccggggg

SEQ ID NO: 191129 - DNA, 578 bp, Homo sapiens
  misc_feature: GYAE6OF02FS5P2.42.42.D09.1.454.CMB.1.raw
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctgggcctcagtgaaggtttccngcaaggcatctggatacaccttcaccaggcaaccntatgcactgggtgcgacacgggcccccggacaaggacttgagtggatgggactaatcaaccctaatagtggtagacagactagcacagaagttccagggcagagtcgcagtacgacccgggacacggtccaacggacgcacacgtactacgatcggagttggacgcgaggcgtggagatagtgaaccgacgacggtcccgttacgtttttattcggtacgcggaagtaagggaaggggtacgtaacgaaggtaaacccgttccgtacgggttcccttaccgtttttcggaccttacggtacccggggg

SEQ ID NO: 191130 - DNA, 619 bp, Homo sapiens
  misc_feature: GYAE6OF02H1UQH.42.42.D09.1.454.CMB.1.raw
  modified_base (302)..(302): a, c, t, g, unknown or other
  misc_feature (302)..(302): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagctggggcctcagtgaaggtttcctgcaaggcatctggatacaccttcaccaggcaccatatgcacgtgggtgcgacgacggcccccgganaaggacttgagtggagtgggactaactaccgaacccaagtaggtggtaggacacgactacgacgaacaagacgttaccgagggacgagacgtccgacacgtcggaacccgggacaccgtaccgaacgacgacaacgacgtacctaacagttaggagttagacgcgagggactaggacgtagtagtacgacggtaccgacggtcccgtttattttacgtggtaccgtacggtaacggaacggtaacgggacgtaaacgaacgtaaccgttccggttacggttcccgttacccgttttacggaccgttacggtacgggg

SEQ ID NO: 191131 - DNA, 556 bp, Homo sapiens
  misc_feature: GYAE6OF02IZNCZ.42.42.D09.1.454.CMB.1.raw
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcagtgaaggtttcctgcaaggcatctggatacaccttcaccaggccaccatatgcacgtgggtgcgacgacggcccccggacaacggaccttaggagtggagtgggactaagtccaaacctaatagtgtacgacagactacgacacagaagttccgaggcagacgtcgccagtacgacccggacaccgtccacgagcacagtacctanagtggagttggactcgaggcagagatnaggacgacgtacggcttntttatcgacgtgacgaaggaggtacgtaacgaagaacctccgttaggtacccttacccgttttgtaccgtacgtaccgggg

SEQ ID NO: 191132 - DNA, 629 bp, Homo sapiens
  misc_feature: GYAE6OF02HWSXQ.42.42.D09.1.454.CMB.1.raw
  modified_base (222)..(222): a, c, t, g, unknown or other
  misc_feature (222)..(222): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagctgggcctngtgtaggttcctgcaggcatcgtggactacaccttcaccacggacaccatatgcacgtggtcgcgacgaccgggcccccgagaacggtcgttgaggtggagtagggaactaataccaacctaagtacggttaggtacggacaagtactacgacaacgaaggtaacgtccgaaggcaggacgtcgacagacggacccgggactaccggtccaacggacgaccacgacgtactacgacgtggtacgtgacgcgacggctaggagatagtacgacggacgtaccgggtccttacgttttagtcggcgtacggaaggtaagggtaacggggaacgtaaccgtaacggtaaaccgttccggttacggttaccctttcccggtttttaacggacccgtttcggtaacccgggg

SEQ ID NO: 191133 - DNA, 544 bp, Homo sapiens
  misc_feature: GYAE6OF02GJ2AY.42.42.D09.1.454.CMB.1.raw
  modified_base (302)..(302): a, c, t, g, unknown or other
  misc_feature (302)..(302): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatcgtggatacacccttcaccaggcaccatatgcactggtgcgacacggcccccganaaggacttgagtggagtgggactaatcaaccctaataggtggtagacagactacgcacagaagtcaggcagagtcgcagtcgacccggacacgtccacgagcacagtcacagtggagttgagcaggctggagatagtacgacgacgacggcgtttactttagtcgcgacgaggaggaagggtacgtaacgagtaaacctccgttcggttcccttacccgttttacgaccttaggtaccgggg

SEQ ID NO: 191134 - DNA, 533 bp, Homo sapiens
  misc_feature: GYAE6OF02IAT5S.42.42.D09.1.454.CMB.1.raw
  modified_base (429)..(429): a, c, t, g, unknown or other
  misc_feature (429)..(429): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaaggcttgagtggatgggactaatcaaccctaatagtggtagacagactacgcacagaagtccagggcagagtcgcatcgacccggacacgtccacgagcacacgtctacagtggagttgagcgaggntgagatagtgacgacacggtccgttatttagtgacgtcgaggacggaagggagtaacgagtaaacctccgtacggttccttcccgttttgaccgtgtaccgggg

SEQ ID NO: 191135 - DNA, 624 bp, Homo sapiens
  misc_feature: GYAE6OF02HO34G.42.42.D09.1.454.CMB.1.raw
  modified_base (489)..(489): a, c, t, g, unknown or other
  misc_feature (489)..(489): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgagtgaagaagccgtggggcctcgagtaggtaaggtttcctgcgaaggcatctaggatacaccttcaccaggcaccatatgcacgtgggtgcgacacgggcccccggacgaacggacttggaggtggagtggggaactaacgtaccaaccctaagtaggtaggtaggacaacgactacgacacgaagtacgtaccgagggcaggacgtcgaccagtacgacccgggaccacggtaccacgagcacacgtctaacagtggagttcgagcgaggtcgtaggaacgtagtanacggaaccgacgaaccgggttacccgtttgttttacgttcggacggtacggtaggaacgggaagggtaacgtaacgtaacgtaacccgtacgttcggttacccttccgtttttaggacccgttcggtacccgggg

SEQ ID NO: 191136 - DNA, 536 bp, Homo sapiens
  misc_feature: GYAE6OF02GKRQ7.42.42.D09.1.454.CMB.1.raw
  modified_base (374)..(374): a, c, t, g, unknown or other
  misc_feature (374)..(374): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggcaccatatgcactgggtgcgacacggccccgacaaggacttggagtggatgggactaatcaaccctatagtggtaggacagactacgcacagaagttccagggcagngtcgcatcggacccgggacacgtccgacgacgcacagtcctacgatggagttgagcagggctgagatagtgacgacgcggtcgttcttttagtgcgcggaggaaggaagggagtaacgacgtaacgtccgttggtcccttcctttggaccgttgtaccgggg

SEQ ID NO: 191137 - DNA, 940 bp, Homo sapiens
  misc_feature: GYAE6OF02I1G0G.42.42.D09.1.454.CMB.1.raw
tcagtgacgtatgtcacgaccggtgctcgatttagacacatacgcagggaaagggggcgatcatccaacaaccacatcccttctctacagaagcctctgagaggaaagttcttcaccatggactggactggtgggtcttctgcttcctggctgtagctccaggtgctcactcccaggtgcaacgtggtgcagtcgtggggctgaagtgaagaagccgtggggcctcgagtggtaacgggttttcctggaccgtaaggctacgttcgtaggaacttacctaccctttaccgaaccgaacggacccaacctaattaacgtcgaccgtaaccggtgggggttacggacccggaaccggacccggggaacccccccgggaaccgaaacgggttaaccgtttagggtaacgggttacgggtaacgggttacgggtaaacgtttaaaccgttaacccgtaaaaccccgtttaaaggttaacggttacggggttaaacgggaaccgtaacggtaaacccggttaaccggacccgtaaaccggtaaacggtaaacgggtttacccggaagggggaacccgtaagggtaaccggtttacccggacccgtaacggttaacccgggaaccccggggtaaaccgtaacccggttaccccgaaaccggacggacccgtaaaccgtacgttaacccgttaaccgtaggttaaacgggttacggtttacgggaaccggtaccggaaacgggtccggtaagggtaaacgggttactacggttaacggaacccggtaaaccgggttacccgggttaccgttttaacggttttacgttccggacgggtacggtaaagggaacgggtaacggtaaagggtaaccgtaacggtaaaccgtttcccgtacgggtttacccctttaccggttttaacggtaccggttacgggttaaccgggg

SEQ ID NO: 191138 - DNA, 639 bp, Homo sapiens
  misc_feature: GYAE6OF02IBQGK.42.42.D09.1.454.CMB.1.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgacagtcgtggggctaggaagtgaaagaagccgtggggcctcagtgtaaggtttcctgacaaggcatcgtggataccaccttacaccgaggcaccaatntgcacgtgggtcgcgacacggaccccccgganaaaggtaccttggaggtgggataggggtaacctaagtccaaaaccgttaagtaggtacgtagggaaccagaacctacgacaacgaagtacgttaccgagggacaggtacgcgcagtcgaccggacacgcacgagacacncgtacanacgtggagtgaacgtcgaaggctaggacgaagtagtacggaaccgtacgtaccggtacgttacttttacgttacgtccgaggtaaggaaacggaaggtaacgtaaaccggacgtaaaccgttccgttacggttacccgttacccggtttttacgtaccgtacggttaaccggggg

SEQ ID NO: 191139 - DNA, 619 bp, Homo sapiens
  misc_feature: GYAE6OF02I5DFB.42.42.D09.1.454.CMB.1.raw
  modified_base (191)..(191): a, c, t, g, unknown or other
  misc_feature (191)..(191): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (409)..(409): a, c, t, g, unknown or other
  misc_feature (409)..(409): n is a, c, g, or t
  modified_base (474)..(474): a, c, t, g, unknown or other
  misc_feature (474)..(474): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccgaggtgcgaacctggtncagtctggggactgaagtgaaggaagccgtcgggccncgagtgaaggtttccnggccaaggcatccgtggataccacttcaccgnggcaccatactgcacgtggtncgacgacgccccggtanacggactcgagngatggactaagtcaacctagtagtgtagactagactacganacgagacgtcaggtcagcgtacgctacgtacggacccggaanaccgtacaacgacgacacgtacgtactaacgagtacggtacgttcgaagcggacggtcgtacganacgttagccggaacggacccgttaacgggtcccgttttaagtttacgttcgggccgtacggaagggtacgggtaaaggtacggtaacgacggtaaaccttcccgggtattcgtttaaccccggttttagccgttaacggtcgggg

SEQ ID NO: 191140 - DNA, 633 bp, Homo sapiens
  misc_feature: GYAE6OF02FP4QX.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctgggctgaagtgaagagcctggggcctcagtgaaggttcctgcaaggcatctggatacaccttcaccaggcaccatatgcacgtggtgcgacacggcccccggaacaaggacttggagtggagtgggactaagtcaaccctaagtagtggtaggacagactacgcacgagaagtccgagggcaggacgtcgccagtcgacccgggacaccgtccgacggacgcacacgtacctacgagtagggagttcggacgccgtagggcgttaggaagtagtaattacgggaaccgtacgaccggtcccggtttactttttacgttccgtcggacggtagggtaacggaaaggggtaaccgtaacggtaaccggtaaaccgttcccgttacgggttacccgtttacccccgtttttacggtaacccgttaccggttaacccgggggg

SEQ ID NO: 191141 - DNA, 559 bp, Homo sapiens
  misc_feature: GYAE6OF02GCN97.42.42.D09.1.454.CMB.1.raw
  modified_base (237)..(237): a, c, t, g, unknown or other
  misc_feature (237)..(237): n is a, c, g, or t
  modified_base (331)..(331): a, c, t, g, unknown or other
  misc_feature (331)..(331): n is a, c, g, or t
  modified_base (490)..(490): a, c, t, g, unknown or other
  misc_feature (490)..(490): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtgggcctcagtgaaggtttccngacaaggcatctaggatacaccttcaccaggcaccatatgcacgtgggtgcgacgacggccccggacaaggacttggagtggagtgggactaanacaacctaatagtgtaggacagactagcacgagaagttccgagggcagacgtcgcagtcgacccggacaccgtaccacgacgacacagtctaacgagtaggagttgagtcaggcgtagagatagtgaaccgacgaccggtccgttagttttatcggcgngaggaaggaagggagttaacgagtaaccgtcgttcggttaccttcccgtttagacgttacgtaccgggg

SEQ ID NO: 191142 - DNA, 621 bp, Homo sapiens
  misc_feature: GYAE6OF02I70O6.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtgggcctcgagtgaaggtttcctgcaaggcatctggatacaccttcaccaggcaaccgatactgcacgtgggtgcgacgacggcccccggaacgaacggaccttggacgttagggagtacgggactaataccgaacccttaagtagttaggtaggacagacgtaacgcaacaggaacgttccgaagggcaggagtccgcgatacggacccggacacgtccgacgacgacacagcctacagtggagttgacgcgaggctgaagtacgtagtaggacgaacgtaccggtaccgtttacttttacgtcgacgtacggaagggtacggtaaacggggtacgtaacgaacgtaaccttccggttacggtttaccctttaccgttttacggtacccgttacggtaccggggg

SEQ ID NO: 191143 - DNA, 637 bp, Homo sapiens
  misc_feature: GYAE6OF02IBY86.42.42.D09.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtctgggctgaagtgaagagctgggcctnagtgagtttccngcaggcatctgatacnccttcacaggcaccatatgcacgtggtcgccgacacgggtcccccggagaacggtcgttgacgtggagtcggggaactaacgtaccaacccgttaagtacggtaggtaggacgagactacgcgaactaagaacgttccgaggtcagagtccgcctagtaccggacccgggacgtacgtcccaaggcgtacaaccgtagtcctaacgtagttaccgggtagttacggtaggaccgtagggtctacgggaagtaccgtagtacggtaccgaacggaccggggttcccttacgttttagtcgccggtacgagggaaggtaacggggataaccgaacgtaaccttccggttacggtccttttacccggttacgttaccggtacggtaccgggg

SEQ ID NO: 191144 - DNA, 546 bp, Homo sapiens
  misc_feature: GYAE6OF02GGPZN.42.42.D09.1.454.CMB.1.raw
  modified_base (235)..(235): a, c, t, g, unknown or other
  misc_feature (235)..(235): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctgggcctcagtgaaggtttccngcaaggcatctggatacaccttcaccaggcaccatatgcacgtgggtgcgacacggcccccggacaaggaccttgagtggatgggactaatcaacctaatagtggtagacagactacgcacagaagttccagggcaggagtcgcatcggacccggacacgtccacgagccacngtctangtggagttgagcagggctgagatagtgacgacgacggccgttactttagttggccgacggagtaaggaagggtcgtaacgaagtaaccttccggtcggttcccttcccgttttgaccgttcggtaccggggg

SEQ ID NO: 191145 - DNA, 546 bp, Homo sapiens
  misc_feature: GYAE6OF02F2LPT.42.42.D09.1.454.CMB.1.raw
  modified_base (302)..(302): a, c, t, g, unknown or other
  misc_feature (302)..(302): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacgacggcccccgganaacggacttggagtggatgggactaatcaacctaatagtggtagacagactacgcacagaagtccagggcagagtcgcagtgacccgggacacgtccgacgagacacagtctacgatggagttgagtcagggctggagtatagtagacgacgacggtccgtcttttagtcgcgacgaggaaggaagggagtacgacgtaacttccgtacggttccttcccgtttacgacgttacgtaccggggg

SEQ ID NO: 191146 - DNA, 576 bp, Homo sapiens
  misc_feature: GYAE6OF02I8XXQ.42.42.D09.1.454.CMB.1.raw
  modified_base (320)..(320): a, c, t, g, unknown or other
  misc_feature (320)..(320): n is a, c, g, or t
  modified_base (417)..(417): a, c, t, g, unknown or other
  misc_feature (417)..(417): n is a, c, g, or t
  modified_base (472)..(472): a, c, t, g, unknown or other
  misc_feature (472)..(472): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgctagtcgtggggctaggaagtgaagaagccgtggggcctcgagtggtaacggttttcctggacgaaggcatcgtaggatacaccttcaccgaggccaccatatcgcacgtgggtgcgacgcggcccccgganacggactggagtgagtggaatactccaacctaataggtggtacggacagacctagcacagacgttaccgaggcagacgcgacagcggaacccggganaccgtaccacggacgaccacacgtcacgagtggtagtgagcaggctgacgattanggacgacgagtccgttatttagttcgcggtcgaggaaggaacgggagtaaccgagaaaccgttcgtaggttcccgtttacctttcggtaccgtacgtaccgggg

SEQ ID NO: 191147 - DNA, 575 bp, Homo sapiens
  misc_feature: GYAE6OF02FPFSO.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaaggacttgagtggatgggactaatcaaccctaatagtggtagacagactacgcacagaacgtccagggcagacgtcgccagtcggacccgggacacgtccacggacgcacagtctacagtggagttgagtcaggtctggagatatggaaccgacgaccggccgttacttttagtcgacgtcggaaggaacggaaggggtaacgtaacgtaacggaaaacctttccgtacggggttccttacccgtttttacggaccttaccggttaccggggg

SEQ ID NO: 191148 - DNA, 606 bp, Homo sapiens
  misc_feature: GYAE6OF02HBEV5.42.42.D09.1.454.CMB.1.raw
  modified_base (238)..(238): a, c, t, g, unknown or other
  misc_feature (238)..(238): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttccngcaaggcatcgtggatacaccttcaccaggccaccatatgcactgggtgcgacgacggcccccggacaacggacgttgacgtggagtgggactaagtacaaccctaagtagtaggtaggacagactacgcacagaacgtcagggcagagtcgcgagtcggacccggacaccgtccacgagcacacgtacacgatggagttgaagtcgaggctggagagtagtagacgtacgtacgggttcgttacgttttagtcgcgtacggtaggtaacgggtaacgggacggtaaccgtaaggtaaacccgttcccggttacgggtttaccctttaccccggtttttacggtaaccgttaccggtaacccgggggg

SEQ ID NO: 191149 - DNA, 797 bp, Homo sapiens
  misc_feature: GYAE6OF02I239D.42.42.D09.1.454.CMB.1.raw
  modified_base (244)..(244): a, c, t, g, unknown or other
  misc_feature (244)..(244): n is a, c, g, or t
  modified_base (647)..(647): a, c, t, g, unknown or other
  misc_feature (647)..(647): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccgaggtcgacaacgtggtgcaggtcgtgggctagaagtgaagacgccggtgggcctcgagtgtacgtttccngacgaggctatcgtaggatacctaccttcaaccgtacggccaccgaattactcggacctacggttggggtccgacggaacccgacccgggaccccccggaagtaacggtacctttagggacgggttacggaggttacgggaaacttaacgtacccgtaaaaccccgttaagttaacggggttaggttaacgggaaaccgtaacggtaaacccgttaccggaccgtaaaccgaacgggtttaaaaccgttacccgggaacggggtaacaacgggtacgggtacccgacccgttaacggtacccggggtaaccccgggaaccgtaaccggtacccccgaaacggaccggtcccaaacccggtacggtttacccaaacgtacggttcgggtaacgttacgggaacnccggtaagggtacccgtaggaaagtgttaaagcggtaacgaaccgtccgggtcctttacgttttagtcgaccgtaggtaggaacgggtaaggtaggtactaacgtaacccgtacgtcgtacctttaccgttagtaccgtacgtaccgggg

SEQ ID NO: 191150 - DNA, 638 bp, Homo sapiens
  misc_feature: GYAE6OF02IUGZ5.42.42.D09.1.454.CMB.1.raw
  modified_base (242)..(242): a, c, t, g, unknown or other
  misc_feature (242)..(242): n is a, c, g, or t
  modified_base (363)..(363): a, c, t, g, unknown or other
  misc_feature (363)..(363): n is a, c, g, or t
tcagtgacgtatgtcacgaccggtgctcgatttagacacatacgcagggaaagggggcatcatcaaacaaccacatcccttctctacagaagcctctgagaggaaagttcttcaccatggactggacctggtgggtcttctgctttcctggctgtagctccaggtgctcactcccaggtgcaactggtgcagtctggggctgaagtgaaagaagccgtggggcctcgagtgaaggttttccngcaaggcatcgtaggatacaccttcaccgaggccaccatatgcacgtgggtgcgacgacggcccccggacaacggacttggagtggagtgggaactaatacaacctaagtagtggtagaanagacgtacgcaacgtagaagttaccgacgggacagtacgtccgaccagtaccggaacccgggactaccgtccgaacgacgacaacgacgtctaacgaagtgggagttcgagacgacggtctaggaagtagtaagtacggaacgaccgtacgggtacccgttttagttttaccgttaggcggtacggtaaggaaggtaacggggtaactacgaaacgtaaaccgttccgttacggttacccgtttccgttttacggtaccgtacggttaccggggg

SEQ ID NO: 191151 - DNA, 698 bp, Homo sapiens
  misc_feature: GYAE6OF02IP7SP.42.42.D09.1.454.CMB.1.raw
  modified_base (241)..(241): a, c, t, g, unknown or other
  misc_feature (241)..(241): n is a, c, g, or t
  modified_base (341)..(341): a, c, t, g, unknown or other
  misc_feature (341)..(341): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctgaagtgaagagccgtgggcctcgagtgtaacggtttccngacaggcatcgtaggactactaccttcacccgaggtccaaccgatactcgctacggtgggtcgaccgacgacccggacccccgaagaacggtacgtaggnggtaggaggtacggaacttacgaaccctaaacctagtacggtaggaccgaacgacgtaccgtacgacaacgaaggtacgtcggacggacaggtacgtcgacctaggtacccggaaccgaccgtccgtaccgacgtacgacctaacgactaccgtaagtaggtacggtacggtagacgtacggacggttcgaggtaagtagttacgaccggaaccgtccggtacggttaccctttagtttacgtccggacgtacgggtaaggtaaacggggtaacggtaacgtaaccgtaacggttacccggttaccggttaccgttcccgttttacccggttacggttacggtaccgggtaccgggg

SEQ ID NO: 191152 - DNA, 645 bp, Homo sapiens
  misc_feature: GYAE6OF02HXCKW.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaaggtgaagagccgtggggcctcagtgtaacggtttcctgcaaggcatctggatacaccttcacgaggcaccatatgacagtgggtgacgacgaccggcccccggaagaacggtaccttgaggtaggagtacgggaactaactaccaaacccgtaagtaggtacgggtaacggacgaacgacgttacgacgaacgaacggtaacgttccgaagggaccgaagacggtacccgaccaaggttacggaccccggggaacaaccgtcccggaacgacgacaaccgtagtactacgtagttcggagttacggagtaccgaggtcgtagagtatagtcgaacgacgcggtcgttacttttagcggcgtaggagaaggaacgggtacgtaactaacggtaaccgtcgttacggttacctttaccggtttacgtacgtacggtaccgggg

SEQ ID NO: 191153 - DNA, 576 bp, Homo sapiens
  misc_feature: GYAE6OF02F8SAN.42.42.D09.1.454.CMB.1.raw
  modified_base (412)..(412): a, c, t, g, unknown or other
  misc_feature (412)..(412): n is a, c, g, or t
  modified_base (451)..(451): a, c, t, g, unknown or other
  misc_feature (451)..(451): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcgagtgaaggtttcctgcaaggcatcgtggatacaccttcaccaggccaccatatgcacgtgggtcgcgacgacgggcccccggacgaaggactggagtggagtgggactaatcaacctaagtagtggtagacagactacgcacagacgtcgaggcagacgtcgccagtcgaccggacacgtccacgancacgcgtactacagtggagttgagcgaggctgagagtancgacggacacggtccgttacgttttatggacgtcggaaggaacgggaagggtacgtaacgaacgtaacccgttcggtacgggtttacccgttaccgttttcggtaaccgttacggtacccggggg

SEQ ID NO: 191154 - DNA, 529 bp, Homo sapiens
  misc_feature: GYAE6OF02GCPBX.42.42.D09.1.454.CMB.1.raw
  modified_base (300)..(300): a, c, t, g, unknown or other
  misc_feature (300)..(300): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacaggcccccgganaaggactggagtggatgggactaatcaaccctaatagtggtaggacagactacgcacagaagttccagggcaggagtcgccatcggacccgggacacggtccacgngcacagtctacagtggngttagagcgaggctggagtatagtgacgacaccggcgttctttatgcgcgagaggaagggtagtaacgagaactcgtggtccttaccgtttcgactacggtcgggg

SEQ ID NO: 191155 - DNA, 560 bp, Homo sapiens
  misc_feature: GYAE6OF02F1IEL.42.42.D09.1.454.CMB.1.raw
  modified_base (306)..(306): a, c, t, g, unknown or other
  misc_feature (306)..(306): n is a, c, g, or t
  modified_base (462)..(462): a, c, t, g, unknown or other
  misc_feature (462)..(462): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggccaccatatgcacgtgggtgcgacgacggcccccggaanaacggacttggagtggagtagggactaatccaaacctaagtaggtaggtaggacagactacgacacagaacgttccgagggcaggcgtcgccagtcgacccgggacacgtccacgacgaccacagtctaacagtggagtgagcaggctgagatagngacgacgccgtcgttacgtttagtgcgacggaggaggaacgggagtaacgacgtaaaccgtccgttggtccttaccgtttacgtactacggtccgggg

SEQ ID NO: 191156 - DNA, 777 bp, Homo sapiens
  misc_feature: GYAE6OF02GAHBG.42.42.D09.1.454.CMB.1.raw
  modified_base (239)..(239): a, c, t, g, unknown or other
  misc_feature (239)..(239): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccaggtgctcactccaggtgcaactggtgcagtcgtggggctagagtgaagacgccgtgggcctacgagtgaacggtttccngacaggcatcgtggactacaccttcaccaggaccaacctatactcgctacgtgggtacgacgacgtaccggccccggaagaacggtaccttaggaggttacgggaacgttcggggaaccttaactaccgaaaacccgttaagttacggaggttaacggacaacggtactacgaccaacgtaaggtaacgttaccggacggtaccgaaggtacgtccgacgtacgtaccggtaaccccgggactaacccggtaccgaacggtcgaaccgtacgtacgttaccctaagtacgttacgggtacgtttacggaacgtacggtacgggtcgttaaggaaccgttataacggttacggaaccgtaccggttaacccggttaccgttttagtttttaccgacgggttaccgggcggtaacgggttaaacgggtaaacggggtaccgttaaacccgtaaacggttaacccttcccgggttacgggtttaacccccgttttaacccgggtttttacggtaacccggtttaccgggttaacccggggg

SEQ ID NO: 191157 - DNA, 607 bp, Homo sapiens
  misc_feature: GYAE6OF02JMVYD.42.42.D09.1.454.CMB.1.raw
  modified_base (238)..(238): a, c, t, g, unknown or other
  misc_feature (238)..(238): n is a, c, g, or t
  modified_base (278)..(278): a, c, t, g, unknown or other
  misc_feature (278)..(278): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaaagagcctgggcctcgagtgaaggtttccngcaaggcatcgtggatacaccttcaccacgcaccatactnacagtgggtcgcgacgacggcccccggacgaaggcttacgaggtacgagtagggaactaactaccaaccgtaatacggtaggtaacgaccaggactacgcaacgagaacgttacgacggtacgaagacgtccgacacgtcggaccgacgacgtccaacgngtacactanacttacgagttacgagttaggacgcgacggctagacgagtactaacgacggtacaccggtcgttacgttcgtagccgtaggtaacggaaggtaacgtaggtaaccgaacgttaacgtccgttacggtaccttttaccggtacgttacgtaaccggtcggg

SEQ ID NO: 191158 - DNA, 631 bp, Homo sapiens
  misc_feature: GYAE6OF02IOFPP.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgtaaggtttcctgacaaggcatctggatacaccttcaccaggcaccatatgcactgggtcgcgacgaccgggcccccggacgaacggacgttggaggtggagtcgggaactaagtaccaaccctaagtaggtaggtaggacagacgtacgcacgagaacgtccgaggcagcgtcgccgagtccggaacccggaccacgtacccgacgacgacgacacgtcctaacgagtaggacgttgagcgaggctaggagtatacgtcgaacgaccgaacgggtcccgttttacgttttagtcggaccgacggtaagggaacgggtaagggtaacggtaacgaacggtaaaccgttcccggttcggtttacccgtttaccccgttttacggtaccgttacggtacccggggg

SEQ ID NO: 191159 - DNA, 601 bp, Homo sapiens
  misc_feature: GYAE6OF02JJVCJ.42.42.D09.1.454.CMB.1.raw
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgccaaggcatctggatacaccttcaccaggcaccatatgcacgtgggtgcgacacggcccccgggacaacggaccttagacggtggagtggggaactaagtccaaaccctaagtagtaggtaggacagactacgcacgagaagtccagggcagagtcgcagtcgaccggganacgtccagcgcacagtctanagtggattggancgtaggctggatagtagttggaccgtaacgacgggtccgtttacttttaagtcgtaccggacggaggtaacgggaaggggaacgttacgaaacggtaaaccgtttccggtagggtttacccttaccccggtttttagacccgttacggttaacccggggg

SEQ ID NO: 191160 - DNA, 728 bp, Homo sapiens
  misc_feature: GYAE6OF02FLH7F.42.42.D09.1.454.CMB.1.raw
  modified_base (233)..(233): a, c, t, g, unknown or other
  misc_feature (233)..(233): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctgggctgaagtgaagagccgtgggcctcagtgaggtttcngcaaggcatctgatacaccttcaccaggccaccatatgcacgtggggtcgcggaccgaccgggcccccggaacaacggtacgtggaggtgggagtggggaactaagtaccaaacccgtaaagtaggtacggtaaggaacacggaacctacgaccaacgtaagtaacgttaccgacgggacgaggacgtaccgctacgtaccggaacccgggtacacccgggtaccacggacgtacgaaccgacgtacctaacgaggttcggaagtttacgggacgacgtaacgggcgtaggaacgtagtaacgtaccgggaacgtaaccggaccgggttacccgttttacgttttaacgttccggtacggtaccgggtaagggtaaacgggtaacgggggttaaaccgtaacggtaaaccggttaaaccgttacccggttacggttttaccccggttttaccccggttttaaccggttaacccggttaccggttaacccgggggg

SEQ ID NO: 191161 - DNA, 550 bp, Homo sapiens
  misc_feature: GYAE6OF02HYB6S.42.42.D09.1.454.CMB.1.raw
  modified_base (249)..(249): a, c, t, g, unknown or other
  misc_feature (249)..(249): n is a, c, g, or t
  modified_base (329)..(329): a, c, t, g, unknown or other
  misc_feature (329)..(329): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttcctgcaaggcatcnggatacaccttcaccaggcaccgatatgcactgggtgcgacacggcccccggacaaggaccttgagtggatgggactaancaacctaatagtaggtagacagactacgacacagagtccaggcagagtcgcatcggacccggacacgtccagacgcacagtctacagtggagttgagcgaggctgagtatagtgacgacgtaccggtcgttacttttagttcgcgtaggacgaggaacgggagtaccgaaggaaaccttccgtacggttcgttaccccttttagaccgttacgtaccgggg

SEQ ID NO: 191162 - DNA, 773 bp, Homo sapiens
  misc_feature: GYAE6OF02H393M.42.42.D09.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
tcagtgacgtatgtcacgaccggtgctcgatttagacacatacgcagggaaagggggcgatcatccaacaaccacatcccttctctacagagcctctgagaggaagttcttcaccatggactggacctggtgggtcttctgtccttccgtggctggtagccttccgaggtgctccacctcccgaggtgccaacgtgggtcgcgngtcggtggggactgaagtggaacggaacgcggtcgggcctacgaggtggtaacggttccncggacgtaagcgatcgtagactacctactacgacaggacacatntgacngtcggtgacgaccgacggacccgganacggtctgaggtggagtacggaactaacgtaccgaaccgtaattagggtaacggtacggaacgaccgaacgtaacgaaccgaagtaaacggtacggtaaccgtaggggtacgaacggtaacgggtcccgtacgaacggtacccgggaacccggtaccggaccgtaacccgtaacggacgtaaccggtacacgtaacgtacgaacggtacggtagtacgtaacgggcgaaggtcgggtagaacgttcgtaaacggttcgggaaccgtaaaccgggtcccgttacggttttaccgttttacgacgggtaccgggaacggaacgggttaaggggggaaacgtacggtaaaccggtttaacgaaccccggttttccggtaccgtttaccccggtttttaaccgttaacggttaacccgggtaaggttaccccgggggg

SEQ ID NO: 191163 - DNA, 609 bp, Homo sapiens
  misc_feature: GYAE6OF02G6Q2V.42.42.D09.1.454.CMB.1.raw
  modified_base (307)..(307): a, c, t, g, unknown or other
  misc_feature (307)..(307): n is a, c, g, or t
  modified_base (397)..(397): a, c, t, g, unknown or other
  misc_feature (397)..(397): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcgagtgaaggtttcctgcaaggcatctggatacaccttcaccaggcaccatatgacacgtgggtcgcgacgacgggcccccggaanaacggtaccttggacggtggagtgggaacttaactccaaaccctaataggtaggtaggacagactacgacacagaagttccgaggcaagngtcgccagtaccggacccggacaccgtccgacgagcgaacagtcctacgagtaggacgttagagctagggcgtaggaagtatagtcggaacgtacgaccgggtcctttacgttttgtcgacgtcggaaggagggtaaagggtagtaaccgaacgtaaccgttccggttacggttacccgtttccgttttaggacccgttaggtacccggggg

SEQ ID NO: 191164 - DNA, 621 bp, Homo sapiens
  misc_feature: GYAE6OF02IT7A1.42.42.D09.1.454.CMB.1.raw
  modified_base (301)..(301): a, c, t, g, unknown or other
  misc_feature (301)..(301): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctgggcctcagtgaaggtttcctgcaaggcatctggatacgaccttcaccaggcaccatatgcactgggtgcgacgacggcccccgganaaggacttgacgtggatgggactaagtcaaccctaagtagtaggtacgacagactacgcacgagaacgtccgaggcagacgtcgacgagtcggacccgggacaccggtaccacggacgaccacgacgtcacgacgtgggagttgagacgacggcgtaggacgaagtagttacggaaccgtaaccgtacccgggtaccgtttaccgtttttaagtcggtacgtcggaacgggtaagggaaacgggtacggtaacgtaacgtaaaccgttccgtacgggttcccctttacccggttttacgtaccgttacggtacccggggg

SEQ ID NO: 191165 - DNA, 579 bp, Homo sapiens
  misc_feature: GYAE6OF02GX0EK.42.42.D09.1.454.CMB.1.raw
  modified_base (393)..(393): a, c, t, g, unknown or other
  misc_feature (393)..(393): n is a, c, g, or t
  modified_base (457)..(457): a, c, t, g, unknown or other
  misc_feature (457)..(457): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggccaccatatgcacgtgggtgcggacgacgggccccccggacaacggtacttggagtgggatgggactaagtccaaaccctaagtagttaggtaggacagactacgcacgagaagttccgaggcagngtcgccgatcggacccggacaccgtaccacgagcgacgagtctacgataggagttgagcacggntgagtatagtaggacgacgaccggtccgttgtttacgtgcgtcggaaggaacggaagggagtaacgaacgtaactcccggttaggttcccgttccgttttacgtaccgttacggtaccgggg

SEQ ID NO: 191166 - DNA, 786 bp, Homo sapiens
  misc_feature: GYAE6OF02IXONF.42.42.D09.1.454.CMB.1.raw
  modified_base (171)..(171): a, c, t, g, unknown or other
  misc_feature (171)..(171): n is a, c, g, or t
  modified_base (634)..(634): a, c, t, g, unknown or other
  misc_feature (634)..(634): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggaccgtggtgggtcttctgtccttccgtggctgtgcctccgaggtcnctacacctcccgaggtcgactaacgtggtgcgtagtcgtgggctagaagtagaaagacgtccggtcgggtcctagtaggtacggtaacggtttccgagacgaacggtctacttcgtaggaacttaacctacctacgaaccgtacgacctaacgtatacgcgtaaccgtagggtcgggaccgaaccgaccgggacccccggaacccggtaaacgtaacggttcggtaacggtagggtacggtaacggtaaccggtaaactaaaccgtaacccccggtaaaacgttaaggtacgggtaacggtaaacgaactaacggtaaacgtaccgaacgtaacggtaacgttaccgtacggaacgtagacggtgacccgactacggtaccccgggaaccgaccggtaccgaaccggtaacgaccgaaccgaacgtaccgtacgagtaggtaccggttaagtacgacggacgnggtacgaggaatagtacgaacggtacccgtacggtacccgtttagttaccgtttagccgtacggaagtacgggtaaacggacggtaataaccggtaagttacccgttcggttacgttacccgtttaccggtatacccgggtacggtaccggg

SEQ ID NO: 191167 - DNA, 708 bp, Homo sapiens
  misc_feature: GYAE6OF02F38JS.42.42.D09.1.454.CMB.1.raw
  modified_base (284)..(284): a, c, t, g, unknown or other
  misc_feature (284)..(284): n is a, c, g, or t
tcagtgacgtatgtcacgaccggtgctcgatttagacacatacgcgagggaaagggggcatcatccaacaaccaccatcccttctctacagaagcctctgagaggaaagttcttcaccatggactggacctggtgggtcttctgcttcctggctgtagctccaggtgctcactcccaggtgcaactggtgcagtcgtggggctgaaggtgaagaagccgtggggcctcgaggtgaaggtttcctgcaaggcatctggatacaccttcaccctaggccacatacngcacgtgggtgacgaccgacggcccccggacaacggcgtggacggtgggagtggggaactaataccaacctaagtacggtggtaagactagactacgcacagaagttccgaggccaaggactccgacgtacgtacggacccccggggaactacccggtacccaaccgggaacgacccgaaccgtacggttacctaaccggtaacgttaggggtaaacgttgggaacgcgtaacgggcgttaggaaaggttagttaacgtcgggaacggacccgtaaccggttccggttttacctttttaaggttcggacgggtacggtaagggtaagggaaaccgggtaggttaaacccgaagggtaaacccttccggtttacgggttacccttttacccggtttacgggtaacccgttaccggtacccggggg

SEQ ID NO: 191168 - DNA, 829 bp, Homo sapiens
  misc_feature: GYAE6OF02GO62R.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtcgcaggtcgtggggctaggaagtgaagaagccgtcggggcctcgaggtggtaacggtttcctgacaagggcattcgtggaactaccacccttcaaccgtaggccaaccgtatatcggctacgtggggttcgaccggaacgaccggggtacccccggaagtaaacgggtacctttaggaacgggttgggaacggttacggggaaccttaaacgtaccgaaaaccccgttaagtaagggttaacgggtaacggaaacgaacggtaaccgttacggaacctaaacggaacggtaaacggtttacccgaaggggacctaaagggaccgttaaccgggccgtaaacggttaccggggaaaccccggggtaccgtaaaccgggttacccgaacgggtaaccgtaaccgtaaccggaacgttaccgaacttaagggtccggtaaggttacggaacgacgtacgggacctagggaacgtagtaacgacggtaaccgtaccggtcgttacccgtttgttttaaccgtggtacccgtaaggtacggaaacgggtaaacgggtaacttaaccggaaacggttaaccccgtacggtttacgggtttaccccctttaacgggttttacgaacccggtttccgggtaacccggggg

SEQ ID NO: 191169 - DNA, 572 bp, Homo sapiens
  misc_feature: GYAE6OF02F1OCA.42.42.D09.1.454.CMB.1.raw
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggccaccatatgcactggggtgcgacaggcccccggacaaggctgagtggatgggactaagtccaaccctaatacgtggtaggacagactacgcagagtaagttccagggcagagtcgcagtacgaccgggacacgtcacgngcacagtctantggagttgagtcaggcngacgatacgtgacgaacgaccggtccgtttgttttacgtgccgtacgaggtaaggaaggggtaacgtaacgaacggaaaaccgttccggttagttcccgttacccgtttttacggaacgtttaccggtaaccggggg

SEQ ID NO: 191170 - DNA, 573 bp, Homo sapiens
  misc_feature: GYAE6OF02HWVLE.42.42.D09.1.454.CMB.1.raw
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (476)..(476): a, c, t, g, unknown or other
  misc_feature (476)..(476): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcagtgaaggtttccngcaaggcatctggatacacttcaccaggcacatatgcacgtggtgcgacacggccccgganaacggacttggagtggatgggaataacgtccaacctaatagtaggtagacagactacgacacagaacgtcgaggacagagcgccagtacgacccggacaccgtcacgancacngtacanagtggagttgagcgaggcagaagatagtcgaacgaccgtacggtaccttgttttaanggacggacgaggtaaggtaagggtacgtaacctaacggtaaaccttccgttacggttacccgtttaccccgttttaggtaccgttacggtaccgggg

SEQ ID NO: 191171 - DNA, 544 bp, Homo sapiens
  misc_feature: GYAE6OF02FRBDD.42.42.D09.1.454.CMB.1.raw
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttcctgcaaggcatctggatacaccttcaccaggcaccatatgcactgggtgcgacacggcccccgganaaggcttggagtggatgggactaagtcaacctatagtggtagacagactacgcacagaagtcgagggcagacgtcgccagtcgacccggganaccggtccacgacgcacacgtctaacngtggagttgagcaggctaggagatagagacgaccacggtccgttatttatgcgacgaaggaggtaaggagtaccgaagtaaccctcgtacggtccttaccgtttggaccttacggtaccgggg

SEQ ID NO: 191172 - DNA, 637 bp, Homo sapiens
  misc_feature: GYAE6OF02HLRPB.42.42.D09.1.454.CMB.1.raw
  modified_base (497)..(497): a, c, t, g, unknown or other
  misc_feature (497)..(497): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtagaagaagccgtggggcctcgagttaggtaacggtttcctgaccgaaggcagtcgtggactacaccttcaccgaggcaccatatgcacgtgggtcgcgacgaccggcccccggagaacggtacttggaggtggagtgggtactaactaccgaaacctaagtaggtaggtacgacgaagtaccacgacacgaaggtacgttacgagggcaggtacgtcggacagtcggaacccgggacacggtaccgacgacgacacgacgtacctaacgagtcggagttagagacgacggngtaagagtagtagtcggacgacgaccggttacgttactttacgtcggacgtacggaacggtaaggacgggttaagtaaccgaaacgtaaccgttcgttaccggttccttacccggttttagaccgttaacggtaccgggg

SEQ ID NO: 191173 - DNA, 615 bp, Homo sapiens
  misc_feature: GYAE6OF02G0JQA.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtgggcctgagtgtaacggtttcctgacaaggcatctggatacaccttcaccaggccaccatagtcgcacgtgggtgcgacgaccgggcccccggacgaaggtacgttggagtggagtagggacttaacactaaccctaagtaggtaggtagacgagactacgcaacgagaacgttccgagggacaggacgtcgaccgagtaccggacccgggacaccgtaccgacgcgaccacgagtcactgtaggtacgttggatcgaggctaggagtatacgaggaccgaaccgtccggtaccgtttacgttttacgtacgtccgaggaacggaaggaaacgggtaggtaacgaacggtaaccgtcggttacggttccttaacccggtttcgtacgtacgtaccggg

SEQ ID NO: 191174 - DNA, 756 bp, Homo sapiens
  misc_feature: GYAE6OF02GZWG4.42.42.D09.1.454.CMB.1.raw
tcagtgacgtatgtcacgaccggtgctcgatttagacacatacgcagggaaagggggcatcatccaacaaccacatcccttctctacagaagcctctgagaggaagttcttcaccatggactggacctggtgggtcttctgcttcctggctgtagctccaggtgctcactcccaggtgcaactggtcgcagtcgtggggctggaagtgaagaacgccgtggggcctcgagtggtaacggtttcctgacaaggcagtcgtaggactacctaccttaccaccgacggcctaaccgatacgtcgactacggtgggtcgaccgaaccgaccggggaccccccggaagtaacgggtacgttaggaggtaggtagtacgggtaacttaaaccgtacccgtaaaaccgtaagttacggtaacgggtaacggacgaacgtaaccgtaacgacgaacgtaacggtaacgttaccggaggggacgtaaggacgggtaccgtacccgacggtaacccgggaaccccgggtaaccgtacccggtacccggaaccggacgtaacccgaaccgttacgtaccttaacggagttacgggtaacggttgacgtacggaggttacgtacgaaggtactagcggaacctacggtacggtacccgttttagtttacgtcggaccgacgtagggaacggtaagggtactaacgtaacgtacccgttccggtacggtttcccgtttaccgttttacggaccgttacgggtaccgggg

SEQ ID NO: 191175 - DNA, 531 bp, Homo sapiens
  misc_feature: GYAE6OF02GBWVV.42.42.D09.1.454.CMB.1.raw
  modified_base (453)..(453): a, c, t, g, unknown or other
  misc_feature (453)..(453): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaaggacttgagtggatgggactaatcaaccctaatagtggtaggacagactacgcacagaagtccagggcagagtcgccatgacccgggacacgtccacgagcacagtctacatggagttgagcaggctgagatatgacgacacggccgttnttttagtgcgacgaggaaggaagggagtaacgagaaacctccgtaggttccttcccgttttgaccttacgtacggggg

SEQ ID NO: 191176 - DNA, 679 bp, Homo sapiens
  misc_feature: GYAE6OF02GN2RN.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctgggcctcagtgaaggttcctgcaaggcatctggatacaccttcaccaggcaccatatgcactgggtgccgaacgacggcccccggaacgaacggtacgttggaggtggagtaggggactaacgtaccgaaacctaagtacggtaggtaggaacgacgaacgtacgacgaacgacggtaacgttacccgaggggacaggacgtcgacacgtcggacccgggacacggtccaacggacgaccaacgtacgtaccgtaacgagttacgggtagtttcggaacggtacgacgggtcgtaggaaggtaagtacgacggtaaccggaacgtaccgggttccgtttacgttttacgtcggtacgacggtagggaaacggtaacggggtaacggtaaccgtaaacgtaacccgttaccggtcgggtttaccctttacccggttttacggtacccggttacggtacccgggggg

SEQ ID NO: 191177 - DNA, 642 bp, Homo sapiens
  misc_feature: GYAE6OF02HB5LJ.42.42.D09.1.454.CMB.1.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtncaactggtgcagtctggggctgaagtgaagagcctggggcctcagtgaaggtttccngcaaggcatctggatacaccttcaccaggcaccatatgcacgtggtcgcgacgacggcccccggacaacggacttagaggtggagtagggactaatacctaacctaagtagtggtaggacagactacgcacagaacgtcaggcaggacgtcgaccgagtacggacccggacaccgtccgaacggacgcacgacgtactacgtagtagggagttagacgacgaggtcaggacgtagtaagtacgaccgaaccgtaccggttccgttacgtttttagtcggaccgtacggaaaggtaacgggtaaagggtaacggttaaaccgaacggtaaaacccgttcccggtttaacggggttacccccttttacccggtttttaacggtaaccccgttacgggtacccgggggg

SEQ ID NO: 191178 - DNA, 740 bp, Homo sapiens
  misc_feature: GYAE6OF02JDZMQ.42.42.D09.1.454.CMB.1.raw
  modified_base (238)..(238): a, c, t, g, unknown or other
  misc_feature (238)..(238): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttccngcaaggcatcgtggatacgaccttcaccaggtcaaccatatgcacgtggtcgcgaccgacggtacccccggaacgaacggtacctttaggaacggtgggaagtacggggaactaacgtaccgtaaacccttaaagttacggtaggttaaggaacgtaaggaacctaaccgacgtaacgaagtaaacggtttacccgaaggggccaaggacgttacgacccgtaagtccggaaccccggggactaccggtacccgaacggaaccggtcaaccgaacggttccgtaacgtacggttagggtaacggtttacggaacggtactaggggtacctagggtagtaacgttagtaccgggaggaacccgtaaccgggtcccgttttacgttttagtcgtaccgggtacgaacgggtaaggaaaggggtaacggtaaaccgaaggtaaacccttccggtacggtttaccctttacccgtttttacgacccgtttaacgggttacccgggg

SEQ ID NO: 191179 - DNA, 620 bp, Homo sapiens
  misc_feature: GYAE6OF02G2CM3.42.42.D09.1.454.CMB.1.raw
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (440)..(440): a, c, t, g, unknown or other
  misc_feature (440)..(440): n is a, c, g, or t
  modified_base (464)..(464): a, c, t, g, unknown or other
  misc_feature (464)..(464): n is a, c, g, or t
tcagtgacgtatgtcacgaccggtgctcgatttagacacatacgcagggaaagggggcgagtcatccaacaaccacatcccttctctacagaagcctctgagaggaaagttcttcaccatggactggacctggtgggtcttctgcttcctggctgtagctccaggtgctcactcccaggtgcaactggtgcagtctggggctagagtgaagaagccgtggggcctcgagtgaaggtttccngcaaggcatctggatacgccttcaccaggtcaccgatatcgcactgggtncgacacggccccggacaaggacttgagtgagtgggactaatcaaccctaatcgtaggtaggactagactaggactacaggaattccgaggcgaagtagcgtccgatacggacccgggacacgtccacgaaggctaaccgagtactaacncgtagggacttgagtcaggtaccngtaagactacgtagaaccggtacaaccggggtccttacgttttacgtacggtacggcggtaaacggaggggtaaacgggtaacgtaacgaacggtaaaaccttcggtacgggtttccgtacccgtttttaccggtaacgtagttaacccggggggg

SEQ ID NO: 191180 - DNA, 837 bp, Homo sapiens
  misc_feature: GYAE6OF02HWH09.42.42.D09.1.454.CMB.1.raw
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagagcgtgggcctcagtgaaggtttccngcaaggcatcgtagatacaccttcaccaggcaccatangcacgtgggtgcgacacgggcccccggacgaacggtacttcggaggtacgggtagttacggggtaactaaacgttaccctaaacccgttaaagttaacggtttagggttacgggtaacgaacggtaaccgttaaccgacgaaccgtaaaggtaaacggttacccgtaaaggggccgaacggtaacgggttacccggaccccgtaagttacccgggaaccccggggtaacccgtaacccggttaccccggaaaccggacgggaacccaaccgtaaccggtaccgtaaaccgtagttacggggttacggtttacggaaacgggaccgaagggtccgttaggaaagggtaacgttaacggtacggaacgggtaaacccgtaacccgggggtttacccgttttaaccgttttttacggtttccggaccgggtaacggtacggggtaaaacgggtaacggggggttaaactaaccggttaaacgggtaaacccgttcccggtttacgggtttacccgtttttacccccggtttttagtaccccggtttaacgggtaaccccggggggg

SEQ ID NO: 191181 - DNA, 590 bp, Homo sapiens
  misc_feature: GYAE6OF02F2FN9.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccagacaaggacttgagtggatgggactaatcaacctaatagtggtaggacagactacgcacagaagttccagggcagagtcgacatcggacccgggacaccgtccacgacgaccacgagtacctacagtggagttgagcgaggcctggacgatagtggaaccgacgaccgggtcccgtttagtttttacgttggccggacggtaaggaagggtaacggggaagttaaccgaaggtaaacccttcccggttagggtttcccttaccccgtttttacggacccgtttaacccgggg

SEQ ID NO: 191182 - DNA, 873 bp, Homo sapiens
  misc_feature: GYAE6OF02H9JNM.42.42.D09.1.454.CMB.1.raw
  modified_base (735)..(735): a, c, t, g, unknown or other
  misc_feature (735)..(735): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgtcttccgtggctgtagctccgaggtgctcactcccaggtcgcaacgtggtgcagtcgtggggctggaagtgaacgagccgtgggcctcgagtggtaacggttcctgacgaaggctagttcgtaggtatacctaccgttaccaaccgtacgggaccaacccgtagtaacgtcgtaccgtacgttcggggttacgaccggaaccgaccggggacccccccggaagtaaaccgggtacccgttttaggaacggttacgggtaggtacggggtaacttaacggtacccgtaaacccgtaaagttacgggtacgggtaacggtaaccgtaacggtaccgttaaccggacgtaaacggttaaacggaacggtttaccccggaagggtaacccggtacgggtaaacggtttcccggaaccgtaacgggttaccccggaaacccgggggttaaccgaaccgggttaccccgaacgggtaaaccggtaacccggaacgtaccggttaacctaaccggtaagttaccggggtaacgtttacgacggtacggacggtcggttaacggaacgtaagcgttaagaacccgggtctaacccgggttntttaaccgtttagttccgggaccggtaacggttacgaaaggggtaaccggtaacgtaaaccggtaaccggtaacctttaccgggtacgtttacccggttacccgtttttacaccggggttaaccgttaacccgggggg

SEQ ID NO: 191183 - DNA, 644 bp, Homo sapiens
  misc_feature: GYAE6OF02IDBYY.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggccttcgagtcgaaggtttccctgcgaaggcattcgtggatacacctttcaaccaggcaccataagtcgacacgtgggtgacgaccgacggaccccccggaagaacggaccttgaggtaggagtcggggaacttaactaccgaacctaagtaggttacggaggaacagacgtacgacacgaagtacgtacacggacagaagtcgactagtcggaacccgggacgacgtacccgaagtacgacacgacgtcaacgtacgtaggtacgttgacgtacgacgggtcgtaggaacgtagtaacgtcgaacggtaccgacgggtccttacgttttattacggcgtacgtaggaacggaacgggtagtaaccgtaacgaaaccgtcccgttaaggttccccgttacgttttacgccgttacggtaccgggg

SEQ ID NO: 191184 - DNA, 568 bp, Homo sapiens
  misc_feature: GYAE6OF02GEWTL.42.42.D09.1.454.CMB.1.raw
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (444)..(444): a, c, t, g, unknown or other
  misc_feature (444)..(444): n is a, c, g, or t
  modified_base (468)..(468): a, c, t, g, unknown or other
  misc_feature (468)..(468): n is a, c, g, or t
  modified_base (500)..(500): a, c, t, g, unknown or other
  misc_feature (500)..(500): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcacctcccgaggtgcaactggtgcagtcgtggggctgaagtgaagaagccgtggggcctcgagtgaaggtttcctggcaaggcatctggatacgaccttcaccgaggcaccatagcgcacgtgggtcgacgacgtacggcccccgagaacgtcgtagngnggagtaggactaanccgaacctaagtgtaggtagactagaactacggacaacgagaagttccgaggacagacgtcgacctagtcggacccggacgacgtccgagacgcacagtcanagtcgtagtgagtcgaggctgagntagtcgacgtacgcgtccgtttcgttagtcgngacgaggaaggaggacgtacgaacgtaacgtcgttacggtccctttacgtcgtacgtaccggtacggg

SEQ ID NO: 191185 - DNA, 760 bp, Homo sapiens
  misc_feature: GYAE6OF02JSWJ5.42.42.D09.1.454.CMB.1.raw
  modified_base (189)..(189): a, c, t, g, unknown or other
  misc_feature (189)..(189): n is a, c, g, or t
  modified_base (581)..(581): a, c, t, g, unknown or other
  misc_feature (581)..(581): n is a, c, g, or t
tcagtgacgtatgtcacgaccggtgctcgatttagacacatacgcaggaaagggggacgagtcatcaacaaccacatcccttctctacagaagcctctgagaggaaagttcttcaccactgcactggacctggtgggtcttctgcttcctggctgtagctccaggtgctcactcccaggtgcactggtncagtcgtgggctgagtgaagaacgcgtgggcctcgaggtgaacggttcctgcaagggctactctggactactacctctaaccaggccacctatagtcgccgacgttggggtcgacggaccgacgggacccccccgaagaacggtaacccggtttgaacgggttccgggtaagtcggggtaaccttaaacgtaccgaaaccccgttaagtacggttcggggtaaacgacgaacggtactaccgcgtaaacgacggtaaacttcccgaggggtaccaaggtcgttacgaccgtagtaccggaaccggtaaccgacgtaccgaacgacggtaccctaacgacggtcttaacgaccggttaacgggtacggttacggaaccgtcggtaacggggtntaaccgggtagagtttaacgaccgggacgttacccgaaccggggttcccgtttcgttttaaacggttcggaaccggtaccggttaagggaacggtaaggggtttacccgaagtaacggtaaacccgggttcgttaacggttccccgttttaccgtttacggtacggtttaaccccgggg

SEQ ID NO: 191186 - DNA, 706 bp, Homo sapiens
  misc_feature: GYAE6OF02JQCJ1.42.42.D09.1.454.CMB.1.raw
  modified_base (306)..(306): a, c, t, g, unknown or other
  misc_feature (306)..(306): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactccaggtgcactggtgcagtctgggctgaagtgaagaagccgtgggcctcagtgaacggtttcctgcaggcatcgtggatactacctcaccaggcaccatatggacacgtgggtcgcgacgacggcccccggaanacgggcttaggacgttggagtgggaactaactccgaaacctaagttaggtggtaaggacaacgtacggtacgaccaacgaaggtaacgttaccgagggtacgagtacggtaccgcccgtaggttaccgggaacccgggaccgtaaaccggtacccggaaggacggacccttaacgaccgggttaaccttacccggaaggttacggacgggtttacgacggaccggagaccggttacggagttaaggtaccgtaacggtaaccgcgttaacccgggttaccgttccgtttttaagggttcgcggtaacgggtacggtaagggaaacgggttgtaacccggaaggttaaaccgtccgtttacgggttcccttaccgttttacggccgttaacggtaccgggg

SEQ ID NO: 191187 - DNA, 593 bp, Homo sapiens
  misc_feature: GYAE6OF02J0M28.42.42.D09.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcactccaggtgcaactggtgcagtctgggctgaagtgaagagctgggctcagtgagttcngcagcatcngnacnctcacngcacatntgcagtggtgcgacncggccccganaaggctgagngagnggactancaacctatagtggagacagactacgcaanagaagtccgaggcgtagagtcgacacgtacggacccgggataccggtaccaacggtacgaccgaacacggtacctacggaacgttagggtacggtttacgaacgcggtacgggtaccttgggaagtacgtaacggtacgaacccggtaacgaccgggttcccgtttaagttttacgttcgacgacgtaacggagggtaaccgtagtaccgaagtaaccgtaccgttcgggtcctttaccgttacgggtacctaggtaccgggg

SEQ ID NO: 191188 - DNA, 823 bp, Homo sapiens
  misc_feature: GYAE6OF02G5C45.42.42.D09.1.454.CMB.1.raw
  modified_base (179)..(179): a, c, t, g, unknown or other
  misc_feature (179)..(179): n is a, c, g, or t
  modified_base (240)..(240): a, c, t, g, unknown or other
  misc_feature (240)..(240): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtncaactggtgcagtcgtggggctgaagtgaagagccgtgggcctcgagtgtaacggtttccngacaaggcatctaggatactacctcaccaggccaccatatcgactacgtgggtgccggtaaccgaccgggaccccccggaacgaacgggaccgttagggaggtcgggagtacggggtaactaagtaaccctaaacccgtaaagttacggtaggttaacggaacgtaacgaaccgtaaccgacctaacgtaaacggtaacggttaccgaaggggtaccgtaaggtacggtacccggacctaacggtacccggggaccccgggtaaaccgtaacccggtacccgaaccggaacgtaacccgtaaccgtaacggtacctaaccgtacggttacgggtaacggttcgaacgtacggtacgggacccgtttaaggaaaccggttagtaacggtacggtaaaccggtaaccggtaacccggggttcccgtttttacgtttttaaccggtacgggtaccggtcggtaaaacggtaacggggtaaaccggggttaaagtaaccggtaaaccgtaaaccggtttcccggtttaccggtttaccccgttttaccggttttaccgtaaccggtttaccgggtaaccccgggggg

SEQ ID NO: 191189 - DNA, 833 bp, Homo sapiens
  misc_feature: GYAE6OF02IARKU.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctccgaggtgacaacgtggtgcacggtctggggctggaagtgaacgaagccgtcgggcctcgagtgtaacggttcctggacaaggcagtctaggactactaccttacgaccacggaccaacctactagtacgactacggtggtacgaccggaccgacgggacccccggaccgaaggtacgttaggaaggtcgggaagtacgggaacttaacgtaccgaaaacccgttaagttaaccggtagggttaacggaaacgaacggtaaccggtaacgtaacaaaccggtaagttaaaccggttacccggtaaggggacaaacggtacgggtacccggtacgaacgtacccggaaccccgggtaacgtaaccccgggtaaccgaccggaacggaccgtaacccgtacgttacccgaaccgttacgtaccgggttaaggtacgtacgtcggaaacgggtccgtaagtaggtacgtaacgttacggaccggtaaccggacccgggtttacccggtttcgtttaaccgtttacggggtaccgtaacgggtaacgggtaaggggaaccggggttaaagtaaccggttaaccggttaaaaccgtttccccggttaagggtttacccccgttttaccggtttaacccgttaccggttacccgggttaaccggggg

SEQ ID NO: 191190 - DNA, 709 bp, Homo sapiens
  misc_feature: GYAE6OF02G1NJ0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagcctgggggcctcgagtgtaaggtttcctgcgaaggcatctggatacaccttcaccaggaccaccatatgcacgtgggtgcgacgacgggacccccggaacgaacggcttggacgtggatagggactaatccaacctaagtaggtaggtaggactagactacgacacagtaacgtccgaggacaggacgtcgaccgtacgtacggaacccgggacgtaacccgtacccgaaacggaccgtacaaccgtagttacctaacgtaaggtacgggttaaggttacggaacgtacggacggggtacctaagggtaacgtacgtaaggttacggaaccggtaccggtaacccgggttacccgtttaacgtttttacggtcggtaccgggtacgaaacggggtaaggtaaacgggggtacgttaaaccgaacgggtaaacccttccggtttacggttacccgtttacccggttttacggtaaccgttacgggttaccccggggg

SEQ ID NO: 191191 - DNA, 638 bp, Homo sapiens
  misc_feature: GYAE6OF02GOILN.42.42.D09.1.454.CMB.1.raw
  modified_base (281)..(281): a, c, t, g, unknown or other
  misc_feature (281)..(281): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtgtaaggtttcctgacaaggcatcgtggatacaccttcaccaggccaccatangcacgtgggtgcgacgacgggccccccggaagaaggaccttggaggtggagtgggaactaacgtacaaacccgttaataggtaggtaggaacacggactaacgcacagtacgttccgaggcagagtaccgccagtccggacccggacaccgacccgaacgacgacgacgacgtactaacgtagtagggtacgttaggacgacggaggcgtaggagagttagtacggaccggaacgtaccgggtccgtttacgttttacgttggtccggagtagggtaacgggaagggtacgtaaccgaacgtaaccgttccggttcggttacccgtttccgtttacggtacgttaccggtaccgggg

SEQ ID NO: 191192 - DNA, 799 bp, Homo sapiens
  misc_feature: GYAE6OF02IOYK4.42.42.D09.1.454.CMB.1.raw
  modified_base (252)..(252): a, c, t, g, unknown or other
  misc_feature (252)..(252): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtgggctgaagtgaagagccgtgggcctcgagtagacggtttcctagcaaggctatcgnggataccgtaccttcgaaccacggccaaccattacgtcggactacgtcggggtcgaccgaaccggacccggggtacccccggaacgtaacggggtacctttacgggacggttacgggaacggttacgggggaacctttaacgtacccgtaaaaccccgtttaaaggtacgggttacggttaaacgggaacgaacggtaaccgtaaccggaccaacgaaacgggtaaccgttacccggaacggggacctaaggaccggtacccggaccgtaacggtacccggggaaccccgggtaacgaccccggtaccgaaccggacgtaacccgaaccggtaacgttacccgtaaggaccggttaggtaccggttagaccgtacgacgggtcgtaacggtaggttaagtacgtaccgaacggaccgttaccggggtcctttttaagtttacgttacggcgaggtaacggaagggaaacgggtcgtaaacgaacggtaaccttccggttaccggtttacctttacccggtttacggtaccgtccgggttaaccgggg

SEQ ID NO: 191193 - DNA, 585 bp, Homo sapiens
  misc_feature: GYAE6OF02FGCRB.42.42.D09.1.454.CMB.1.raw
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (484)..(484): a, c, t, g, unknown or other
  misc_feature (484)..(484): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagccgtggggcctcgagtgaaggtttcctgcaaggcatcgnggatacaccttcacctaggcaccatatgcacgtggtgcgacacggccccgganaaggctgagtggatgggactaatcaacctaataggtggtaggtacagactacgacacgagaacgttccagggcaggacgtcgcagtcggacccggacacgtaccacgacgcaacgagtctacgatgggattgagtcgaggtcgtggagtagtaatcggaaccgaccgacggtacccgtttntttttacgtcggtcgacggtagaacgggtacgggaacgtaacgaacgttaaacgtcccgttaggtaccctttccggttttacgaccgttcggtacccgggg

SEQ ID NO: 191194 - DNA, 604 bp, Homo sapiens
  misc_feature: GYAE6OF02GMLDL.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtgggcctcagtgaaggtttcctgcaaggcatcgtggatacaccttcaccaggccaccatatgcacgtgggtcgcgacgacggcccccggagaacggacttggagtggagtggactaatccaacctaagtagtggagacagactacgcacagaacgttcgaggcagagtcgcagtcgacccggacgacgtccgacgagcacgacgtactacagtggtagttgacgacgacggtcgtaggagtagtagtacggaacgaccgtaaccgggtccctttagttttacgttcggcggtaggagggaagggtaaacggggtaagtaaccgaacggtaaaccgttccggtacggttccctttacccggtttacggtacccgttacgggtaccggggg

SEQ ID NO: 191195 - DNA, 678 bp, Homo sapiens
  misc_feature: GYAE6OF02JNZR0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaactggtgcagtctggggctgaagtgaagagccgtgggcctcagtgtaacggtttcctgacgaaggcatctggataccgaccttcaccacggccaccatatgtacacgtgggtagaccgaccgacggcccccggaacgaacggtaccttaggacggtggagtcgggaactaacgacctaaaccctaagtaggtaggtaggacaggactacgacaacgaggtaacgttccgaagggcaggacgtcgaccagtacgacccgggacaccgtccacggacacaactgtaccgacgtacggtaggtacggttcgacgtacgacgggtctaagggaccgtagtacgtaggtacccggaacggtacccgttacggtttacttttacgtacggtacgggtaccggaaggtaacgggtaaagggtaaacggtaacgaaacggttaaaccgttccggttaccggttcccgtttacccgtttacgggtaccgtacgggtacccggggg

SEQ ID NO: 191196 - DNA, 586 bp, Homo sapiens
  misc_feature: GYAE6OF02FRHHR.42.42.D09.1.454.CMB.1.raw
  modified_base (240)..(240): a, c, t, g, unknown or other
  misc_feature (240)..(240): n is a, c, g, or t
  modified_base (436)..(436): a, c, t, g, unknown or other
  misc_feature (436)..(436): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctggaagtgaagaagccgtgggcctcagtgaaggtttccngcaaggcatctgatacaccttcaccaggcaccatatgcacgtgggtgcgacgacggcccccggagaacggacttggaggtggagtagggaactaagtaccaaccctaatagtaggtaggacagactacgacacgagtaacgtcgaggcagacgtcgcagtcggacccggacgaccgacacgacgacacgagtccanagtggtagttcgagacgacggctgagtatagagaccgacgtcggtaccgtttgttttacgtcgcgtacggaaggtaacggaagggtacgtaacgaacgtaaccgttcgtacggttaccttccggtttacgtaccgttacgggtaccgggg

SEQ ID NO: 191197 - DNA, 657 bp, Homo sapiens
  misc_feature: GYAE6OF02G5IJF.42.42.D09.1.454.CMB.1.raw
  modified_base (180)..(180): a, c, t, g, unknown or other
  misc_feature (180)..(180): n is a, c, g, or t
  modified_base (286)..(286): a, c, t, g, unknown or other
  misc_feature (286)..(286): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttccgtggctgtagctccaggtgctcactccgaggtncaactggtgcagtcgtggggctgagtgaagaacgccgtgggcctacgaggtgtaacggtttccaggccaaggcagtcgtggatacgaccttcacaggcaccatacngcacgtggtcgcacgaccggccccggaagaacggacttggaggtcgtagtcggaactaacgtacaaccctaagtagtaggtaggacagactacgacacgagtagtacccaggggacacggtacgcgtacccgagttacggaaccccggggaacaccggttaccgaaccgacgccgaaccgtacgtactaacaggttcggaagttcgacgcgacgggtctagagtatacgacgggaactacgaccggtactttcgtttagttccggacggtcggaacgggtaaacggacgggtaacgtaaccggtaacggtaaccgttcgtccgggttttacccttaccggttttacgttaaccggttccgttaaccggggg

SEQ ID NO: 191198 - DNA, 604 bp, Homo sapiens
  misc_feature: GYAE6OF02IO46X.42.42.D09.1.454.CMB.1.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
tcagtgacgtatgtcacgaccggtgctcgatttagacacatacgcagggaaagggggcatcatccaacaaccacatcccttctctacagaagcctctgagaggaaattcttcaccatggactggacctggtgggtcttctgcttcctggctgtagctccaggtgctcactcccaggtgcaactggtgcagtctgggctgagtgaagagcgtgggctnagtgaagttcctgcaggcatcnggatacaccttnaccaggcacatatgcactgggtncggacacgggtccccggacaagggactttggagtacgggatcggggaactaactacaacccttaatacgtggtaacggacagactaacgcaagagaacgttccgaaggcagagtccgcagtcgaacccgggacacggtccacgacggcacgagtcctagattaggacgttggagcgaggtctggaagtatagtaggtacgaccgtacgggtccgtttaacgttttgtcgacggtaggtaacgggaggtaaacggggagttaaccgaacggtaaccttaccggttacgttacccgtttccgtttaacggtaccgttacggttacccggggg

SEQ ID NO: 191199 - DNA, 762 bp, Homo sapiens
  misc_feature: GYAE6OF02I7G1J.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagccgtggggacctcgagtgtaacggtttcctgcaaggcatcgtaggactaccaccttccgaccaggccaccatactgcactggtcgcgaccgacggcccccggacgaaggaccgttggaggtggagtgggaacttaacgtaccctaaacccgttaagtacgtagggtaacggtaacgaggtaaccgtaaccggactaaccgaaggtaaacgttaccgagggaccgaaggtacggtacccgaccgtaactaccgggaaccccgggaaccgtacccggtacccgaccggaccgactaacccgaaggttaccctaacgtacggttacggtaacggtttacggaacggacgaagggtcggttaaggaacggtacgttaggtaacggaccgggtaaccggaaccgggttaccgtttaccggtttttaacgttacgggtaccggaacgggtaacgggtaaggggaacgggttaacggaaacgttaaccgtaaacccgttaccggtttacggttccccgtttacccggttttacgtaccgtccggttaacccggggg

SEQ ID NO: 191200 - DNA, 772 bp, Homo sapiens
  misc_feature: GYAE6OF02GKQFA.42.42.D09.1.454.CMB.1.raw
  modified_base (245)..(245): a, c, t, g, unknown or other
  misc_feature (245)..(245): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctggaagtagaagaacgccgtggggcctcgagtgtaacggtttccngacgaaggcatcgtggataccgtaccttcaccgaaggccaccatatcgcacgtgggtgcggaccgaccgggaccccccgaagaacggtaccgttggaacggtggaacgtaggggaaccttaactaccgtaaaccctaaagttaggtacgggtaaggtaaccgaagaaccgttaccgacgaacgaacggtaaacgttaccggaacgggacgtaaggtacggtcccggaccaaggtacccgggaacccccggggaacgtaaccccggtacccgaaccggaacgtaacccgtaacgtacggtacctaagtacggttacgggtaacggtttggaacgtcggtaacgggcgttaggaaaggtactaggtacggtaaccgaccgtacccgggtccgttttacgttttagtccgggtcgtaagggtaaggaacgggttaaacggggacggtaaccgtaaacggtaacccgttccggttacgggtttaccctttacccgggttttacggtaccggttacccgggtacccgggggg

SEQ ID NO: 191201 - DNA, 670 bp, Homo sapiens
  misc_feature: GYAE6OF02HK3BU.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtgggctgaagtgaagaagccgtgggcctcgagtgaaggttcctgacaggctagtcgtagactacaccttcaccgtaggcactatatcgctacgtggtcgacgacgaccggccccggacgaacggtacgtggacgtaggtagtcggaactaacgtcctaaccgtaagtaggtggtaacgacgagtacgtacgacacgtaagtaacgttccgaggtacgagtacgccgacgacgtaccgggaacccggaccgacggtaccgaccgacgtacaacgtacgtacctacgtacgttaggtacgttcgacggtacgacggtacgtgaaggtacgtaacgttcgggaacgtaccgtaccgggttaaccgtttacgtttacgtcggacgttacggaacggtaagggtaaccgggtaagtaaccgaacgtaaccgttcgttacggttaccctttcccggttacgtacccggttacggtacgggg

SEQ ID NO: 191202 - DNA, 773 bp, Homo sapiens
  misc_feature: GYAE6OF02F7AZY.42.42.D09.1.454.CMB.1.raw
  modified_base (241)..(241): a, c, t, g, unknown or other
  misc_feature (241)..(241): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtcgcaacgtggtgcagtcgtggggctgaagtgaagagccgtgggcctgagtgtaacggtttccngacgaaggcatcgtaggctacgacttcaccaggcaccatactgctacgtgggtgtcgacgacggtcccccggaagaacggtacgtttggaacggttgggaattacggggaacctaacgtaacccgtaaacccgttaagtaacggggtaggttaacgggactaacggtaaaccgttacggaccaaacggtaacggtaaacgtttaacccggaggggtacgaaacggggtcgtaaccggtaccctaacgggtaccgggaaccccgggtaaccgggtaaccgttacccgggaacggaacgtaccggaacctaaccggttaccgtaagtaaccgtagggtaacgttacgggaacggtacgtaacgggtacgtaggaagtacgttagtaacggaccgtacgtaacccggtccgttttaagtttacgggttcgtaccggacgtaacgggaagggtaacggtacgtaaccggtacgaaaccgtttccggttcggttaaccctttaccgggtttacgacccgtttcgggtaaacccgggg

SEQ ID NO: 191203 - DNA, 817 bp, Homo sapiens
  misc_feature: GYAE6OF02HPVLS.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcacatggactggactggtgggtctttctgtccttcctggctgtagccttccgaggtgctaccacctcccgaggtcgactaacgtggtcgacgaggttcggtggggctaggaaggtaggaaaggaacggtcccggtgggggtacccttaggaagggttacggttaaaccgggttttcctaggaaccggtaaagggcctacgttaccggttagggtaaccttaacccgttaccccgttacccgaaccggtaacggacccctaaccgtatacttcggaccgtacgggtgggtaccggaccgaccggaccccgggacccccggaaagtaaggtctacggtaggtcgggaagtacggtaactaacttaccaaacgtagtaggttacggacgtaacagtcgtaacgacaacggaagtaccgtcggacggacaaggtacggtcccgacgaggtacccggaaccgggacctaccgacggtacgacggaacaccgtaagtacgtacgtaaggtacggtagtacggagacgacgggactaggactagtacgacggtaaccgacgttacccggtcttttaacgtggttaccgacgggtacggttaacgggaaagggtaacgggtaaaccgtaaaccgttaaggtaaaccccgtttcggttacggttttcccgtttaacccggtttacggttaacccggttaccggggtaacccggg

SEQ ID NO: 191204 - DNA, 670 bp, Homo sapiens
  misc_feature: GYAE6OF02ICED7.42.42.D09.1.454.CMB.1.raw
  modified_base (240)..(240): a, c, t, g, unknown or other
  misc_feature (240)..(240): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctgagtgaagaagccgtgggcctcgagtgtaaggtttccngcaaggcatcgtaggataccaccttcaccaggcaccatatgcacgtggtgccgacgacggccccggacaaggtcttagagtggagtgggaactaagtacaacccgtaagtagtaggtaggacacgactacgacacgaagtacgtacacgggcagacgtcgaccagtacggacccggacacgtcccgaacgacgaccaacgagtacctaacgtagtacgggtaacgtttaggaacgtcgaacgggtctaggtaacgtagtaacgtacgggaaccgtaccgacccgggttccgtttacgtttttacgtcggtacggtacggtaacggaagggtaacgggtaacggtaacgaaaccggttaaacccgttccggttacggtttaccccgttttacccggtttttacggtaacccgtttacgggtaacccggggg

SEQ ID NO: 191205 - DNA, 562 bp, Homo sapiens
  misc_feature: GYAE6OF02FYTZT.42.42.D09.1.454.CMB.1.raw
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccaggtgctcactcccaggtgcaactggtgcagtctggggctgaagtgaagaagcctggggcctcagtgaaggttcctgcaaggcatcnggatacaccttcaccaggcaccatatgcactgggtncgacaggcccccggaacgaaggaccttgagtggatggggactaatcaaccctaatagtggtaggacagactagcacagaagttccagggcagagtcgccatcggacccgggacaccggtccacgagcacagtctacntggagttgancaggctagagatatagaacgacgaacggccgtacttttagtcgtcgcggagtaaggaagggagtaaccgaagtaaaaccgttcccgttacgggttccttaccccgttttcggtaccgttacgttaccgggggg

SEQ ID NO: 191206 - DNA, 685 bp, Homo sapiens
  misc_feature: GYAE6OF02HP8J1.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaaggtgaaggaagccgtggggcctcgagtggtaacggtttccaggcaaggcatcgtagactacacttcacaggcaccatatcgcgacgtgggtacgcgaccgaccgggaccccggaagaacggtcgtcggaggtggagtacgggaactaacgtaccaaccgtaagtaggtaggtagaacaggtaactacggacaacgtaagtaacgttacgaggacaggacgtccgaccgtagtaccgggacccgggactaccggtacccgaacgacggaccaacggtacgtactaacgacggttacggtagttacggacgtacggacggtcctagggaagtaacgtacggtacgaaccgtaccgtaccgggtcgtttaacgtttacgtacgggtacgtacggtaaggaaggaacggggtaacgtaacgtaaacggtaaccgttccggtacggttccgtttacccggttttacgaccgtttacggtaccgggg

SEQ ID NO: 191207 - DNA, 631 bp, Homo sapiens
  misc_feature: GYAE6OF02JCRE3.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggccaccatatgcacgtgggtcgcgaccgacgggcccccggagaaggtacttggaggtggagtgggaactaagtaccaaccctaagtacgtggtaacggacaagactacgcacgagaagttccgagggcagacgtcgcagtacggaacccggacaccgtccaacggacgacacacgtactacgagtgggagttgacgccgaggtcctaggaagtaatagtacgaacggaaccgtaccgggtcccgtttacttttacgtcggtaccggtacggaggtaacgggtaaagggtaacgtaacgaacggttaaacccgttccggttacggtttcccgtttacccgttttaggacccgttacggtaccggggg

SEQ ID NO: 191208 - DNA, 591 bp, Homo sapiens
  misc_feature: GYAE6OF02FST2F.42.42.D09.1.454.CMB.1.raw
  modified_base (239)..(239): a, c, t, g, unknown or other
  misc_feature (239)..(239): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctggaagtgaagaagccgtggggcctcagtgaaggtttccngcaaggcatctgatacaccttcaccgggcaccatatgcacgtgggtgccgacgacgggcccccggacgaacggaccttggagtggagtggggaactaatacaaccctaagtaggtggtacggacagactacgcacagacgtcgagggcaggagtccgaccgagtacggacccgggacaccggtaccacggagcaacgagtacgacagttggagttaggacgcgaggcaggaagattacgcggaacgacgtaccgggtctttactttagtgcggcgaggaaggtaacggagtacgaaggtaaaccgtcgtacggttccgttcccgttttagaccgttacggtcgggtaaccgg

SEQ ID NO: 191209 - DNA, 712 bp, Homo sapiens
  misc_feature: GYAE6OF02F1BT0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcgagtagtaggtttcctgacaaggcatcgtaggactacaccttcacaggcaccatatgctacgtgggtgacgacgaccgggacccccggaacgaacggtacttaggaggtgggtaagtcggggtaacctaactaccgtaaacccttaaagtacggttaggtaacggacgtaacgtaacgtacgacgtaacgaaggtaacgttaccgaaggggtacaagggtacgtccgaccgagtaccgggaacccgggacaccggtaccgaacgacgaccaacgacgtactaatacgtagggtagttagaacggtccggaagggtctagggaacgtagtacgttaacggacgaaccggtaccggtccgtttaacgttttacgtacggaccgaggaacgggtaaagggaacgggtaacggtaaccgtaacgggtaaccgttccggttaccggtttccctttaccccgttttacggtaccggttacccggtaccggggg

SEQ ID NO: 191210 - DNA, 664 bp, Homo sapiens
  misc_feature: GYAE6OF02FQBA0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtgggcctcgagtgaaggtttcctgcaaggcatcgtggataccaccttcaccaggcaccatatgcacgtgggtgcgacgacggcccccggacgaaggtacttgagtggatgggactaatccaacctaataggtggtaggacagactacgcaacgagtaacgtccgagggcaggtagcgccagtacggacccggacaccgtaccgacgacgcaacgtacgtaccaacgtagtacgggtagttaggacggtacgagggtacctagggaacggtattaacggtacggtaaccggaacccggtacgggttcccggtttaacgttttttacggtacggtcggacggtaaggaaaggggtaaacggggtacgtaaacgaaccggttaaacccttccgggttccggttacccgtttacccggttttacggtaccggttaccgggtttaacccggggg

SEQ ID NO: 191211 - DNA, 773 bp, Homo sapiens
  misc_feature: GYAE6OF02GZV30.42.42.D09.1.454.CMB.1.raw
  modified_base (633)..(633): a, c, t, g, unknown or other
  misc_feature (633)..(633): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggaccgtggtgggtcttctggtcttcctggctgtagcctccgaggtgctcacctcccaggtgcaactggtgcagtcgtgggctaggaaggtagaagaacgccgtggggcctacgaggtgaaagggtttttcccaggaccaaagggtcctagtcgttacgggtaactaccgtacccttaccgaaccaacgggaccaaccgtaatagtcgaccgttacggtcggggtgaccggtaccgaacccggggcccccggtaacggaacggtaccttaggaaggtgggaaggtacgggaacttaacgtaccaaacccgttaagtacggtaaggtaaggaacgagtaaccggttaacgacgtaacgaaccggtaagtttccccggaagggacgacggacgtaccgaccgaggtaccggacccgggaacctaacccggtcccgaacgtacggacctaaccggaacgtaccttaacgaaggttaccggttaggtacgtacgaccgaacggtcgtaagganagtagtaccgaaccgtaacgacccggtccgttttaacgtttagtaccgcggtaaggaacggaagggtaaacggtacgtaagaaccgtaaacgtcccgttggttcccgttaccggttttacggaccttacgggttacgggg

SEQ ID NO: 191212 - DNA, 673 bp, Homo sapiens
  misc_feature: GYAE6OF02FNM78.42.42.D09.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtcgcaactggtgcagtcgtgggctgaagtgaagaagccgtggggcctcgagtgtaaggtttccngcaaggcatcgngactacaccttcaccgaggccaaccgatatgctacgtgggtcgcgaacgaccggcccccggtagaacggtacttcggaggtcggagtgggaactaacgtaccaaacctaagtacggtaggtaacggacaagactacgcaacgaggtaacgttaccgaggaccaggtacgtcgccgaagtaccggacccggtacaccgtaccgacggacgaccacgacgtacctacgtagtgggtacgtttaggacgtacggacggacgtacggagttaagtacgtacggtaaccgaacggtaccggttcccggttttacttttagtccggaccgtacgggtagtaacggggtaaggtaaccgtaacgaacgtaaacccgttcggtttacgttcccgtttaccggtttacgtaccggttacggtaccgggg

SEQ ID NO: 191213 - DNA, 619 bp, Homo sapiens
  misc_feature: GYAE6OF02GDV0A.42.42.D09.1.454.CMB.1.raw
  modified_base (278)..(278): a, c, t, g, unknown or other
  misc_feature (278)..(278): n is a, c, g, or t
tcagtgacgtatgtcacgaccggtgctcgatttagacacatacgctaggggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcgagtgaaggtttcctgcaaggcatctggatacaccttcaccaggcaccatatncactgggtgcgacgacggcccccggagaacggacttgacgttggatacgggaacctaagtaccaaacctaagtagtggtaaggacagacctacgactacaaggtaacgttccgaaggacagtacgtacgaccagtacggaaccccgggacaccgtaccgacgtacgactacacgtctaacgagttggtacttggaagtccgaagggccttaggacgtagtactaggaaccgacgtaccggttccgttacttttagtcggcgtacgaaggaacggaaggtacgtaacgacggtaaccttcggtcggttacgttacccgtttgtaccgttacggtacccgggg

SEQ ID NO: 191214 - DNA, 666 bp, Homo sapiens
  misc_feature: GYAE6OF02F5HT4.42.42.D09.1.454.CMB.1.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (461)..(461): a, c, t, g, unknown or other
  misc_feature (461)..(461): n is a, c, g, or t
  modified_base (495)..(495): a, c, t, g, unknown or other
  misc_feature (495)..(495): n is a, c, g, or t
  modified_base (563)..(563): a, c, t, g, unknown or other
  misc_feature (563)..(563): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctgggcctcagtgaaggtttccngcaaggcatctggatacaccttcaccaggcaccatatgcacgtggtgcgtaccgacggcccccggtaanaaggtacctttggacggtagggattaggggaaccttaaagtaccgtaaaccctaaagttacgtacgggttaaggaccaagggtaacttaaccgacgaaccaaggtaaacgtttcccgaaggggtccaaggacgtcgaccgaattcggaccccgggtanaaccggttccaacggtacgcgaacacggtactanacgtaggtacgttcgacgtcacgggtcctagggaagtatacgtcggaacgacgtaacggtcccgtttntttacgtttcgcgtaggaacgggtaaggaaagggttagtaaccgtaacgtaaccttccggtaaggttccctttacccgttttacggacgttacgggtaccggg

SEQ ID NO: 191215 - DNA, 698 bp, Homo sapiens
  misc_feature: GYAE6OF02F08BP.42.42.D09.1.454.CMB.1.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgnggggctgaagtgaagaagccgtgggcctcagtgaaggtttccngcaaggcatctgatacaccttcaccgaggcacatatgcacgtgggtgacgaccgaccgggcccccggaagaacggtactggagtgggaagtgggaactaactacgtaaacctaagtaggtaggaagacgaagactacgcgaacagtaaacgtcgaggacgagtcgtacgaccacgtaccggacccggaacgacccggtaccgaacggacgaccgtaacgaaccggtactaaaccggtagtacgggtaacgttaggaacgaccggtaagggtacctagggaagtaagttaaccggtaggaaacccggaacgtaacccgggttaccgttttaacgttttacgtacggaccggtaacggaagggtaagggaaaacgggtaacgtaaaccggtaaacgttaaaccgtccggtttacggttaacccgttttcccgtttaacggtaccgttaccggtacccggggg

SEQ ID NO: 191216 - DNA, 649 bp, Homo sapiens
  misc_feature: GYAE6OF02I7GD8.42.42.D09.1.454.CMB.1.raw
  modified_base (306)..(306): a, c, t, g, unknown or other
  misc_feature (306)..(306): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaactggtgcagtctggggctgaagtgaagaagccgtggggcctcgagtgaacggttcctgcaaggcatctggatacaccttcaccaggcaccatatgcactgggtgcgacgacggcccccggaanaacggacttggagtggatgggaactaatcaacctaatagtaggtagacagactacgcacagtacgtcgaggcagacgtcgccgatcggacccggacaccgtaccgacgacgcaacgacgtactacgagtagggtagttgaacgcgaggtaccgtggaagtagtacgtacggaaccggaaccgaccggggtaccctttacgttttaacgtttcggaccggtacgtaagggaacgggtaaaccgggtacggtaaaccgtaaacggtaaacccgttcccggtttaacggttaccccgttttccccggtttttaacgaacccggtttacccgggttaacccgggggg

SEQ ID NO: 191217 - DNA, 721 bp, Homo sapiens
  misc_feature: GYAE6OF02IMV8R.42.42.D09.1.454.CMB.1.raw
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
tcagtgacgtatgtcacgaccggtgctcgatttagacacatacgcagggaaagggggcgatcatccaacaaccacatcccttctctacagaagcctctgagaggaaagttcttcaccatggactggacctggtgggtcttctgcttcctggctgtagctccaggtgctcacctccaggtgcaacgtggngcagtcgngggctagagtgaagagcgtgggctcagtgaggttccngnacgnatctggatactactcacgacgcaccatagtcgactacgtcgggtgccgacgaccggaccccggagaacggtaccttaggacgtagggaacgtacggtaacgttaacgtaacccgaaaccgtaagttaggtacggtaacggtaacgagtaacgtaacgaccgtaactaaggtaccgttaacgacgggtacgacggtaggtccgaccgtaagtaccggaaacccgggtacgtaacccgaccggtaaccgagaccgtaacgtacgtaccgttaacgtaacggtacggggtacgttacgggacgtacggacggtagtaccggaagtagtacgtacggaaccgtaccggaaccggtccgtttaccgttttacgacggtacgtaacggaggtaacgggtaacggtacggtaaaccgttaacggttaacccgtaccttcggggttaccctttaccgggtttaacgttaccggttacggtaacccgggg

SEQ ID NO: 191218 - DNA, 630 bp, Homo sapiens
  misc_feature: GYAE6OF02H5WYL.42.42.D09.1.454.CMB.1.raw
  modified_base (178)..(178): a, c, t, g, unknown or other
  misc_feature (178)..(178): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (403)..(403): a, c, t, g, unknown or other
  misc_feature (403)..(403): n is a, c, g, or t
  modified_base (489)..(489): a, c, t, g, unknown or other
  misc_feature (489)..(489): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccaggtncaactggtgcagtctggggctgaagtgaagagccgtgggctnagtgaacggtttcngcagctagctggactactccttcacacggcacatatgcacgtgggtgaccgacgaccggtccccggagaaggtccgttagacggtaggtagtcgggaacctaatcccgtaaacctaagtaggtaggtacggaactacggaactacgactacgaagtacgttcaacgggnaggacgtcgtaccagtacgacccggactaccgtacgaagaggcctaacgacgtacctacaggttaggacgttagaacgcgacggtnacggacgtataccgtagaaccggtaccgaaccggttcgttcttttaagtcgtaccgtaccggaaggtaacggaaggggtactaacggtaagaaacccgtttgaccggtttccgtacccgtttaggacccgtagtaccgggg

SEQ ID NO: 191219 - DNA, 693 bp, Homo sapiens
  misc_feature: GYAE6OF02HSYCO.42.42.D09.1.454.CMB.1.raw
tcagtgacgtatgtcacgaccggtgctcgatttagacacatacgcagggaaagggggcgatcatcaacaaccacatcccttctctacagaagcctctgagaggaaagttcttcaccatggactggacctggtgggtcttctgcttcctggctgtagctccaggtgctcactcccgagtgccaactggtgcagtcgtgggctgagtaggaagaagcgtgggcctcaggtgtaaggtttccgtgccgaaggacatccgtggactaacctaccttccaccgacggaccaaccctagtatcgacctaccgtgggtcgcgaccgacgggcccccggaagaaccggtacgtacggagtcgggagtggggaaccttaactaaccgaaccttaaaagtaggttaggtaacgggacgtaacgaacgtaccggtaacaacgacgtaaggttacccgaggaacgtagacggtaccgtcgagtaccggtaaccggtccaacggtacccgacgacgacgtaaccgacgtacaaccgtgtaggagtggtacaggaccggtgacgagaacgtagtacgacgactaccggtacttaccgttttagtcgtagggccgtaaggaaggtaacgggaacgtaacgaacggtaacccgttacggttaccggttacccgttacccggttttacggaccgttaccggtaaccgggg

SEQ ID NO: 191220 - DNA, 652 bp, Homo sapiens
  misc_feature: GYAE6OF02G4FG6.42.42.D09.1.454.CMB.1.raw
  modified_base (243)..(243): a, c, t, g, unknown or other
  misc_feature (243)..(243): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctcaggtgctcactccaggtgctaactggtgcagtcgtggggctgaagtgaagaacgccgtggggcctcgaggtgtaacggttttccngacgaaggctagtcgtaggactactaccttacacctacggcaaccgatatgacctacgtgggtgaccgacgaccggcccccggaagaacggcttaggaggtggagtgggaacctaagtacctaaacccgtaagtaggtacggtaaggacgtaagtacgtaaccgacaacgaagtaacgtacccgacggggacgaggacggtccgaccgtagtaccggaaccccgggactacccggtaccgaaccggacgacgacgtacgtacacgacgtaggtagttgacgcgaaggcgtagagtatagtacgacgacgacggtccgtttactttagttcgacgtcgaggaaggaaggtagtaaccgaacgtaacctcgttacgttaccgttcccgtttacgtaccgtcggtaccgggg

SEQ ID NO: 191221 - DNA, 751 bp, Homo sapiens
  misc_feature: GYAE6OF02JFWBJ.42.42.D09.1.454.CMB.1.raw
  modified_base (178)..(178): a, c, t, g, unknown or other
  misc_feature (178)..(178): n is a, c, g, or t
  modified_base (243)..(243): a, c, t, g, unknown or other
  misc_feature (243)..(243): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccaggtnacaactggtgcagtctggggctaggaagtgaagacgccgtgggcctcgagtcggtaaggtttccngacgtaaggcatcgtaggatacaccttcaccgacggaccaacctatatcgcacgtgggtcgcggaacgaccggacccccggaacgaacggtacgttaggtaggtacggacgtacgggtacgtaactaccgggggtaacctaagttacggtagggtaaggacaacgtaccgtacgacgaacgtaaggtaacgtaccgacggacgaacggtacggtaccgaccgtacgtaccggaaccccgggactaacccggtaccgaaccggacgaccgaaccgtaacgtaccgtacgtaagtacgggtaggttacgacgtacgtacggtactaggaagtacgttacggacggtacggtaccgtaaccgggttaccgtttacggttttacgtcggtacggtacggaacggtaacgggtaacgggttaaacggtaaccggtaaacggttaacccgttccggttaacggtttacccgttttacccggttttacggttaccggttacgggttaacccgggg

SEQ ID NO: 191222 - DNA, 693 bp, Homo sapiens
  misc_feature: GYAE6OF02JEFU7.42.42.D09.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (565)..(565): a, c, t, g, unknown or other
  misc_feature (565)..(565): n is a, c, g, or t
  modified_base (597)..(597): a, c, t, g, unknown or other
  misc_feature (597)..(597): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtnctcactcccaggtncaactggtncngtcgtggggctgaaggtgaagagccgtggggcctcagtgaaggtttccngaccgaaggcatcgtggatacnccttcacctaggccaccaactatggtccacggtgggtagtaccggacgacggacccccggaacaacgggaccttggacggttggaacgtaggggaaccttaacgtaccaaacccgtttaagtaacggttggtaaacgggtaccaaaggtaccgtaccggtacaacgaacggtaacgttacccgaggacgaggtacgtccgaccagacggacccggaacgtaccggtccgaacgacgacaacgtacgtaaccgtacacggttgggtaacttcgggacgtacgaacgggtctagggaactaaggtntaacggacgtaacccgcgggttaccccgtttntttaagttcgaccgtacggaggtaacgggaggtaagtaccgaaagtaacccgttcggtacggttcccttaccgtttcggaccgtacggttccgggg

SEQ ID NO: 191223 - DNA, 665 bp, Homo sapiens
  misc_feature: GYAE6OF02GUJ2H.42.42.D09.1.454.CMB.1.raw
  modified_base (497)..(497): a, c, t, g, unknown or other
  misc_feature (497)..(497): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctgaagtgaagaagccgtgggcctcgaggtgaacggtttcctgacaaggcatcgtgatacaccttcacctaggcaccatactgcacgtgggtgcgacgaccggcccccggacgaacggactggacgtggagtcggactaagtacctaaccctaagtagtaggtagaacgagaacgtacgccgaacaaggtaacgttcgacggtacaggacgtccgtacacgttacggacccgggacacgtaccacggtacgcactagtcctaacgagttacggagttagacgtaccgagggtaccgngtaacgagttacgtaccggacgtaaccgaccggtccggttacttttaacgttcggaccggtaacgtaagggtaacggaacgggtaaacgtaccggaaacgttaaacccgttccgttcgggtttacccctttacccggttttacgtaaccgttacggttaacccggggg

SEQ ID NO: 191224 - DNA, 564 bp, Homo sapiens
  misc_feature: GYAE6OF02IV5GN.42.42.D09.1.454.CMB.1.raw
  modified_base (491)..(491): a, c, t, g, unknown or other
  misc_feature (491)..(491): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctgggctgaagtgaagagcctggggcctcagtggaaggtttcctgcaaggcatctggatacaacttcaccaggccaccatatgcacgtgggtgcgacgacggcccccggaacgaacggacgtggagtggagtgggaactaactaccaaacccttaataggtaggtacggaacacgactaccgcaacgaagtaacgttaccgaggcgagagtccgcagtcggacccggacaccgtccgacgagacacagtcacagtggagttgagcgaggcgtagagatagacgacgacgacggtccttntttagtcgcgtacggagaaggaaggagtaacgaagtaacctcgtcgtaccttccgttagtaccgtagtacggg

SEQ ID NO: 191225 - DNA, 575 bp, Homo sapiens
  misc_feature: GYAE6OF02F6YL8.42.42.D09.1.454.CMB.1.raw
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttccngcaaggcatctggatacaccttcaccaggcaccatatgcacgtgggtgcgacgacggcccccggacgaacggacttgagtggatgggactaataccaaccctaatagtggtaggacagacacgcacagaagttccgagggcagagtcgcagtcgacccggacacgtccacgngacacgacgtactacagtggagttgacgcgaggcgtagagtagtagtagacgaacgacggtccgttacgttttagtcgcgcggtaggaagggaagggacgtaacgaagtaacccgttcgtacggttccctttacccggttttacgtaccgttacggtaccggggg

SEQ ID NO: 191226 - DNA, 781 bp, Homo sapiens
  misc_feature: GYAE6OF02JYX9G.42.42.D09.1.454.CMB.1.raw
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaagttcttacaccataggactggacctggtgggtcttctgcttcctggctgtagctccaggtgctcactcccaggtgcaacgtggtgcagtcgtggggctagaagttgaaacgtagccgtggggcctcagtggaacgggtttccngcgaaggtcctagtcgtaggatacctaccttcacctaaggccgacctactaagttgaccgtacgtcggtagccgacgacggtacccccgagaacggtcttacggaggtacggacgtagggaaaccttacgtacaaacccggttaacgtaggtacggttaccggaacgtacgtaacgtaaccgggcaaacccggtaaggtaaccggtttaaccggcgggtaaccgtaaggacggttacccgacgtaacggtccgggaaccccggtacgaacccggttaccgaaccggacgaacgtaaacccgtggtaacccgttagaagttaccggggtagtaacggtacgtaacggagggtacccgttggaaacctgtaccgtttaacggaccgttaaccggaccggtaccggtttaccgttttaagtcgggtaccgtacggtaacgggtaacggaacgggtaacgttaaacgtaaccggaaccgtttaccggtcgggttaacccgtttacgtttaaccgggtaccgttagggttaacccggg

SEQ ID NO: 191227 - DNA, 701 bp, Homo sapiens
  misc_feature: GYAE6OF02JCQBY.42.42.D09.1.454.CMB.1.raw
  modified_base (141)..(141): a, c, t, g, unknown or other
  misc_feature (141)..(141): n is a, c, g, or t
  modified_base (304)..(304): a, c, t, g, unknown or other
  misc_feature (304)..(304): n is a, c, g, or t
  modified_base (502)..(502): a, c, t, g, unknown or other
  misc_feature (502)..(502): n is a, c, g, or t
  modified_base (561)..(561): a, c, t, g, unknown or other
  misc_feature (561)..(561): n is a, c, g, or t
tcagtgacgtatgtcacgaccggtgctcgatttagacacatacgcagggaagggggcatcatccaacaaccacactcccttctctacagaagccctctgagaggaaagttcttcaccatggactggacctggtgggtcttntgcttcctggctagtagctccaggtgctcactcccaggtcgcaacgtggtgcagtcgtggggctgaagtgaagagccgtgggcctcgaggtcgaagggtttcctgacgaacgggctattcgtagggactaacctaccgttacaccgacggcctaccatacgtnactgtcggtgcgaacgccggaccccggagaacggtcctttaggagtacgggtatcggggaacttaacggtacctaaacccgtaagtacggtacgggtaacgggaacgtagaaccgttaccgacgtaaccgaaaggtaacgttaccgaacggggtacaacgggtaccgtacgacccgtagtacccgggaaccccggganaaccccggtaccaaaccgtgacccgtaacgtcgttactacgtacgtgagttgcgaacgnggactaggactagtacacggaccgtaacgaccggtccttagtttacgtcggacgttaccgaggtaagggaacgtacggtaagtaaccgacgttaccgtcgggttaccctttaccgttacggtactttacccgggaccggg

SEQ ID NO: 191228 - DNA, 697 bp, Homo sapiens
  misc_feature: GYAE6OF02F12M3.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccaggtgctcactcccaggtgcaactggtcgcagtctggggctagaagtgaagaagccgtgggcctcgagtgtaacggtttcctgacgaaggcagtcgtaggactacctaccttcaccgtaggccaccatatgacgtacgtggtcgacgaccgaccggacccccggaagaacggtaccgttaggaaggtaggtacgtacggggaaccttaacgtaccctaaaacccgttaagttaggttacggtaacggacgaacgtaccgtaccgacaacgtaagtaacgttaccgagggtacgaacggtacgtccgactacgtaccggacccgggtaccgaccgtaccgacgacgaccgactacgtacgtacgagtggtacgttagacgtcgaggtacgtaggaagtagtaagtcggaaccgaccggtaccgtaccgtttactttacgtacgacggtacggaaggaacggtaacggtacgtaaccgtaacgtaacccgttcggtacggtttacccttccggtttacgtaccgttacggtaacccgggg

SEQ ID NO: 191229 - DNA, 878 bp, Homo sapiens
  misc_feature: GYAE6OF02IIDN6.42.42.D09.1.454.CMB.1.raw
  modified_base (187)..(187): a, c, t, g, unknown or other
  misc_feature (187)..(187): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcactcccaggtgcaactggtncagtctggggctgaagtgaagaagccgtgggggcctcgagttggtaacggttttccctgacgtaaggcatctggaattaccacctttcaccgtacggcaacccataacttgctacgtcgggttgccgtacgaccgggacccccggaacgaacggtaccgttagacggtggtaacgttacggggaaccttaaacgttacccgaaaacccgttaagtacggttacgggtaaacgggtaccgaacggtaccttaaccggaccgtaacggtaaacggttaaacggtttcccgaaagggggtcctaaaacgggtaccggtttacccgggaacccgtaacggttacccggggaaacccccgggtaaccgtaaccccggttaacccggtaaacccggtacggaacccgtaaccgtaaccggtttacccgtaaaccgttaccggttaaggggttaaccggtttacgggaccggtaaccggtaacgggtaccggttacggaaaggttaccgttagtttaaaccggggaacccgaaacgtacccggggttaccccgttttaacgttttaaccgtttcgggtaccggaccgggttaagggaacgggtaaggggtaaccgtaaccgtaacggttaaaaccgttcccggttacgggttaccctttacccggttttaacgtacccggttacgggttacccggggg

SEQ ID NO: 191230 - DNA, 718 bp, Homo sapiens
  misc_feature: GYAE6OF02I43AV.42.42.D09.1.454.CMB.1.raw
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactccagtgcactggtncagtctgggctgaagtgaagacgcgtgggcctcgagtgaaggttccngcaaggcagtctaggactactaccttcaccgtaggccaccatatgacgtacgtgggtacgaccggaccgaccgggtaccccccggacgaaacggtaccgttaggaagttacgggtacgtagggtaaccttaacgtacctaaaacccttaaacggttacggtaggttaaccggaacgaacggtaccttaaccggaccaacgtaacggtaaacggtttacccgagggaccgtaaggacgtccgaccgaagtaccggaacccggtaaccaccggtacccgaccgaacgccgaacgacgtaccgtaaccgagttaggtagttacggaacgcgtaggtactaggactaacgtagtacgaccggaaccgtacggtccgtttaacgttttacgcggtaccgacggaacgggaacggaaagggtaccgtaacgtaacggtaacgttacggttaccgttacgtttcccgtttaaggtacccgttacggaccgggg

SEQ ID NO: 191231 - DNA, 810 bp, Homo sapiens
  misc_feature: GYAE6OF02HDQUC.42.42.D09.1.454.CMB.1.raw
  modified_base (253)..(253): a, c, t, g, unknown or other
  misc_feature (253)..(253): n is a, c, g, or t
  modified_base (321)..(321): a, c, t, g, unknown or other
  misc_feature (321)..(321): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttccgtggctgtagctccaggtgctcactcccaggtgcaactggtgcacgtcgtggggctagaagtgaagagccctgggcctcgagtgtaaggtttcctgacaaggcatcnggactaccgaccttcaccgaggtcacctatatcgactacgtggtcgacgacgtaccggcccccggaanaacggtcttacggaaggtggtaacgtacggggaacttaacgtaacccgtaaacccttaaggttaacggtacgggtaaggaaccgtaaggaaccgttaaccggacctaaacggaaggtaaacggttacccggaacggggtacaacgggtaacgtccggaccgtaacgttccgggaacccgggtaacgaccggttacccgaacggtacgaccgtaacggtaccgttaccgtaacgtaggttaacgggttaacggttacgggaacggtaccggtaacgggaccgttaacgggtaagtaacgttaagtacgggtaacccggtaaacccgtaccgggttaccgttttacgttttaccgtaccggtaccggacggtaacgggtaacgggtaacggggtaaccgttaaaccgaaacggttaaacccgttcccggtttaccggttacccgttttacccccgttttaacgggtaacccgttaccgggtaaccccgggg

SEQ ID NO: 191232 - DNA, 776 bp, Homo sapiens
  misc_feature: GYAE6OF02JLUSG.42.42.D09.1.454.CMB.1.raw
  modified_base (570)..(570): a, c, t, g, unknown or other
  misc_feature (570)..(570): n is a, c, g, or t
tcagtgacgtatgtcacgaccggtgctcgatttagacacatacgcagggaaagggggcgatcatccaacaaccacatcccttctctacagaagcctctgacgaggaaaggttcttctaccatggactggacctggtgggtcttctgcttcctggtctgtagctccaaggtcgtactcactcccgaggtcgactaacgtggtgcaggttcgtcggggtcttaggaaggttggaaaagtacgccggtcgggggtccttaccgagtagggttaacgggtttcctgggaccgaaagggtcgacgtttaccaggtaacttacgtaaccttaccgacgacggacctacgtaactactcgtcgtacggtcggtagacgacggaccgggcccgaacgtaacggtacgtacggcggtaggtacgggtacggtacgtaacgtactaaacccgtaagtacggttaggtaacggacgtaacgaacgtaccgacggaaactacggtaacgtacggaacgacggtaccgaggtaaccgcgagggttaacccgaaccgggttaccaaacccgggtcgaacggganaacccgtaggtaacctaaccgtaattcggtaacggtacgtacgtacgccgaagggtacgtacgaatcgtacggtaggacgtacccgtcgggtaccgttttactaggttacgtacacgggtacgggtaaacgtagggtaacctcccggtaaaggtaagttaccggtcgtttaaccggtttacccgttaggtaccgtaccggtacggg

SEQ ID NO: 191233 - DNA, 740 bp, Homo sapiens
  misc_feature: GYAE6OF02GMRTH.42.42.D09.1.454.CMB.1.raw
  modified_base (237)..(237): a, c, t, g, unknown or other
  misc_feature (237)..(237): n is a, c, g, or t
tcagtgacgtatgtcacgaccggtgctcgatttagacacatacgcagggaaagggggcatcatccaacaaccacatcccttctctacagaagcctctgagaggaagttcttcaccatggactggacctggtgggtcttctgcttcctggctgtagctccaggtgctcacctcccaggtgcaacgtggtgcaggtcgtggggctgaagtgaagagccgtgggcctgagtgacgtttcngcaaggcagtcgtggactacaccttcaccgacggcaccatatgctaggtgggtcgacgaccgaccgggacccccggagaacggtacttggaggtaggagtacgggtaactaacgtacctaaaccgtaagtaggttacggaacggacgagtaaccgtaccgacacgaagtaacgtcgaagggactaggacgtaccgaccgtacgtaccggaaccgggaccgtacgtacccgacggaacgaccgtaacgtacgtacgtaacgtagtacgggttacggttaggacgtaccggtagggaccgtagaggtaacgtagtacggtaacccggtaccgtaaccgggttcccgtttaagtttttaccggcgggtaccggtacggtaacgggtaacggggtaacggggaaacggttaaaccgggtaaacgtaacccggttttcccggttacgggtttacccccgtttttaccttttaaccggggttacccggtttaccggggtaacccggggg

SEQ ID NO: 191234 - DNA, 678 bp, Homo sapiens
  misc_feature: GYAE6OF02H8QF0.42.42.D09.1.454.CMB.1.raw
  modified_base (499)..(499): a, c, t, g, unknown or other
  misc_feature (499)..(499): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtctggggctgaagtgaagagccgtgggcctcaggtgaaggtttcctgcaaggcatcgtggatacctaccttcaccaggtccaccatatcgcacgtggtgcgacgacgggccccggaacgaacggtaccgttgacggtggtaagtcgggtaactaactaccgaaacccttaagtacggtaggtaacggactaagaccgtacgacacgtaacgtaaggttccgaaggggtaccaagggtacgtccggacctacgacggtacccgggaaccgtaccggtaacccgaaggtacgcaacgtacgtacctaancggtaggacgttggagtacgaggtcaggtaacgagtagtacgaacgaccgtacggtaccgtttctttaagtcgacgttaccggaagggtaacggaaacggggtacgttaaccgaacggttaaccctcggttacggttccccgtttacccgttttacggtacccttaccgggtaccgggg

SEQ ID NO: 191235 - DNA, 655 bp, Homo sapiens
  misc_feature: GYAE6OF02HP009.42.42.D09.1.454.CMB.1.raw
  modified_base (179)..(179): a, c, t, g, unknown or other
  misc_feature (179)..(179): n is a, c, g, or t
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtncaactggtgcagtcgtggggctagaagtgaagagccgtgggcctcgagtagtaaggtttccngacgaaggcatcgtaggactacaccgttcacgnggcaccatatgctacgtggtcgacgaccgaccggaccccggaagaacggtacgtgacggtggagtacgggactacgtacaaccgtaagtaggtaggtacgacgtagactacgacacgtacgaacgttacgagggacgacggtacgtccgacgaggtaccggacccggacgtaccgtccgaacggacgaccgtacgtacgtacctaacggtacgtagggtaacgttgacgcgaacggtcgtaggagtaactagtacggaaccgtacgtaccgttccgttacgttttagcggacgtacggtacggaaggtacggtaacgaacgtaacgtaaccgttccggtacgtttaccgttacccgtttacgtaccgtacgtaacccgggg

SEQ ID NO: 191236 - DNA, 563 bp, Homo sapiens
  misc_feature: GYAE6OF02GDAH9.42.42.D09.1.454.CMB.1.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (365)..(365): a, c, t, g, unknown or other
  misc_feature (365)..(365): n is a, c, g, or t
  modified_base (485)..(485): a, c, t, g, unknown or other
  misc_feature (485)..(485): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctcaggtgctcactcccaggtgcaactggtgcagtctggggctgaagtgaagagccgtgggcctgagtgtaaggtttccngcaaggcagtcgtggataccaccttcaccaggcacatangcagtgggtgcgacgcgggcccccggagaacggacttggagtggagtgggaactatacaaccctaatcggtaggtagacagactacgcanagaacgttcagggcagacgtcgcagtcgacccggacgacgccgacgagcacgatacacagtggagttcgagcgaggctaggagatagtacgacgacgacggtccttatttacgtggacgnggacggaagggaacgggtagtaacgaacgtaacgtaccgttcgggttccttccgtttacgtaccgtacggtaccgggg

SEQ ID NO: 191237 - DNA, 642 bp, Homo sapiens
  misc_feature: GYAE6OF02JZD5B.42.42.D09.1.454.CMB.1.raw
  modified_base (317)..(317): a, c, t, g, unknown or other
  misc_feature (317)..(317): n is a, c, g, or t
  modified_base (510)..(510): a, c, t, g, unknown or other
  misc_feature (510)..(510): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctgggctagaagtgaagagccgtgggctcgagtgaaggtttcctgcaaggcatcgtaggatacctaccttcaccgtacggacacctatatgccacgtggtcgaccggacgaccggacccccgganaacgggtccttaggaggtaggagtagggaacctaagtaccaacctaagtacgaggtacgaacacgacctacgacaacgaaggtacgttaccgaggggacgacggagtaccgacgtataccgggacccggaagccctaccgaggtaccacgtagtacctagtacgatacggagttagaagccagggactacggngtactagccgaagacaccggtacgttactttgcgaccggagacggtaaggaaacggttagtaaccgaacgtttaccgtaccgtttagggacccccttttaccggttaatacccccgggttagtacccggggg

SEQ ID NO: 191238 - DNA, 721 bp, Homo sapiens
  misc_feature: GYAE6OF02GYDKC.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaactggtgcagtcgtggggctgaagtgaagagccgtgggcctcgagtgacggttcctgcaaggcatcgtggactacaccttcaccgaggcacctatatgcacgtggtcgcgacgacggcccccggagaacggcgtggagtaggtagtcgggactaataccaacccttaagtacggtaggtacggaacagaccgtacgcaacgaagtacgttacgaggacgagacgtccgaccgagtaccgggtacccggaccgaccgtaccgaaccgtacgacctaacgacgtacctaaccgtagtacgggtacggttaggaacggaccggagggtacgtaggtaaccgtaagttaacgttacggaaccggtaccggtaaccgggttacccgtttttacggttttataccgggtaccggtacgggtaacgggtaaacggtaacggggtaaactaaaccggtaaaccggttaaaccgtttaccccggttacgggtttaccccgttttacccggtttttaacggtaccggtttaaccgggttaacccggggg

SEQ ID NO: 191239 - DNA, 825 bp, Homo sapiens
  misc_feature: GYAE6OF02G8PR1.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaacgccgtggggcctcgagtggtaaggtttcctgacaggctagtcgtggataccgtaccttaccgaccgacggccaacctatatgactacgtgggtcgacgaccgaccgggacccccggacgaacggtaccgttggaacggtggaaggtcgggaaacctaactaccgtaaacccgtaaagttaggtaaggtacgggtaacacggtaacctaacggaccaaacgtaaggtaacgtttacccggacggggacctaaggtcggtacccggaccgtaacgtacccggggacccccgggtaaacgaccccgggtaacccgtacccggaaacggacccgaaccggtaaccgtacccgttaaacgacggttagggtaaccgggtttgaacggtaccggtaagggcccgttaggaaacgttaaggtaacgttacggaacccggtaagggtaaccccgggttacccggttttacgtttttaccggttaccggcccgggtaacggtaagggtaacggggtaaacggggttaagtaacccggtaaacgtaaaacccggtttcccggttagggttacccccttttaccgggtttttaacgtacccgggtttaacgtaacccgggggg

SEQ ID NO: 191240 - DNA, 612 bp, Homo sapiens
  misc_feature: GYAE6OF02GQ5BX.42.42.D09.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagagccgtggggcctnagtgaaggtttccngcaaggcatctggatacaccttcacctaggccaccatatgcacgtgggtacgcgacgaccgggacccccggaagaaggactaggaggtggagtgggactaactacaacctaagtaggtaggtacgacagactacgacacgagtaacgtcgagggacagacgtcgcagtacgacccggacacgtccgagcgacacacgtacagagtaggtagttagagcgaggtcgtagagagtagtacggacgaccgtacggttccgttacgtttagttcggaccgtagggacggtaagggaagggtaacgtaacgtaacggtaaccgttccgttacgggttacccttttacccggtttacggtaccgtacgggtacccggggg

SEQ ID NO: 191241 - DNA, 544 bp, Homo sapiens
  misc_feature: GYAE6OF02FL6R2.42.42.D09.1.454.CMB.1.raw
  modified_base (303)..(303): a, c, t, g, unknown or other
  misc_feature (303)..(303): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaaggtttcctgcaaggcatctggatacaccttcaccaggccaccatatcgcacgtggtgcgacgacggcccccgganaacggacttgagtggatgggaactaatccaacctaatagtggtagacagactacgcacagacgtcgaggcagacgtcgcagtcggacccgggacaccgtaccacgagtccagacgtcctaacagtggaaggttcgagcgacgggctagagatagtacgacgacgaccggtccgttatttacgtgacgcgaggaggaaggagtacagaacctcgtcgtctcctttagaccttaggtaccggg

SEQ ID NO: 191242 - DNA, 595 bp, Homo sapiens
  misc_feature: GYAE6OF02GL9MK.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagagccgtgggcctcagtgtaaggtttcctgcaaggcatctggatacaccttcaccaggccaccatatgcacgtggtgacgacgacggcccccggacgaacggacttggaggtcggagtgggactaatcaaccctaatagtggtagacagactacgacacagaagttccgagggacagacgtcgccagtcgacccgggacaccgtccacgacgcacacgtctaacgagtaggagttgacgcgaggcaggtagatagtagacgtaacgaccggtcctttacgtttcgtagccgtaggacggaagggaagggaacggtaacgaacgtaaaccgttccggttacggttacccgtttcccgttttacggtaccgttacggtaacccggggg

SEQ ID NO: 191243 - DNA, 696 bp, Homo sapiens
  misc_feature: GYAE6OF02IV120.42.42.D09.1.454.CMB.1.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtctttctgcctttcctggctgtagctccgaggtgctcacctcccgaggtgcaagtcccccggtgcgagtcgtgggctgaagtgaagagcgtgggcctcgagtgtacgttccngacaggcngtctgactacctaccttcacccaggccgaccactatcgcctacggtcggtacgcgaaccgaccgggtaccccccggaagaacggtacttaggacggtgggactgggaacttaacgtaccgtaaaccgttaagtacggttacgggtaacgaacgtaacgaccgtaacgaactaacgtaacggtaacgttcccgaagggacaacggtcgacgaccgtacgtaccggtaacccgggaccgaacccgtaccgaccgacgaaccgtacgtaacgtcgaacgtagtacgggtaagttcgacgcgaggtctaagagtagtagacgacgtacgtacgttccgttaacgtttgacgtacgtacggaacggaaggtaacggactaacggacgttaaaccgtcggttacgttacccgtttacccggtttagtaccggttacggtacccgggg

SEQ ID NO: 191244 - DNA, 725 bp, Homo sapiens
  misc_feature: GYAE6OF02IG4K9.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtctttctgcttcctggctgtagctccaggtgctcactcccaggtgcaactggtgcagtctgggctgaagtgaagagcgtgggcctcgagtgtaagtttcctgacaaggcatcgtgtataaccgcctttccaaccgtacggcaacccattaacgtcgctaacggtggggttacggccggaaccgaccgggccccccgggaaacgaaacgggtaccttaggtcggtagggtagtacggggtaacttaaacgtacctaaacccgttaaagttacggtacgggttaacggaactacggtaacgtaacggaccaaccgaaagtaaaccgttcgaagggaccacggtaaggtcccgacgtacgtcggaaacccgggacgtaccgtacccgtacggacgacacgtagtactacgagttcggagttcggagtacggagccgtagtaagtagtaacgagaaccgacgtaaccggtcgtttacgttttacgtacggacgtacggtaaggtaacgggaagggtacgtaaccgaagtaacccggttccgtacggtttaccctttaccggttttaacccggtagttacccgggtaaccggggg

SEQ ID NO: 191245 - DNA, 517 bp, Homo sapiens
  misc_feature: GYAE6OF02GRY62.42.42.D09.1.454.CMB.1.raw
  modified_base (398)..(398): a, c, t, g, unknown or other
  misc_feature (398)..(398): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagagcctggggcctcagtgaaggtttcctgcaaggcatctggatacaccttcaccaggcaccatatgcactggtgcgacaggcccccgacaaggacttgagtggatgggactaatcaaccctaatagtggtaggacagactacgcacagagttccagggcagagtcgccatcgacccggacacgtccacgngcacgagtcacatggagttgagcaggctgagatatgacgacgacggccgttacgtttatgcgacggaggaaggaagggagtacaagaactccgtggtccttcctttgacctcgtcgggg

SEQ ID NO: 191246 - DNA, 717 bp, Homo sapiens
  misc_feature: GYAE6OF02HEHI0.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaagccgtggggcctcagtgtaggtttcctgacgaggcatctaggattaccaccttcaccacggcaccatatcgctacgtgggtgcggacgaccgggacccccggaacgaacggtacgtgaggtggagtacggaactaacgtacctaaacccgttaagtaggtacggtacggaacgtacggaccgtaacgacaacgaggtaacgtaccggaggacgaaggacgtccgaccgacgtaccgggaacccgggacgtacccgtaccgacggacgacgaccgacgtacctacgtaggtggtacgttggacgtcgaacggtcgtaggactaagtacgtacggtaacgtaccgtaccgggttccgttttaccgtttttagtccgggtacggacggtaacggaaacggggtaacgggaacggttaacggtaaacccggttaaccgttccggtttacccgggtttacccgttttaccccggttttcggtaacccggttacccggttaacccgggggg

SEQ ID NO: 191247 - DNA, 791 bp, Homo sapiens
  misc_feature: GYAE6OF02F6ZGV.42.42.D09.1.454.CMB.1.raw
  modified_base (248)..(248): a, c, t, g, unknown or other
  misc_feature (248)..(248): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctccaggtgcaacgtggtgctagtcgtggggctgaaggtgaagaacgccgtgggcctcgagtcggtaacggtttccgngacaaggcatcgtaggatacaccttcaccgaggccaccatacgtgactacgtgggtgaccggaccgaccggggacccccggaagaacgggtaccgtttgggtaaggttcgggaaggtacggggtaaccttaaagtaccctaaaaccccgttaaaggttacggtagggttaacggaacgtaacggtacctaacgtaccgaacgaacggttaaacgttcccggagggtaccgaaggtacgtacggacctaggtacccggaacccggggtaaccaccggtacccgaacgggcgtaccgaacgtacggtacttaacgaacgttaggggtaacggttgtaccgggacgtaccgggttacggtaacgaggtaagttacgtacggtaaaccgaccgtaacccgggtccgttttacgtttttaacgtccggtcgtaaggggtacggaaaggggtaaccgggaagtaaaccggtaacgaaaacccggtttccggttaacgggtttcccctttacccggtttacggttacccgtacggggttaaacccggggg

SEQ ID NO: 191248 - DNA, 741 bp, Homo sapiens
  misc_feature: GYAE6OF02JW2U2.42.42.D09.1.454.CMB.1.raw
  modified_base (320)..(320): a, c, t, g, unknown or other
  misc_feature (320)..(320): n is a, c, g, or t
  modified_base (723)..(723): a, c, t, g, unknown or other
  misc_feature (723)..(723): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctcgaggtgctcgacctccgaggtcgactaacgtggtcgcgcggttgtgggcgtagaagtaggaagacgcggtcgggcctacgaggttggtaacggtttcctacgacgtaacggctacgtcggtaggtacctacccgttactaccgaacgaccgtaccaacgtntcggtacgcggtcggttggccggacggacccggtaaccccggaccgtaacgtacggtaggtacggaggtacggacgggtacgtaaacttaacccgtaaactaacgttaagggtaggtacggaaacgtacggaacgaacgtaacgaacgtaaacgtacgtacgggtacggagtaccggagtccgcgtaacgtcggtaacccggacccgagtacccgaacgacgtaccaacgtacgtaccggtaaccaaggttcgtaagggtcggtacgacgacggtcgttagacgttacacggtaacggtaaccgacgttaccgaccgttttacttaaggtttcgacgtagggtaacgaagggtcgtaaaccggaagttaccggacgttacgttccggtaacgtttcttaccgnggttaccgacgggtacgg

SEQ ID NO: 191249 - DNA, 640 bp, Homo sapiens
  misc_feature: GYAE6OF02G04KX.42.42.D09.1.454.CMB.1.raw
  modified_base (170)..(170): a, c, t, g, unknown or other
  misc_feature (170)..(170): n is a, c, g, or t
  modified_base (192)..(192): a, c, t, g, unknown or other
  misc_feature (192)..(192): n is a, c, g, or t
  modified_base (245)..(245): a, c, t, g, unknown or other
  misc_feature (245)..(245): n is a, c, g, or t
  modified_base (333)..(333): a, c, t, g, unknown or other
  misc_feature (333)..(333): n is a, c, g, or t
tcagtgacgtatgtcacgaccggtgctcgatttagacacatacgcagggaaagggggcatcatccaacaaccacatcccttctctacagaagcctctgagaggaagttcttcaccatggactggacctggtgggtcttctgcttccgtggctgtagctccgaggtgctcncctccgaggtcgactacgtggngcgtagtcgtgggctagagtagaagagtccgtgggcctgagtgtacggttccngacaggcagtgtgatacctacctacacgacgaccacgatactcgactagtggtcgaccgtacgacccggcccgaagacggtactgagnggtacgtacggaactaacacctaactagagtaggagacagactacgataacgaagtacgtcgaggacgagacgtcgacacgtacggaccgacgaccgtaccgacgacgactacgactctaacgagtcggtacgtagacgacgaggtcgaagtacgtagtacgtaacgaaccggccggttaacccggtcgtttaaccgttttacgcggtaccgaaggtacggtaaagggaaaccggtcgtaaaccgaacgttaaccgtccggttaccgttccgtttaccggtttaacgtaccgtacgggtaaccgggg

SEQ ID NO: 191250 - DNA, 619 bp, Homo sapiens
  misc_feature: GYAE6OF02HP7N4.42.42.D09.1.454.CMB.1.raw
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (448)..(448): a, c, t, g, unknown or other
  misc_feature (448)..(448): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaactggtgcagtctggggctgaagtgaagaagccgtggggcctcgagtgtacggtttcctgacaaggcatctaggactacaccttcaccgaggcaccatatcgcacgtggngcgacgaccggccccgganaaggtctgagtggangggactaataccaacctaatggtggtacgacagactacgacacagaacgttccgagggcaacggacgtccgacagtccggaccccgggacaccgtcccacgacgaccgaataccgtcaacgngtacggagttcgaacgcgacggtcgaggaagtatagtgaaccgccggtaaccggttcccgttagtttttacgcggttccgaacggtacggaaggtaaccggggaactacgtaaacgtaaccgtccggttacgttaccttaccccgttttagtacccgtaggtaacccgggg

SEQ ID NO: 191251 - DNA, 707 bp, Homo sapiens
  misc_feature: GYAE6OF02GFX6Z.42.42.D09.1.454.CMB.1.raw
  modified_base (237)..(237): a, c, t, g, unknown or other
  misc_feature (237)..(237): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccaggtgctcactcccgaggtgcaactggtgcagtcgtgggctgaagtgaagagccgtgggcctgagtagaaggtttccngacaaggctatcgtgatacaccttcaccaggcaccatatgcacgtgggtcgacgaccgacgggacccccggaacgaacggtaccgttggaggtggagtgggtaactaacgtaccaaaccgtaagtaggtaggtaacggacgaagaccgtaacgacgaacgaaggtaacgtccgagggacgaagcgtaccgaccgtagtaccgggaacccgggaccgtaaccggtacccgacgagtaccacggtaacgtacctacgtagttaggtacggtttaggagtaccgagggtccaggtagtacgtagtacgggaaccgtaaccggtaccggttccgttttaacgttttcgtaccgggacgtacggtaacgggtaacggaaaccgggggtagtaaccgttaaacggtaacccgttaccggttaccgggtttccctttaacccggtttttacggaccggttaccgggttacccggggg

SEQ ID NO: 191252 - DNA, 654 bp, Homo sapiens
  misc_feature: GYAE6OF02HQZ3S.42.42.D09.1.454.CMB.1.raw
  modified_base (240)..(240): a, c, t, g, unknown or other
  misc_feature (240)..(240): n is a, c, g, or t
  modified_base (291)..(291): a, c, t, g, unknown or other
  misc_feature (291)..(291): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagaacgccgtgggcctcgagtgtaggtttccngacgaggcatctggatactaccttcaccgaggccaccatatgctacgtggngcgacgaccggccccggaagtaacggacttacggaggtaggtgtagggactaactaccaacccgtaattacggtaggtaggacaagactacgacaagtagaacgttaccgaggacagagtccgacagtacggacccggacgaccggtccgaacgacgaccacgacgtaccacgtaagtggtacgttaggacgacgtacggagtacggaagtagtagtcgaacggtaccgtaccgggtccgtttacgttttagtacgcggtacgaacgggtaaggaacgggttaacggtaaccgaaacggtaacccgttccggttacggttacccgttttacccgtttacggtaccgtttacgggtaccggggg

SEQ ID NO: 191253 - DNA, 887 bp, Homo sapiens
  misc_feature: GYAE6OF02JPNK7.42.42.D09.1.454.CMB.1.raw
  modified_base (184)..(184): a, c, t, g, unknown or other
  misc_feature (184)..(184): n is a, c, g, or t
  modified_base (278)..(278): a, c, t, g, unknown or other
  misc_feature (278)..(278): n is a, c, g, or t
tcagtgacgtatgtcacgaccggtgctcgatttagacacatacgcaggaagggggcgagtcgatcaacaaccacatccttctctacagaagcctctgagacggaaagttcgttcaccatggactggacctgtgggtctcgtgcttcctggactggtagctccgaggtgactcactcccaggtcncaactggtgccgagtccgtaggggccttggaaacgtggaaacgaacggtcccgtagggggtccctcagggttacggaaacgggtttttccccgngacgtaaaacggggcctaacttcggttacgggacttaaccgaccgtttcgaaccgacggtccgaacgtacgtaactggtacctaccggtacgggttcggaccggtaccgaccgggtacccccggtaaccgtaacgggtaccttcggaacggtcgggtaggtaccgggaacgtaaccgtaccgtaaccccgttaaggtacggttaacgggtacggaacgtaacgaaccggtaacgtccgaaacggtacggtaaacgttcccggaaacgggtccgtaaacgggacggttaacccgccgggaaacttcccggggtaaacccccggaaggtaccccggtacgtaaccggacgaaccggaacctaccgggtacgttaaacccgaggttaccgggacggttacggaagtccgaaggttccgtaacggtaacgtacgtaacgtcggtaaccgggaaccgtaccgggtaacccggtttacgttttacgggtaacgtacggggtaccgaagggttaaaccggggtaaggggttaacgaaccgggttaacgtaaaacccgttcgggttacccggttactttaccccggggtttaattacccggtaggttaaccccgggg

SEQ ID NO: 191254 - DNA, 661 bp, Homo sapiens
  misc_feature: GYAE6OF02H35PF.42.42.D09.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (450)..(450): a, c, t, g, unknown or other
  misc_feature (450)..(450): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagccgtggggcctcagtgaaggtttccngcaaggcatcgtggactacaccttcaccaggcacatatgcncgtgggtgccgacgaccggccccccggaacaaggtaccttaggaggtggaagtgggaactaacgtaccaaacccttaagtaggtaggtaaggacgaagtaccgtacgacaacgaagtaacgttaccgaaggcgaagcgtcgacagtcgacccgggacacgtcagacgcacngtactagagttgaggttgacgcgaggcgtaggacgaagtatacggaaccgtaacgaccggtaccgtttacgttttaacgttcggaccggtacggtaagggaacgggtaaacgggtacggtaaaccgtaaccgttaaaccgttcccggttaccgggttacccttttaccccggtttttacggtaaacccggttaccgggttaacccgggggg

SEQ ID NO: 191255 - DNA, 659 bp, Homo sapiens
  misc_feature: GYAE6OF02IZDOU.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtctgggctgaagtgaagagcgtggggcctcagtgtaaggtttcctgcaaggcatctaggataccaccttcaccaggccaccatatgcacgtgggtgcgacaccggccccggaacgaacggacttcgagtggacgtagggactaagtacaaccctagtaggtacggtagacgacgacgtacgacaacgagtaacgttacgagggaccgagacggtcgactacgtacggaacccgggaccgaccggtccacggagccgaactacgtactacgagtcgggagttgacgcgaggtacgtaggagtagtaacgtcggaacgaaccggtaccggtaccggtttacgtttttacgtccggtaggtacccggaagggtaaacgggaacgggttaacgtaacgtaaaccgggtaaaccttccggttacggttacccgtttaccccggttttagacccggtttagggtaacccgggg

SEQ ID NO: 191256 - DNA, 795 bp, Homo sapiens
  misc_feature: GYAE6OF02JXFVB.42.42.D09.1.454.CMB.1.raw
  modified_base (172)..(172): a, c, t, g, unknown or other
  misc_feature (172)..(172): n is a, c, g, or t
  modified_base (544)..(544): a, c, t, g, unknown or other
  misc_feature (544)..(544): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctgggtgggtcttctgtcttcctggctgtacgctccaggtgctcncctccaggtcgcaacgtgggtcgcgtagtccggtggggctaggaaaggtagaaacgggaacgtccggtcgggggtccctacggtaaggttacgggtaaacggtttttccgaggtaccggaacgggtactaacggtccggttacggaacttaacccgaccgtttaccgacccggaagggtaccaaaccgttaagttacgttacgggtaccgtaacggtcggggtacgaaccgggtaccggaacccgggggtacccccgggtaaaacggaaacgggttaccgtttaggggtaacgggtacggtaacgggtacggggtaaacctaaaccgtaccgaaaaccgttagtaacggtcggtaagacgtacggacgtacncgaacaggtaactcgaggacagtacgcgcacggtcggaacccggtacgaaccgtacgacgaacgcgaacgtatacgacgtagtacggtaggttacgagaggtagccgtaagacgtagtacgacggacgtaccgaccggttacttacgttacgtggcgtacgaagggtaacggtaacgggtaacgtaggtaaccggtacttacgggtaccgttaccgtttccgtttaacggtaccgtacgggtaacccgggg

SEQ ID NO: 191257 - DNA, 917 bp, Homo sapiens
  misc_feature: GYAE6OF02IQSZ7.42.42.D09.1.454.CMB.1.raw
  modified_base (241)..(241): a, c, t, g, unknown or other
  misc_feature (241)..(241): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtgggctgaagtagaagaagcctggggcctcgagtggtacggtttccngcaaggcctatctggtactactacctttaccaacccgtaggaccaacctaatagttacgcgtaccggttgggggttacggaccggaaccggacccgggggtacccccccgggaaacgtaaaccgggggttaaccgtttaggggaacgggttacggggtaaggttacgggggttaaaccgttaaaacgttaaccccgtaaaaacccccgtttaaaagtttaacggggttaacggttaaagggaacccgtaacggtaaacccgttaaccggacccgtaaacgaaacgggtaaaccgtttaccgggaaacgggggacgtaacggtaaccgggtcccggtaacctacgtacccgggtaacccgggaaccgaacccggtcccgaaccggaacgaccaacggtacgtccgtaacgtacgttagggtacgttacggacggtacgtacgggtcgtaggaacgttaagtacgttaacggtaaccgggacccgtaaaccgggtttacccgtttacgtttttaacgttcccgggtacgggtaaccggtaagggtaaacgggaaaaacgggggtaacggttaaaaaaccggtaaacccggttacccgggttttacccggttttaacccggttttaccccgttttaccggtaaacccggtttacccgggtacgggggtaaacccccggg

SEQ ID NO: 191258 - DNA, 828 bp, Homo sapiens
  misc_feature: GYAE6OF02G8TOX.42.42.D09.1.454.CMB.1.raw
  modified_base (237)..(237): a, c, t, g, unknown or other
  misc_feature (237)..(237): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgcagtcgtggggctgaagtgaagagccgtgggcctcagtgaaggtttccngcaaggcatcgtggatacaccttcaccacggcaccatatgcacgtgggtcgcgacgaccgggcccccggacaacggaccttaggacggtgggaacgttcggggaacttaacgtaccctaaaacccgtttaagtaacggttacgggttaacggaaccgaacggtaaccgttaacggcccaacgtaaaggtaaacggtttacccgaaggggtaccaaggtacggtaccgaccctaagttcccggggaaccccgggtaaccaacccggttacccgaaaccgggaaggtaccccaacgaacgttaccgtaaacgtaagttacgggtaacggtttgaacgggtacgaaccggggtaccgtagggaacgttaagtacgttaaccgggaaccggaacccggttaacccggggttacccgtttttaaccggttttttaacgtccgggtacccgggttaagggtaacgggaaaacgggttaaaccggggggtaacgttaaaccggtaaacgggttaaaacccgttccgggttaaccggtttaccccggttttacccccggttttacggttaaccgtttaaccccgggttaacccgggggg

SEQ ID NO: 191259 - DNA, 663 bp, Homo sapiens
  misc_feature: GYAE6OF02HPZLP.42.42.D09.1.454.CMB.1.raw
  modified_base (243)..(243): a, c, t, g, unknown or other
  misc_feature (243)..(243): n is a, c, g, or t
tcagtgacgtatgtcacgaccggtgctcgatttagacacatacgcagggaaaggggcatcatccaacaaccacatcccttctctacagaagcctctgagaggaaagttcttcaccatggactggacctggtgggtcttctgcttcctggctgtagctccaggtgctcacctcccaggtgcaactggtgcagtcgtggggctggaagtgaagacgccgtgggcctcgagtaggtaagtttccgngcgaagcagttcgtagataccgtacttcgacacggcacatatgacacggtggtcgcgacgaccggaccccggaagaaggtctgaggtgagtggactaactactaaccgtaagtagtaggtagacgagacctacgcgaacgaagtacgtaccgagacgacggacgtccgacacggtcgggaaacccggaccgaccgtaaccgacggacgaccgtacgtaacgtactaacgaagttgtaacggttaggaccgtacggaggctaaggactaagtcggaacgtaccggaccgttacgggttaccgtttagtttaacgtggtaccggtagaacgggaaggttaaccgggactaacggaaccgttaacggtacccgtttcgttaccccggtttatttaacccgggtacgttacccgggtaaccggg

SEQ ID NO: 191260 - DNA, 900 bp, Homo sapiens
  misc_feature: GYAE6OF02I9NJZ.42.42.D09.1.454.CMB.1.raw
tcagtgacgtatgtcacgaccggtgctcgatttagacacatacgcaggggaaagggggcatcatccaacaaccacatcccttcgtcttacagaagtcctcttggagaggaaagttcttcaccaatggactggacctggtgggtcttcgtgtcttcctggctaggtagtcttccaggtgctactaacgtcccaggtgcaacgtggtgcagtcgtggggctagaaggtggaaggaagtccgtgggcctcgaggtcggtaacggtttccagcgaaggtcagtccgtaggactacctacctttcacccgtacggtacctaccctattaagttcgactaaccgtggggtacgaccggtacccggaccgggccccccggtaacggaacggtacccgtttaggaacgggttgggtaacggtacgggggtaacgttaaacgtacccggtaaaccccttaaaaggtaacggggttggttaaacgggtaacgtaacggtaaacccgtaacggtaccgaacgtaaacggttaaacgttacccggaaaggggtaccgtaacgggaacggtttcccggacccgtaacgtacccggggtaaacccgggtaacccgtaacccggtaacccgaacggtaaccggaaccgtaaccggtaacggttaaccgaacttaacggtaggttaacggtttacggacggtaaccgtaagggtacgtaaccggtaaggttacggttaacgtacggtaaacccgggttaaccgacccgggtttaccgtttaccggtttaacgttacggtacccgtaaggtttaacgggaacgggtaacggggttaactaacggtaacgtaacccggttaccgttacgggttacccctttaccggtttacggtacccggttaacgggtaacccgggg

SEQ ID NO: 191261 - DNA, 875 bp, Homo sapiens
  misc_feature: GYAE6OF02H1N6O.42.42.D09.1.454.CMB.1.raw
  modified_base (205)..(205): a, c, t, g, unknown or other
  misc_feature (205)..(205): n is a, c, g, or t
  modified_base (664)..(664): a, c, t, g, unknown or other
  misc_feature (664)..(664): n is a, c, g, or t
tcagtgacgtatgtcacgaccggtgctcgatttagacacatacgcagggaaagggggcatcatccaacaaccacatcccttctctacagagcctctgagaggaaagttcttacaccatggactcggacctggtcgggttctttctgtcttccgtggctgagtctccgaggtcgactccgacctccggaaggtcactaacgttggngacgtacgttcggtggggtactagggaaggttaggaaaacgggtaccgtccggttcggggtaccccttaacggtagggttacggtttaaaccgggttttccaaggacggtaacggtctaacgttccgtaggtactaacccgtacctttaccgaaccgacggtaccaaccgtagtacgtacgacgttacggtgggtaccgtacccggtacccggaaccccggggaccccggtaaaggtaaccggttacgtttacgggaacggttaacgggtacgggtaaacgggtaaccttaaaccgtaacccctaaaccggttaaagttacggggtacgtaaccggtaacgtaccgaaccgtaccgaactaaacggtaacggttacgtaaccgggacgggtacaacggttaccgggaccctacggtacgggacccggaacccgggtccgaaccggtaccgaaccggtanaacccgtactaacggttaccgtaacgttaggtacgggttaacgtggaacgcggtacggagttaaggaacgttacgtaacgaccgtaaccggtacctccgggtttaaacgtttcgttcgggatccgggtaaggacggtaagggaacgttacgaaacgggtactaaccgttcgtttccggtaccttttacggacgtaccggttaccggacggg

SEQ ID NO: 191262 - DNA, 720 bp, Homo sapiens
  misc_feature: GYAE6OF02FUOCO.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctgaagtagaagagccgtggggcctcgagtggtacgtttcctagacgaaggcagtcgtaggactacaccttcaccgtaggccacctatagtgaccgtacgtgggtcgacgaccgaccgggacccccggagaacggtcgttaggaggtacggagtacggtaacgtaactaccgtaaacccgtaagttacggtacggtaacggacgtaacgaaccgtacgacgtaacgtaaggtaaacgttaccggaagggcgaacggtacgtaccgccgtaagttaccgggaacccggtaccgaccggtacccgacggaccgacacgtacgactacgtaggtacgtacggttagacgtcgaggtcgtaggtacgtagtgaacgggtaccgtaaccggtacggttaccgttttcgtttacgtcggtaccgggacgtaaggtaaagggaacgggtaccggtaacgtaaccgttaaccgttcggtaccgtttacccggtttcccgtttacggtacccgttacgggtacccgggg

SEQ ID NO: 191263 - DNA, 688 bp, Homo sapiens
  misc_feature: GYAE6OF02GD8Q0.42.42.D09.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (531)..(531): a, c, t, g, unknown or other
  misc_feature (531)..(531): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcactcccgaggtgcaactggtgcagtctggggctgaagtgaagagccgtgggcctnagtgtacggtttccngcaaggctatcgtggactacacccttcaccaggcaccatatgctacgtgggtcgacggtacgaccgggtacccccggaacgaacggtacgttacggagggtacgggtaaggtacggggtaacttaaacgtaccctaaaaacccgttagtaacggtacgggtaaggtaacgaacggtaccgtaccggacaacgtaacggtaaacgttccgaagggactaggtcgtaccgaccgtaggtaccggacccgggtaacacccggtaccgacggacgtaccgaacgtacgtctaacgngtacggtagttacggagcgaagggtctacgaggtactagacggtacaaccggtccgtcgtttacgtttagtgcggacgaaggtaaggaagggtaactaaggaccgttaaaccgtccgtttcggtaccgttcccgtttaagaccgtacggtaccgggg

SEQ ID NO: 191264 - DNA, 795 bp, Homo sapiens
  misc_feature: GYAE6OF02FSH66.42.42.D09.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
  modified_base (626)..(626): a, c, t, g, unknown or other
  misc_feature (626)..(626): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggcctgtagctccaggtcgctcacctcccaggtcgactaaccgtggtcncgagttcgtcgggggtactaggaagtagaacggaacgtcccgttacggggcccttacggaggttaggtaaaggttttcccgngtaccgaaagggtcctaagttcgtaggaacttaccgtaccctttacgaaccacggtacctaaccctattacgtagacccgtacggttgggtcggtaaccgaccggacccgggtaccccccggtaaggaacggtaccgttaggagggtttgggaagtcgggtaacctaacgtaccgtaaaccttaggtaggtacggtacgggtacaacgggttacacgacctacggagtaaacgttcggaacggaccgtaggtacgtccgtaccgagtaccgggaccggacaccggtacacggactacgacgacgtctaagtgtcggaattgggacgtacgtacggacgtaggtaacnggtttaaacgcgacccgtaacgtaccggggttaccttttacttacgggttccggacggttacggaacgtaaacgggggtaacggtaagtaacccggtaaaccggttaaccgtttcgtacccgggttaaccgttttccgttaaccggtccggtttaagggtacccggggg

SEQ ID NO: 191265 - DNA, 822 bp, Homo sapiens
  misc_feature: GYAE6OF02JVMD8.42.42.D09.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccgaggtgccaactgggtgcacgtgtcggggctgaagtggaaagagccgngggcctcgagtagacggttttccngacgtacggctagtcgtaggactaccgaccttccgaccgtacggcctaacctagtgtacgccgtacgtgggtgtaccggacgtacccggaccccggaacgtaacggtacttcggaacggttacggtaacggtacgggtaaccttaaagttaccgtaaaaccccgtaacgttaacggttacgggtaaccggaaccgttaacgtaaccgttacccggacgtaaaccgggaacgttaacgggttaccctaacggggacgtaaccggacggttacccggaccgaacgtttacccgggaacccggaacccggtaaccccggtaccgaaccggtacgtacctacggtaccgtacgtaacgttacggtaggtaacggttcgaaccggtcgtaaccggtacgtacgtaaggtaccgtaaggttaccgaaccgaaaccgttccggttacggtttaccgttttaacgcggttaccgaacggaacgggaaccgggttaaggaaaccgttcggaaaccggttacccggttccggttacccggttaccgtttaccggttttacggacccggtttacgggtaccccgggg

SEQ ID NO: 191266 - DNA, 832 bp, Homo sapiens
  misc_feature: GYAE6OF02INAU8.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccctatggactggacctggtgggtcttctgcttcctggctgtagctccaggtgtcgtccacctcccgaggtcgctaacgtggtcgctcggtcgtggggctaggaagtagaagacgccgtcggggcctagaggtacggtaacggtttccgtgacgaacggctagtacgtggtacctacctaccttaccgaccgacgacctaaccgtacgtacgtcgaccgtacggtacgggtacgacccggaccgggtacccgggaccccggtaacgtaaccggttacggtacggtacggtacggtaggtacggtaacttaaccgtaacccgtaaccgttaaggtacggtacggttaacggaacgtacgtaaccgtacgtaccgtaacggtaacgtaccggtaccgggtacggtacggtaacggtaccggtaccgtaccgtaccgggtaccccgggtaacccgggtacccgtacccggtaccgtaacggtaccgtaccgtacgtaccgtccgttaacgttaacggtacggtaggtacgacgtacggtacgcgtacggtaacgtacgtacgacggtaaccggtaccggttaccggttacgtttacgtttacggtaccggtacggacggtaacggggtaacggtaacggttaaccgtaaccggtaccgttaacccgttcggttacccggtttacccgtttaccgtttccggtaccggtacgggtacccggg

SEQ ID NO: 191267 - DNA, 753 bp, Homo sapiens
  misc_feature: GYAE6OF02I7V1I.42.42.D09.1.454.CMB.1.raw
  modified_base (179)..(179): a, c, t, g, unknown or other
  misc_feature (179)..(179): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtncaactggtgcagtcgtggggctgaagtgaagaagccgtggggcctcgaggtgtaaggtttcctgacgaaggcatcgtggatacaccttcaccaggccaccgatatgactacgtgggtcgcgaccgaccgggcccccggagaacggcttggacgtggacgtagggactaataccaacctaagtggtaggtagacgagactacgacacgaagtaacgttcccgagggacaacggtacggtccgaccgaacggtaccgggaaccccgggaaccgtaaccggtacccgaacggaacggtaccgaacgtaccggtaccgtaaccgtaaggttacgggtaacgttagggaacgtaccggtaacgggtaccgtaggtaacggaagtttacggaacggtaaccgtaaccggtaccgggttacccttttaacggttttacggtttaccggacccggttacgggtaacggtaacggggtaaacgggttacggtaaacccggtaaacggtaaacccgtttcccggtttacggtttaccccgtttacccggttttaccgtacccggtttaccgggtaacccggggg

SEQ ID NO: 191268 - DNA, 812 bp, Homo sapiens
  misc_feature: GYAE6OF02I02LG.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaactggtgacagtcgtggggctagaagtgaagaacgccgtggggcctcgagtggtaacggtttccctgaccgaaggcaatccgtaggactaccaccttaccaccgaggaccaccaatacgtcgactacgtcggtcgacggaccgtaccgggacccccggaagaaacggtacgttaggacggtacgggtaacgtacggggaaaccttaacgtaacccgtaaaaccccgttaaagttaacgggttacgggaacggtaaccgaaacgtaaccgtaaccgaacgtaaacgaaacgggttaaacgttccggaaagggaccgtaaaggacggttaccgaaccgtaacggttaccgggaaccccggggaacgtaacccggtaccgaaacggtacgaccgtaacgtaaccggttacctaaagttaacggtacggttaaggttacgaacgtacggaacggtcgtaacgtaaggtacgtacgtacggaacgttaccgggtaacggttaaccgttttacgtttaagtccggaaggtacggtagggaaacgggtaacgggtaacgtaaaccgtaacggttaaaccttacccggttacgtttccgtttaacccgtttaggtaaccggttaccgggtaacccgggg

SEQ ID NO: 191269 - DNA, 887 bp, Homo sapiens
  misc_feature: GYAE6OF02JP5WZ.42.42.D09.1.454.CMB.1.raw
  modified_base (271)..(271): a, c, t, g, unknown or other
  misc_feature (271)..(271): n is a, c, g, or t
  modified_base (413)..(413): a, c, t, g, unknown or other
  misc_feature (413)..(413): n is a, c, g, or t
tcagtgacgtatgtcacgaccggtgctcgatttagacacatacgcagggaaagggggcgatcatccaacaaccacatcccttctctacagaagcctctgagaggaagttacttcaccactggactggacccgtggtgggtcttcgtgcttccgtggctgtagctccaggtgctcactcccgaggtgtcaacgtggtgctacgtgtcggggctggtaacggtaggaacgaacgtccggtcggggcctccgtaagtcggtaacgggtttcccnggaccgaaggtccagttccgtaggtaacttaccgaccgtttaccgaacccgtacgggcctaaccctatcgtacgtaacgtcgttaggggtacgacccgaaccgacccgggtaccccggaaccgacgggtctttaggaacggnggtaaaccgtcgggaactaacgtaccgtaaaacccgttagttaacggtagggtaacgggtaacctaacggtaaccccggttaacgaccggaaaccgtaaaggggtaaccgtttaacccggaaacccgggggttagaaaacggtttccgggtacccggtaaccgaaaccggggttcccggtaaacccccggggaaccggttaccccgaaccggtaacccggaccgaaccggtaacccgtaacgttaccggaacttacgggtacggtacggtttaccgaaggtacggacggttaccgaaggttaacgaacggtacgtgtaacccgggtaagggtcccgttacccggtttagtttacggtaccgtacgggttaccggaacggggttaaggaccgggtaactaaccgggtacaacccggttaaccggttcggttaacccgtttaccggtttaccggtaccgttagggttaacccgggg

SEQ ID NO: 191270 - DNA, 1076 bp, Homo sapiens
  misc_feature: GYAE6OF02HTO09.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtacgctccgaggtgcctccaccttcccgagggtgaccgtaacgttgggtcgcgtacggttcgtggggaccttggtaaaggtacggaaaggtaaaccggtcccgggttacggggggcccttacggtaagggttacggttaaacgggtttttccccgtaggaaccggaacggggtacctaacgttaccggttaacggggtaaccgttaaaccccgttacccgttttaacccgaaccccggtaaccgggacccctaacccgttaataaccggttccgggaacccgttaaccgggttccgggggtacggtaccccggtaaccccggggaccccgggggaacccccccgggtaaacgggttaaaccggggtaaccggttttaggggtaacggggttaacggggtaacggtaacgggggttaaacccttaaaaccgttaaaccccgtaaaaacccggtttaaagggttaacgggttaacggggttaaaccggtaaaaccggtaaccgtaaacccggttaacccggtaaccgaaaacgggttaaaccgggttaacccgttaaccgggtaaccggggaaccggttaaccggggtaaccggtcccggtaaccgtaccgggtaaccccggggaaccccgggtaacccgtaacccggttaacccggaacggaacccgtaaccgtaaccgtaaccgttaccgtaacggtacgggttagggtaacgtacggtaacggacggtcggtacggtaggaacgttaacgtacggtacggaaccggttaaccgggttaccggtttcgttttaccgtttacggtcggacggtaacggaagggtaacggggtaacggtaacgtaacggtaaaccggttaccgttacggttacggtttaccccgttaccggttttaacgacccgggtttaacgggtaacccgggg

SEQ ID NO: 191271 - DNA, 873 bp, Homo sapiens
  misc_feature: GYAE6OF02HH31L.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtggtgcagtcgtggggctggaagtggaagaacggccgtagggggccctacgaggtaggtaacgggttttcctaggtacgaaggcctagtccgtagggtataacctacccttccgtaaccgacgggacccaaacccgacgttaacgttcggacgtaacggttcggggttacggaccggaaacccggacccggggacccccccgggaacggaaaccgggtacggtttacgggaggttacggggtaaggtacggggtaaaccttaaacgttaaccccgtaaaaccccgttaaaggtttacggggtaacggttaaacgggaaacgtaacgtaacccgttaaccgggaaccttaacgaacgggtaaacggttacccgggaacgggacaacggtacggtaccggtacgtacgtacccgggaacccgggaaccgtaaccccggaccggtaaccgaaccgaccgtaaccgtaacggttaccaacgttaacggtaggtacggttcgggacgcggaggtcgacgtagtaattacggtacggaaccggtaccgtacccggttaccgtttccgtttacgtacggtaccgtacgggtaagggaaggtaagggtaacggtaacccggaaagttaacccgttacccgtttaacgttacccggttttccccgttttaagtacccgggttaccggttaaccggggg

SEQ ID NO: 191272 - DNA, 673 bp, Homo sapiens
  misc_feature: GYAE6OF02G6IX2.42.42.D09.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
tcagtgacgtatgtcacgaccggtgctcgattttagacacatacgcgagggaaagggggcatcgatccaacaaccacatcccttctctacagaagcctctgagaggaaagtcttcaccatggactggacctggtgggtcttctgcttcctggctgtagctccaggtgctcactcccaggtgcaactggtgcagtctggggctgagtgaagagccgtggggcctnagtgaaggtttccngcaaggcatctaggatacaccttcaccaggccaccgatatgcacgtgggtcgccgacgaccggcccccgganaacggacgttacgaggtcggatggggacttaactaccgaaccttaagtacggtaggtacggacaggacacgacaacgacgtacgttccgacgggacaggtacgtacgaccataccgggacccgggaacgtacccgtcccgaacggagacccacgtacgtcctaacgagtgggtacgttagacgtacgagggtactggaagtagtactagggaacccgaaccgtccgggtacccgtttagttttacgtccggaccggtacggtaacggaagggaacgggtacgtaaccggaacggttaaaccgttccggttacgggtttcccctttacccggttttacggtaccgttacccgggtacccggggg

SEQ ID NO: 191273 - DNA, 786 bp, Homo sapiens
  misc_feature: GYAE6OF02GGE77.42.42.D09.1.454.CMB.1.raw
  modified_base (169)..(169): a, c, t, g, unknown or other
  misc_feature (169)..(169): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
  modified_base (350)..(350): a, c, t, g, unknown or other
  misc_feature (350)..(350): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctcaggtgctacnctcccgaggtgcaacgtggtgcagtcgngggctgaagtgaagacgcgtgggccngaggtgaacggtttcctgacgaaggctagtcgtagactactaccctacaccgaggtaccacatancgcgtacgtgggtcgacgacccgaccgggccccggaagaacggttactaggtacgggtaggnggttagggaaccttaacgtaaccctaaccgtaggtacggtaaggtacggaacacgtacggtaccgacgtaacgtaacgtacggtacgagggacctaggacgttccacggtacgaccgggaacccggacgtacccgtaccggtaccgacgaccgtacgtactacccgtaacgaacggttcggtaacggtttaggaacggtaccgcgggttacgtacgacgttaacggtagttaaccgggaacccggaaaccggttcccgggtttaaaccttttcccgggttttaaagcccgggtacggaaccgggtttagggtaaaacgggggtaagggtaaaccggttaaccggtaaacgggtaaaccccgtttccggttaccggggttttaacccctttacccgggtttaccgttaaaccgggtttaccggggtaaccccggggg

SEQ ID NO: 191274 - DNA, 747 bp, Homo sapiens
  misc_feature: GYAE6OF02FM708.42.42.D09.1.454.CMB.1.raw
  modified_base (139)..(139): a, c, t, g, unknown or other
  misc_feature (139)..(139): n is a, c, g, or t
  modified_base (147)..(147): a, c, t, g, unknown or other
  misc_feature (147)..(147): n is a, c, g, or t
  modified_base (154)..(154): a, c, t, g, unknown or other
  misc_feature (154)..(154): n is a, c, g, or t
  modified_base (162)..(162): a, c, t, g, unknown or other
  misc_feature (162)..(162): n is a, c, g, or t
  modified_base (244)..(244): a, c, t, g, unknown or other
  misc_feature (244)..(244): n is a, c, g, or t
  modified_base (433)..(433): a, c, t, g, unknown or other
  misc_feature (433)..(433): n is a, c, g, or t
  modified_base (568)..(568): a, c, t, g, unknown or other
  misc_feature (568)..(568): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtggtcttntgcttccngctgtanctccagtnctcactccaggtgcaacgtggtgcgagtcgtggggctaggagtgaacgtaagccgtgggcctgacgtggtaaacggtttccngtaccgaggactacgttcgacggtactacctccttaccgacgtacggactacccgtatacgttcgctacggtcggtcgccggaacgccccggtaccccggaagtaaaccggtacgtttcgggagtacggtaggacggtaacgtaacgtacctaaaccgttatacgggtacggtagacgacgacgtacgngaaccgaagaacggtacccagggtaccgagtccggtccgactacggtacccggggaacccggacgaaccccggttacgaccggtaccgcgggaaaccgtaccgtttacgacggtaacgttcggggtacgttacgngggtaacctcgggcgttaaggagttaacgacgttacgagaacccggtacgttccgtttacgtttagacgtacggaacggtacgggaaggtaacgggttacctaaaggtaacgtttaacccgccggttttaaccggtttcctttacccggttttaccgccggtttacgggtaacccgggg

SEQ ID NO: 191275 - DNA, 734 bp, Homo sapiens
  misc_feature: GYAE6OF02G068V.42.42.D09.1.454.CMB.1.raw
  modified_base (243)..(243): a, c, t, g, unknown or other
  misc_feature (243)..(243): n is a, c, g, or t
tcagtgacgtatgtcacgaccggtgctcgatttagacacatacgcagggaaaggggcatcatccaacaaccacatcccttctcctacagaaagcctctgagaggaaagttcttcaccatggactggacctggtggtcttctgcttcctggctgtagctccaggtgctcactcccgaggtgctaactggtgcagtcgtgggctgaagtgaagaagccgtgggcctcgaggtgtaacggtttccngacgacggcagtcgtggactacaccttcaccgaggccaacctatagtgacacgttgggtagaccgtacgaccggccccgaagaaggtacttggaggtggagtacgggaactaacctaccgtaaaccctaagttacggtaggtaaggaacagaacctacgaacctaacgaagtaaccgttaccggaggactacggacggtaccgacgtacgtaccgggacccgggaccaccggtcccgaacggacgtaccgaaaccgtcgtaacctaacggtacggtggtaacggtttggacgacggtacgggtacgttacggaagaccggtttaagaccggaacggtaacccgtacgggttcccgtttttaacgtttagtaccggccggaacggtaacgggtaaagggaaccggttacggtaaacgaaccggttaacccgttcccgggtttacggttcccgttttaccccggtttacgaccggttaccgggtaacccgggg

SEQ ID NO: 191276 - DNA, 748 bp, Homo sapiens
  misc_feature: GYAE6OF02F06X0.42.42.D09.1.454.CMB.1.raw
  modified_base (89)..(89): a, c, t, g, unknown or other
  misc_feature (89)..(89): n is a, c, g, or t
  modified_base (192)..(192): a, c, t, g, unknown or other
  misc_feature (192)..(192): n is a, c, g, or t
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
tcagtgacgtatgtcacgaccggtgctcgatttagacacatacgcagggaaagggggcatcatccaacaaccacatcccttctctacanaagcctctgagaggaaagttcttcaccatggactggacctggtgggtcttctgcttccgtggctgtagctccaggtgctcacctcccaggtgcaacgtggtgnagtcgtggggctggaagtgaagaacggccgtggggcctcgagtaggtacggtttccngacgaggtctatctggataccaccttcaccaggcaccatangcacgtggtgacgacgaccggcccccggaagaaggtccgtaggtagtcgggaagtcgggaaccttaacgtaaccgaaacccttaaaggtagttacgggtaaggaaccgagtaaccgtacgacacgaaggtaaacgttccgagggactaacggacgttaccggacctacggtaaccgggaaccccgggaaccgtacccggtaaccccgtaagaaccggacctaccggtaacgtaacccgttacgtaacgttacgggtagggtttaaccgacgtaccggtaaggcggttaagaacggttataacgggacggtaacggtaccgacccgggttacctttcggttttaactggaccgtagggaacgaacgggttaagggaaccggttaacgaaacggttacccggttccggttacgtttaccccgtttaccggtttacgtacccggttacggtaacccggggg

SEQ ID NO: 191277 - DNA, 727 bp, Homo sapiens
  misc_feature: GYAE6OF02JPCXR.42.42.D09.1.454.CMB.1.raw
  modified_base (175)..(175): a, c, t, g, unknown or other
  misc_feature (175)..(175): n is a, c, g, or t
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (508)..(508): a, c, t, g, unknown or other
  misc_feature (508)..(508): n is a, c, g, or t
  modified_base (556)..(556): a, c, t, g, unknown or other
  misc_feature (556)..(556): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttcgtgctttcctggtctggtacgcgtccaggtgctcncctcccgaggtcgctaacgtggtgcgtagtccgtgggctgaagtgaagacgccggtacgggtccgtntaggtgtaacggttttccgagtacgagtacgtatcgtagtactaccgtacctacgaccgcgaccaccgtaagtntaacgtcgacggtcggactaccgggaccgacccggtacccggaagtacggtacgtaggacggtcggagtacggtactacgtaacccgaaacgttaggtaggtacggtacgacacggtacagtacaacgagtaaccgtcgtagggacctacgacgccgcgtacgacccgacgggtacaccggacgacggaacncgtacctacgtactaacgtaggtacggttaacggagccgaccgtaggngtaacggttagtaccgtaacggtccgtaaacgccgggttacccggttaccgttttacgtttcggcggttaaccgagggtaacggtgggaaaaccggttcggaaacggttaccaaccggtttccggttaccggtccgtttacccggtttaggtacccggcggtaacccgggg

SEQ ID NO: 191278 - DNA, 857 bp, Homo sapiens
  misc_feature: GYAE6OF02IWCKO.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctccactcccgagtcgacaacgtggtgcagtcgtcggggctggaaggtagaaagaagccgtcggggcctacgaggtaggtaacggtttcctggacgaaggcagtcgtaggtaactacctacccttccaaccgacggaccaacctatactcgacgtacggttagggtccggacccgaccggacccgggacccccggaaaccgaaagggtaccgttaggtaacgggttgggtaacggtacgggtaaaccttaaccgtaaccccgtaaaacccgttaaggttacgggtaacgggttaacggaaccggaaacgtaacccgtaacgaccgaaacggtaaacgttaaaccggttaccggaacggggacgacgggtaaccgtaccggaccgtaccgttaaccggggaaaccccgggtaaccgtacccggtaacccgaaccggaccggaacccgtaacggtaaccgttacccgtaacgtaggttaccgggtaggtttaggaccgggacgtaggaccgtaggtaacgtaacgtcggtaacgtaaccggaacccgttaccgggttcccgtttttaacgtttacgtccggtacggaggtaacgggaaaggtaacgggtaacgtaaccgaaaccggttaacccgttccggttaccgggtttaccgtttacccggtttaagttaccccggttagggtacccgggg

SEQ ID NO: 191279 - DNA, 641 bp, Homo sapiens
  misc_feature: GYAE6OF02JCZA9.42.42.D09.1.454.CMB.1.raw
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcctcctggctgtagctccaggtgctcactcccaggtgcaactggtgcagtctggggctgaagtgaagaagcctggggcctcagtgaaggttcctgcaaggcatctggatacaccttcaccaggcaccatatgctacgtgggtncgacgacggcccccggaanaacggtaccttggaggtaggacgtacgggaacttaataccaaacccttaagtaggtacggtaaggacagacctacgcaacgaagtaacgttaccgacgggcaaggacgtcgacagtacggaccggtacacgtaccgacgagacacgagtcaacgagtacggagttagagtacgaggtactaggaacgtacgtagtacggaacgaccgtaccggtaccgttacgttttacgtaccggtacgacggtaagggaacggtaacgggtacgtaaccgtaacgtaaacccgttcgtacggttacccgttacccgttttacggaccggtttacggtaccggggg

SEQ ID NO: 191280 - DNA, 685 bp, Homo sapiens
  misc_feature: GYAE6OF02FQXDR.42.42.D09.1.454.CMB.1.raw
  modified_base (313)..(313): a, c, t, g, unknown or other
  misc_feature (313)..(313): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccaggtgcaactggtgcagtcgtgggctgaagtgaagaagccgtggggcctcgagtggtaacggtttccgtgcgaaggcatcgtgactacaccttcaccacggcaccatatcgcacgtggtcgcgacgaccggccccganacggtacgtggaggtggagtaggtactaactaccaacctaagtagtaggtacgacacgaacctacgactaacgaagtacgttaccgacgggacacggtacgtccgacgtaacgtccgggaaccccgggtacgaacccgtcccgaaccggacgaccgaccgtacgtacctaacgtacggttagggtaggttacggacggacggacggtcgtaggaagtagtcgacggtaccggaccgtaccgggttaccgtttacgttttacgtacggccggtaggtaacggtaaagggtaacgggtaacgtaacgtaacgttaaccgttccggttacgttcccgttttaccgtttacggtaccggttaccgggtaaccgggg

SEQ ID NO: 191281 - DNA, 755 bp, Homo sapiens
  misc_feature: GYAE6OF02JPR8Z.42.42.D09.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
tcagtgacgtatgtcacgaccggtgctcgatttagacacatacgcagggaaagggggcatcatccaacaaccacatcccttctctacagaagcctctgagaggaaagttcttcacatggactggacctggtgggtcttctgcttccgtggctgtagctccgaggtgctcactcccgaggtgcaacgtggtgcagtcgtgggctaggaagtagaagagcgtagggcctnagtgtacgttcngacgaagcagtcgngactacctacctaccacgtagaccacctatacgtcgactcggttaggcgaccggaccgaccgggtacccccggaagtaacggtacgtacggaggtaggacgtacgggtaacctaacgtaacccgtaacccgtaggttaaccggtaggtaaacggtacgaacgtaccgtaacggtaaacaacggtaacgttaaacgggtaccggacgggtaagtacgggacgtacccgggacgttaacgggacccggaacccccggtaaggacccgtaaccgaacgaacggtaccgaacgtacccggtaacgtacgtacggttacgggaacggtacgtacggacgtacggtcgtaggaacgttacgtaggaaccggtacgaacgtcccgggtttacttacgttttacgccgggacgttaacgggaagtaaccgggaagtaaccggtacgaaacggtacccgtagttacccggttaccttccggtttaaaccgtacggtaccgggtaaccggg

SEQ ID NO: 191282 - DNA, 733 bp, Homo sapiens
  misc_feature: GYAE6OF02JLKC4.42.42.D09.1.454.CMB.1.raw
  modified_base (455)..(455): a, c, t, g, unknown or other
  misc_feature (455)..(455): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggaccgtggtgggtcttctgcttcgtggactgtagctccgaggtgctcgtacctcccaggtcgctaacgtggtgcctaggtcgtcggggcttggaaaggtgaacggaacgtccggtgggacctcgtaagtcggtaacggtttcccaggcctaagggctacgtgtacggtaacttacaacccttcgacctacggccacctaagtagtcgtcgtacggtcgggcggaccgaaccggtcccggacccggaacgtaaggtcggtacgaggtcggaggttcgtaaactactaaccgtaacgtaggttaacggtggtaacgtagaccgtaccggtaanacccgtaaggaacggttactaaccggacggtacgtacgggtcgacgtacccgtaacggtccggacccgaacggtaccgaccggtaccggacactaacgtacgtacccaagttaccgtaggttacgtacgtcgacgaacggtcgacggtagtacgacgtcggaaccggtacgtaccggttcgtttacgttgtccgtcgtaggtaacgtggtaacgggattaaccggaagtccggttaccgtacgtttccgttacgttacgtaaccggttggtaaccggg

SEQ ID NO: 191283 - DNA, 816 bp, Homo sapiens
  misc_feature: GYAE6OF02JJIG6.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatgactggacctggtgggtcttctgcttcctggctgtagctccaggtgctcacctcccgaggtgacaacgtggtgcacgtcgtggggctgaagtagaagacgccgtcggggcctcgtacgtggtaacggtttcctggacgaaggcctatcgtaggactacgtacccttaccacctacggaccaccgtatacgtcgacacggtgggtacggccgaccggaccgggccccccgggaaccgaacgggtaaccgttcggtacgggttgggacggttaggggtaacctaaacgttaacccgtaaacccgtaacggttaaggtacgggtacggaacgtaacggtaaccttaacgaccgtaacgtaaccggtaacggttacccgggacgggtacgaacggtacggtccgacccggtacggtacccgggaaccccgggtaaccgtaccccggtacccgacggtaacgaccgtacgacggttacccgacttacgggtacgggttaaggttcggacggtacggcggtcgtacgtaacgtagtaacgttcgggaaccgaccgggtaaccgttaccgttttacgttttacgtcgtacgggtacggacgggtaaacggggtaaggtaacggtaaaccgtaacggtaaccgttaccggttaccggtttaccgtttccccggtttaacggttaccgttacccggggttaccgggg

SEQ ID NO: 191284 - DNA, 768 bp, Homo sapiens
  misc_feature: GYAE6OF02IFT1G.42.42.D09.1.454.CMB.1.raw
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (613)..(613): a, c, t, g, unknown or other
  misc_feature (613)..(613): n is a, c, g, or t
tcagtgacgtatgtcacgaccggtgctcgatttagacacatacgcagggaaagggggcatcatccaacaaccacatcccttctctacagaagcctctgagaggaaattcttcaccatggactggacctggtgggtcttctgcttcctggctgtagctccaggtcnctcactccaggtnactaacgtggtncgagtcgtggggactagaacgtagaacgaacgtccggtgggccctagaggttacggtaacggtttccagactaagggctaagttcgaggaattacccgtaccgttaacaaccgtaccggacctaaccgtaatacgtcggaactaccgggttaggtacgacccggaaccgacccggggacccccggtaaggaaacgggttacctttagacgggttagtacggtacgggtaacttaaacgtaccgtaaaccttaaaggtacgggttacggaacgggtaaccagtaaaccgtacgtacaacggaacgtaacggtcgaaggacgagtacgtacgacgtaaccacgggaacccgaccgtaaccgtcaacgtacgactaaccgacgttaactagtacggttagaacggttaccgggaagacgtaacggntaaggaaccgtagtaagacgaccgtaccggacgttacccgtttagtttacgacgtaggaccggtaaggaacggggttaacggaacgttaaccgaacggttaacccgttcgtaccggtttacttcccgttaacggtaccggtacgggtaaccgggg

SEQ ID NO: 191285 - DNA, 669 bp, Homo sapiens
  misc_feature: GYAE6OF02IVDLQ.42.42.D09.1.454.CMB.1.raw
  modified_base (180)..(180): a, c, t, g, unknown or other
  misc_feature (180)..(180): n is a, c, g, or t
  modified_base (306)..(306): a, c, t, g, unknown or other
  misc_feature (306)..(306): n is a, c, g, or t
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
  modified_base (592)..(592): a, c, t, g, unknown or other
  misc_feature (592)..(592): n is a, c, g, or t
tcagtgacgtatgtcacgaccggtgctcgatttagacacatacgcagggaaagggggcatcatccaacaaccacatcccttctctacagaagcctctggagaggaaagttcttcaccatggactgacctggtgggtcttctgcttcctggctgtagctccaggtgctacactcccaggtnacgaactggtgcagtcgtggggctggaagtgaaggtaacgccgtcgggggcctccgagtagtaacgggtttcctagcgaaggccatcgtgactaccgtacccttacacccgacggaccactagtancgtcacggtgggtaccgccggaccgaccggggccccggacgaacgggtacgttggaagttggagtacgggacttaaatcccgaaaccttagtacggtaggtaagacaggtaacctaggaccctaacgaacggttaacggtacggacgggtccgaagtacggtaccgacgaccgtaccgggaaccccggaccgaacgtccgaccgaccgacgacgtcggactacagtacgggnttcgagnaggcgtaagatagtagacgacgaccgtcgtcgtttacgttcgtacgnggaggaaggaagggaagggttacgaataacgggtaacttacggttcgttaccgttcttacgtaccggtacggccggg

SEQ ID NO: 191286 - DNA, 804 bp, Homo sapiens
  misc_feature: GYAE6OF02JUVD1.42.42.D09.1.454.CMB.1.raw
  modified_base (185)..(185): a, c, t, g, unknown or other
  misc_feature (185)..(185): n is a, c, g, or t
  modified_base (238)..(238): a, c, t, g, unknown or other
  misc_feature (238)..(238): n is a, c, g, or t
tcagtgacgtatgtcacgaccggtgctcgatttagacacatacgcagggaagggggcatcaatccaacaaccacatcccttctctacagaagcctctgagaggaaagttcttcaccatggactggacctggtggtcttctgcttcctggctgtagctccaggtgctcactccaggtgcaatggtncagtctggggctgaagtgaagagcctggggcctcagtggtaacggttttcccngcaaacggcaattccgtagggaacttaccgaaccctttcaaaccccgagggaccaacccgtattacgttcggcctaaccgtgggggtacgaccggaccgaacggggtcccccccggaacaaaggtaccgtttggaacggtggaacgtacggggtaactaacgtaccgtaaaccctaagttaacgtagggtacggtaacgacggaaccttacgacaacgagtaaacgtttccgaagggtaccaaggacgttacgcccgtaagtacggaaccccgggtacctaaccggtcccgagtaaccgacgtaaccgtacgtactaaaccgtgttccgggaaagtttcggaacgacggtaacggtacgttaggaaccgtagtacttacgggaacccgttagtaaacccggggtccgtttttaccgttttttaagcccggttacgggaacccggtttaaagggggacggttaaaacggggttacgtaaaaccggaacggtttaaaccgtttacgggtaacccggttttccggttacccgttttttaacccgggaccgttaacgggtttccccgggg

SEQ ID NO: 191287 - DNA, 737 bp, Homo sapiens
  misc_feature: GYAE6OF02F7A27.42.42.D09.1.454.CMB.1.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcactcccaggtgcaacgtgtgcagtctggggctgaagtgaagagcctgggcctnagtgaaggtttccngacaggcatctgactcaccttnaccaggccacatatgcacgtgggtcgacgacgaccggaccccggacgtaacggtaccgttggacggtggactaggggtaactaaacgtccgtaaaacccttaagtaacggttggtaacggaacgacggtaaccgtaaccggactaacggtaacgtaaaccgttacccgaaggggtaccaaggtaccgtacccggacctaacggtacccggaaccccggggtaacctaccggtaccccgaacggtacgacgtaacccgacggttacgtaaccgttacggtacgggttaacgttcggaacgttacgacgggactggtaacgtagtacgtacggaacgtaccgaccggttcccgtttacgttttacgtcgtccggaacggtacgggacgggtaaacgggtacgttaaacgaacggttaaccgttccgtttaccgggttcccgttttacccgttaccggttaccgttaccgggttaacccgggg

SEQ ID NO: 191288 - DNA, 966 bp, Homo sapiens
  misc_feature: GYAE6OF02H0UET.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccgaggtgctcacctcccgaggtgcaacgtggtgcgtacggttcggtcggggactaggaaggtaggaagaacggtccggtcgggggtacctacggtaggttacggttaaccggttttccgtaggaccgaagggctagttacgtacggtaactacccttacccgttacccgaaccgacggaccctaacctaattacggacgtacccggtacggtcggggtacgacccggtaaccccgggaccccggggtaacccccgggtaagtaaccgggtaccgttaagggacggttagggtaaccggtacggggtaaacttaacccgtaaccgtaaacccgttaagggtacggttaacggtaaccgggtaacgtacggtaaccgtacgaaccgtaacggtaacgtaacggttaccggacgggtacgacggaccggtccgaccgtacggtaaccccgggacccgggaacccgtaaccgggtcccgaaccgggacgtacccgtaaccggttacggtaaccgtaacggttaacgggttcgggttaaacggttacgggaccgtaacgggtagggttaacccgtagggtaaaccgtagttaaccggtaccggtaaccgggaacccgggtttaacccgggttttaccccggtttttaaggttttaaccgggtaccgggttacccgaaggggtaaaccgggttaaccgggtaaacggggttaaccgtaacggttaaacccggttacccgtttacccgggttacccggttttacccggtttacccggtttaaccgggttaccggtacccggggttaaccggggg

SEQ ID NO: 191289 - DNA, 879 bp, Homo sapiens
  misc_feature: GYAE6OF02GSK8L.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtggtcttctgcttcctggctgtagctccaggtgctcactccaggtgacaactggtgcagtcgtgggctgaagtagaagaacgccggtgggcctacgagtaggtaacggttttccgacgacgaacggcacgtccgtaggtaacctacctaccgttaccaacccgaggacctaaccgtaattaacgtcgacccgtacgggttacgggtcgacccgggtaaccggacccgggacccccgaaaggtaacgggtacgtttacggtagggttagggaacggtacggggtaaaccttaaacgtaaccccgttaaaacccgttaaaggttaacgggttacgggtaaacggtaaccgtaacggtaaccgtaaccggaaccgaacgtaaacggtaacggttaccgacggggacctaacgggaccgttaccggaccgtaacggtacccgggtaaaccccgggaccgtaacccggtacccgaacggtaaccgaccctaaaggttaaccgtaccctaacggttaacggtcgggtaacgtttacggaacgtcggaacgggtaccggtagaagtaacgtacggtacggaaccggttacccggttaaccgggttaccttttaccgttttcggtaccgggtccggtaacgggtaaggaaccgggtaaagggttaacctaaaccggtaacgttaaccccggttcgggtttacccgttttacccgtttaacccggtttacggttacggttaccgggtaacccggggg

SEQ ID NO: 191290 - DNA, 839 bp, Homo sapiens
  misc_feature: GYAE6OF02IVX0O.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctagtagctccaggtgcctcacctcccgaggtcgactaacgtggtgctaggtccgtggggctaggaagtagaaagacgtccggtggggcctcgaggttaggtaacggtttccctaggaccgaagggtctagttcggtacggtaacttacctacccttacccgaccgacgggaccctaaccgtaagttaactacggtacccgtaacgggttcggggttaccggtacccgtaaccgggaacccccgggtacccccggggtaaacgtaaaacgggtaccgttttacggggacggtttacggggtaacggttacggggttaaccttaaaccgtaacccgtaaaacccgttaaggttaacggtaagggtaccggtaacgtaaccgtaacccgtacggaccctaaacggtaaggtaaaccggttccggaacgggtacggtacggaccggttccgacgtaacggtacccgggtaacccggaaccgtacccgtccgaacggtcgaccgtacgacgtaccgtaagaggttacggacgttaggacgtaccgagggtacctagtaacgtagtaacgtacggaccgtaacgtccgtacgtttagtttacgtgaccggtacgagggtaacggaacgggtacaacgtaacgtaccgttacggttaccgttaccgttccttacggttaccgcgggttaaccggg

SEQ ID NO: 191291 - DNA, 630 bp, Homo sapiens
  misc_feature: GYAE6OF02F74MT.42.42.D09.1.454.CMB.1.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
tcagtgacgtatgtcacgaccggtgctcgatttagacacatacgcagggaaaggggcatcatccaacaaccacgatcccttctctacagaagccgtctgagaggaaagttcttcaccatggactgacctggtggtcttctgcttcctggctgtagctccaggtgctcactcccaggtgcgaactggtgcagtcgtgggctgagtgaagagcctgggactcgagtggtaacgtttccngacgaggntagtctggatactaccttaccgaccagccactatagtcgccagtaggtcgaccgaccggacggcccccggaagacgtacgttggacggtgagtaggactaanacctaacgtagtagngtagacagacgtacncganacgacgttacnggacctgacgtacgcaacgtcggaacccgggtctacccggaccgtaccgacgaccgtaacgtaccggtaccgttaacgtagtacggttaggtagacgtcgaggtcggtagaacgtatacgtaacggaccggacgtccgttcgttacttttagtccgacgtaggacggtaaggtaccgggtataacgacggttaactccggtttaggtcccgttttcgtacggaccttacgggtacggg

SEQ ID NO: 191292 - DNA, 611 bp, Homo sapiens
  misc_feature: GYAE6OF02F88UE.42.42.D09.1.454.CMB.1.raw
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
  modified_base (488)..(488): a, c, t, g, unknown or other
  misc_feature (488)..(488): n is a, c, g, or t
tcagtgacgtatgtcacgaccggtgctcgatttagacacatacgcagggaaagggggcatcatccaacaaccacatcccttctctacagaagcctctgagaggaaagttcttcaccatggactggacctggtgggtcttctgcttcctggctgtagctccaggtgctcacctcccgaggtgacaacgtggtgcagtcgtggggctaggaaggtagaaggaagccgtggggcctagacgtaggtaacggtttcctgacgaaggctatcgtagtactacaccttcgaccaggaccacagtatcgacgtacgtggtacgacgacgaccggaccccggagaacggtacgtggagtggagtacgggactaataccgaaacgtagtaggtaggacgagagacgtacgacacgagtacgtcgaggacaggctacgacagtcggaccggacacgacacganacgacactactanagtagtgtagagacgtacggtnaggagtatagtacgacgtacgtaccgttacgttgttacgtggacgtacgaaggaacgtaaggggtacaacggtaacgtaccttcgtacggttcccttaccgtttacgaccgtggtaaccgggg

SEQ ID NO: 191293 - DNA, 788 bp, Homo sapiens
  misc_feature: GYAE6OF02JHMOK.42.42.D09.1.454.CMB.1.raw
tcagtgacgtatgtcacgaccggtgctcgatttagacacatacgcagggaaagggggcatcatccaacaaccacatcccttctctacagaagcctctgagaggaaagttcttcacatggactggacctggtgggtcttctgtcttcgtgtctgtacgctcgaggtcgcctcgacctccgaggtgacaacgtggcgacgaggttccgtagggcttaggaaacgtagaaacggtaacggcccgggtagggtccccttaggaaggttcgtaaccgggtttcacggacgacggactagttcgtacggactaccgtaccctttaccgaccgaaggacccaaaccgtagttacgcgacttacgggtgggtaccgaccggaacccggaccccgggtaaccccggaacgaacggtctaggtaccggtaggagggtaccggtaactaaacctcctaaaccgtaggtacggtagtaacggactacgagaccgcaaaacgcgtaacgttccgaaggccgtagccgtacgaccaggtaccgggtaacccgtagaacccggtaccgacggtaacaccgaacgtactacggtacgtacgtttagggaggttagacggaccgaggttaccaaggtcgagtaccgtggtaaccggaacctaccggttacctttaggttaccgttaccggacggtaccggtaaggaacggggtaactaaccggtaaccgaaaccgttaacccgtaccggtttaccggtttaccgttaacccggtttaacgttaccggttaccgggggaacccggg

SEQ ID NO: 191294 - DNA, 765 bp, Homo sapiens
  misc_feature: GYAE6OF02JM8O1.42.42.D09.1.454.CMB.1.raw
  modified_base (166)..(166): a, c, t, g, unknown or other
  misc_feature (166)..(166): n is a, c, g, or t
  modified_base (187)..(187): a, c, t, g, unknown or other
  misc_feature (187)..(187): n is a, c, g, or t
  modified_base (568)..(568): a, c, t, g, unknown or other
  misc_feature (568)..(568): n is a, c, g, or t
tcagtgacgtatgtcacgaccggtgctcgatttagacacatacgcagggaaagggggcatcatccaacaaccacatcccttctctacagaagcctctgagaggaagttctcaccatggactcggacctgggtgggtcttcgtgcttcgtggctgtagctcgaggtnctcactccagtgcacgtggtntgagtcgtagggctaggaacgtgaaacggtacgtcccgtggggaccttacggacggttaggtaaacgttccgtaggacgtaacgggtctacgtacggttacggtacttaaccgtaccttaccgaaccgacggtacccaaactacgttacgcgacctacggttacgggaccgaaccgaccggtacccgggacccgtaacgtaaggtaccgtaacggtacgggtaaggtaccggaaccgggttaaacttaacgtaccccgtaaaaaccgttaagtccggtaaggtaaccgtaactaggtaaccctaacgtacgaaccgtaaggtaaccgtcggaaacggactagggaccgtaacgacgtacgtaccggaccggacgttaaccncggtaacgacgacgacacgttacaacgtgtacggacgtcgacgacgtacgcgtaaggatacgttagacgtaaccggtagtaccgggttacttaccgttagtacggacggtacggaagtaacggggtacgtaccggtaaaccgttacggtaaccgtccgttaccggttcctaacggtttccgtaacgcgggtaaccgg

SEQ ID NO: 191295 - DNA, 486 bp, Homo sapiens
  misc_feature: GYAE6OF01DZI9B.47.70.G04.1.454.CMB.1.raw
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcgctgcagcngagattcngcaacttatactgtctccagtatgatgcttacctcggactttcggccaagggacccaagggtgaaatcaaacgaactgtagctagnaccntctcg

SEQ ID NO: 191296 - DNA, 560 bp, Homo sapiens
  misc_feature: GYAE6OF01AO2LL.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtccatcaaggttcagcggcagtaggtctgggacagagttcactctcactatcagcgctgcagcctagaagacttctgctaaactttattacttgtcctaccaagttactgacttgcctttaacccgtcggtacctttcgggacccgtaaaggggtacccgtaaagggttacgggaaaacgttaccgaaaaccggtaacgttggtacggacttacggcctaaccgacttcgttcggttaccc

SEQ ID NO: 191297 - DNA, 492 bp, Homo sapiens
  misc_feature: GYAE6OF01A6KSK.47.70.G04.1.454.CMB.1.raw
tcagagctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaactgaagattttgcaacttactactgtcaacagagttacggtacccgtactacttttcggcctaggggaccaaacgtggaacatcaaacgactgtgactgcacatctgtc

SEQ ID NO: 191298 - DNA, 585 bp, Homo sapiens
  misc_feature: GYAE6OF01EE3TP.47.70.G04.1.454.CMB.1.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
tcagagctcacgtacacgaccggtgctcgatttagtgtagtgtgaaggggaaagggggagtcgagtcctcacgtcgaggtaccaacgacgcactggtacgatgagggtccccgctcaggctcctcgggggctcctgcctactctaggcgtccgaggtgccgtagtattgtgactatccgagatagacccagtcgtccatcctccgtgtctgcgatctggtagagcgganagtcaccatcacgttgccggcaacgtcagagcattaacagcgtattaatggtatctacgagaaccaggaacncccctaacgtcgtgagtcgtagtgctgccatccagtttgctagtagtcgggtacctatctagtcagtgcagtgatcgtggacagtatttcactctcaccatcagcacggtactcgactaacctgaagtactttagactaacttactactgtaccaacgacgtaacggttaccggtacccgttattacgtttacggaccgtaagggtaacccaaacgtagggaacgtacgttacgaaacggtactacggtaggacttcggacctaccgtagtccgtggttacccg

SEQ ID NO: 191299 - DNA, 492 bp, Homo sapiens
  misc_feature: GYAE6OF01BLXIM.47.70.G04.1.454.CMB.1.raw
  modified_base (392)..(392): a, c, t, g, unknown or other
  misc_feature (392)..(392): n is a, c, g, or t
  modified_base (485)..(485): a, c, t, g, unknown or other
  misc_feature (485)..(485): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagtnttttgactaacttactactgtcaacagagttacgtacccgtactactttggccaggggaccaaactggacatacaaacgactgtgctgccacntctgtcc

SEQ ID NO: 191300 - DNA, 498 bp, Homo sapiens
  misc_feature: GYAE6OF01BBEOY.47.70.G04.1.454.CMB.1.raw
  modified_base (492)..(492): a, c, t, g, unknown or other
  misc_feature (492)..(492): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaagcccctaacctcctgatctatgctgcatccagtttgcatagtgggtccatctaggttcagtgcagtgatcgtgggacagatttcactctcaccatcagcagtctgcaactgaagtatttgactaacttactactgtacaactagtagttaccggtacccgttactaccgttttggcctaggggaccaaacgtgaacatacaaacgtactgtggctgcacntctgtc

SEQ ID NO: 191301 - DNA, 607 bp, Homo sapiens
  misc_feature: GYAE6OF01A3AHU.47.70.G04.1.454.CMB.1.raw
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggnaagtcagagcaattaacagcgtaattttaaaattggtaatacaaccaagaaaaccgagggaaacncccctaacctcctagactctatgctgcatcctagtttgactagtaggtcgggtccatcgtagttcagtgctagtggatcgtaggactagtatttcactctacacatcagctagtctcgacctaactagtaacgttattttacgacttaaactttactacttacgtacaaacgtacggtaacgtttaacccggttaacccgttacgttacgtttacggacccgtaacggggaaccctaaacgtcgggtaaactaacgttaaccgaaaacggtaacgttggtacggaccctacggaccctaacctacgttccgttagttaccc

SEQ ID NO: 191302 - DNA, 549 bp, Homo sapiens
  misc_feature: GYAE6OF01AOQL0.47.70.G04.1.454.CMB.1.raw
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
tcagagctcacgtacacgaccggtgctcgatttagtgtagtgtgaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaacncccctaagctcctgatctacgatgcatccaatttcggaaacnggggtcccatcgaaggttcagtggaagtggatcgtgggacagtattttacttcactatcagcagcctgcagcctagaagatattgacaacattattaactgtacaactagttaatacaattaactcccttacccctactttcccggcccttagggaccctaaaagtcggaaattacgtacaaaaccggtattaggtaggacctacggacctaaccgtattccgtagttaccc

SEQ ID NO: 191303 - DNA, 517 bp, Homo sapiens
  misc_feature: GYAE6OF01BVZW8.47.70.G04.1.454.CMB.1.raw
  modified_base (511)..(511): a, c, t, g, unknown or other
  misc_feature (511)..(511): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaacagcgtaatttaaatggtatcaaccaagaaaccaggaaacgcccctaacctcctgatctatgctgcatcctagtttgcataggtcgggtcccatctaggttcagtggcagtggatcgtgggacagtatttcacttctcactatcagcagcctgcagcctagaagtatttagaactttattattgtacaatagtaacgttaccgtacccgtactacgtttcggaccgtaagggacctaaacgtggaacatacaaacgactagtggctcgacaccntctgtc

SEQ ID NO: 191304 - DNA, 570 bp, Homo sapiens
  misc_feature: GYAE6OF01C9PTW.47.70.G04.1.454.CMB.1.raw
  modified_base (278)..(278): a, c, t, g, unknown or other
  misc_feature (278)..(278): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattaacagcgtaatttaaattggtatcaacagaaaccaaggaaacncccctaacctcctagatctatgctgcatcctagtttgctagtaggtcgggtaccctattcgttaggttcaggttggctaggtggatcgtagggactagtatttcactactccacatcagcagtctagccaactagtaagttatttgaccttaacttactatcgtaacaactaaggtacgtttacccggtaccccgttacttaccgtttcggacccgaaggggtaacccaaacgttcggaactaactaaccgaaacggtactaggtacggactcgaccacctatctcgttacc

SEQ ID NO: 191305 - DNA, 515 bp, Homo sapiens
  misc_feature: GYAE6OF01ATTSV.47.70.G04.1.454.CMB.1.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagagctcacgtacacgaccggtgctcgatttagtgtagtgtgaagggaaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagccaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggctgcagcctgaagnttcngcaattatactgtctcagtatgatgccttaccctcggtacctttcggcctaagggcccgaaagggtaggaaacttacaaacggtaactaggtggacttacgccaacctatccgtgttacc

SEQ ID NO: 191306 - DNA, 518 bp, Homo sapiens
  misc_feature: GYAE6OF01CQCSI.47.70.G04.1.454.CMB.1.raw
  modified_base (389)..(389): a, c, t, g, unknown or other
  misc_feature (389)..(389): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaagccctaagcgcctgatctatggtgcatacactttgcaaagtgggtccatcaagttcagcggcagtaggtctgggtacagagttcactctcactatcagtcggctgcagcctgaagtnttctgacaactttataactgtctaccagttactgtatcgcttaccctcgtactttcggacctaaacgggacctaaagggtacggaaatacgaaaacgacgtgtcggacgttgacctacagttcgttacg

SEQ ID NO: 191307 - DNA, 559 bp, Homo sapiens
  misc_feature: GYAE6OF01CH73M.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcagggcgttgcaaatgctttggcctggtttcagcagacaccgagggaaggcccctaagcgcctgatctatggtgcatacactttgacaaagtcgggtccatcaaggttcagcggcagtaggtcgtgggacaggagttcactctcactatcagcgctgcagcctagaagtattctgactaacttattactagtaactaaaatataaactagtacgccccgtctactacgtttccggacgggtaacgggaaccgtaagggtacggaaggtaacgtaccgtaaaaaccggtaacgttacgggtacggtaccgtagacccgtaacccgtagttacccg

SEQ ID NO: 191308 - DNA, 537 bp, Homo sapiens
  misc_feature: GYAE6OF01C1RFV.47.70.G04.1.454.CMB.1.raw
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (495)..(495): a, c, t, g, unknown or other
  misc_feature (495)..(495): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccggaggtgccaggtgtgacatccagatgacccagtctccatcctccctgtctgcatctgtaggagacagagtcaccatcacttggccgggcgagtcgagggcgttgacaaatgctttggctggtttcagcagacacgagggaagcccctaagcgcctgatctatggngcatactactttgacaaagtcgggtcccagtacaaaggttcaagcggcaggtaggtcgtacgggganagtagttcaacgtctacactatcgagcgctgcacgctagaanttcngactaactttnttactnttctactagtntgactcgtcttacccgtcggtacgttcgaccgaacgggtactaagggtacgtaanaacgaaacgaagtgtacgtctacgactaaccgtatgtttccg

SEQ ID NO: 191309 - DNA, 488 bp, Homo sapiens
  misc_feature: GYAE6OF01BJ6UZ.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaacagggaaagcccctaacctcctgatctatgctgcatccagtttgcatagtgggtccatctaggttcagtgcagtgatcgtggacagatttcactctcaccatcagcagtctgcaactgaatatttgactaacttactactgtcaacagacgttaccgtacccgtactactttcggccgagggaccaaacgtgacatacaaacgactgtggctgacacatctgtc

SEQ ID NO: 191310 - DNA, 586 bp, Homo sapiens
  misc_feature: GYAE6OF01DG95X.47.70.G04.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagagctcacgtacacgaccggtgctcgatttagtgtagtgtgaaggggaaaggggggtaggtcaggtctcagtcgacggacacagcatggacatgacgggtccccgctcagctcctgggctcctgctactctggctccgaggtgccagatgtgacatccagatcgacccagtctccatcctccctgtctgcatcngtaggancagcgtcaccatcactggccggnaagtcagancaattaacngacgtatttaaagtgtatcacagaaaccaggaacnccctaacnctgatctatnctgcatctagttacgctaagtggtcgggtaccagttacgtaggttaccagttcggactaaggtggtactcgtgggaactagtactttccactctaccaccatcaagcattcagccaactagtaagttattcgtactaacttactacgtctaactaagtaacgtacggtttaccgtaacccgttacttaacgtttcggaccgtaacgggtacctaaacgttcggaactacctaacgtaaaccggtaaactggttacgacgttacgacctacctacttccggtcgttacc

SEQ ID NO: 191311 - DNA, 541 bp, Homo sapiens
  misc_feature: GYAE6OF01C0DPH.47.70.G04.1.454.CMB.1.raw
  modified_base (280)..(280): a, c, t, g, unknown or other
  misc_feature (280)..(280): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgtaatttaaattggtaatcaaccaagaaaccagggaaacncccctaacctcctgatctatcgctgcatcctagtttgctataggtgggtccctattcgtaggttcaggttggctagtggatcgtgggacagtactttcactctacacctatcagctagtctagcaactgaatatttgactaacttactactgtacaactagtacgttacgtacccgttactacgtttcggaccgtaacgggtaaccaaacgttgaactactacaaacgtaactggtacgctacgacacctatcttgttacc

SEQ ID NO: 191312 - DNA, 517 bp, Homo sapiens
  misc_feature: GYAE6OF01CY1ZS.47.70.G04.1.454.CMB.1.raw
  modified_base (221)..(221): a, c, t, g, unknown or other
  misc_feature (221)..(221): n is a, c, g, or t
  modified_base (509)..(509): a, c, t, g, unknown or other
  misc_feature (509)..(509): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctgctctggctctcaggtgccagatgtgacacccagatgacccagtctccatcctccctgtctgcatctgtaggagacagagtcaccatcacttgccgggnaagtcagagcattaacagcgatttaaatggtatcaacagaaaccaggaaacgcccctaacctcctgatctatgctgcatccagtttgactatagtcgggtccatcgtagtcagtgcagtggatcgtggacagatttcactctcacatcagcagtctgacaactgaagtattttgactaacttactactgtaccaatagtaacgttaccggtaccctactacgtttcggacctaacggggacctaaagtcggaacattacaaacgactggtacgtacttagaccacgtntcgttacg

SEQ ID NO: 191313 - DNA, 522 bp, Homo sapiens
  misc_feature: GYAE6OF01DLW09.47.70.G04.1.454.CMB.1.raw
tcagagctcacgtacacgaccggtgctcgatttagtgtagtgtgaagggaaagggggagtcagacccagtcaggacacaacatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgatagggtggttggcctggtatctgcaagaaaccagggaaagcccctagaacttcttaatctataaggcgtctaattttagaaactggggtacccatacaaggttcagcggcaggtgatctggggacagagttcactctacaccatcaacaccctgcacgcctgatgtattttgcgtacttattactgtaccaaagtataatagtgtaccttcctcggttccggccctgggacctaaagtggatgtacaaagactgtgctgcacatctgtcttacatcttcccgctac

SEQ ID NO: 191314 - DNA, 575 bp, Homo sapiens
  misc_feature: GYAE6OF01BE4FK.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtctccatccctccctgtctgcatctgtaggagacagagtcaccatcacttgccgggcgagtcgagggcttgacaaatgctttggcctggtttcagcagacaccgagggaacggcccctaagccgcctgatctatggtgcatactactttgactaaaggtcgggtcccagtacaaggttcagcggcaggtaggtcgtgggacagagttcacgtctacactatcagcggcctgcagcctagaagtattctagtactaacttacttactcgtactaccgtagttatagtacttcgtaccttacccgttcggtaccttttccgggacccgtaaagggtaacccgtaagggtacggtaaacgtacgtaaaaccgtacgttagtacgggtacttacggaccacctagtccgttacg

SEQ ID NO: 191315 - DNA, 517 bp, Homo sapiens
  misc_feature: GYAE6OF01A2B0I.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagccctgcagccctagaacgtatgttgacaactttattactagtacaaaaatataaacagtcgccccgctcgtacctttcggcggaagggacctaagggtcggaagactacgaaaacgaacgttcggtaggctgctaacccg

SEQ ID NO: 191316 - DNA, 528 bp, Homo sapiens
  misc_feature: GYAE6OF01ATC6P.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgtcgggcgagtcagggcattagctaatttttagccttggtttcagcaagaaaccagggaaacgcccctaagtccctgatctatgctgtcgtcctactttgactaaaggtcggggtcccagtccgtaaggtttacgcgggtcggtggatcgtgggactagtactttcacttctcacatcagcagcctgcagcctagaatatttgactaacttatactagaccaataatataatagtacttacctatcctaccgttcggaccaagggacacgacgtaggaagaacgtaaggactgcgctcgacacatctgtctacg

SEQ ID NO: 191317 - DNA, 550 bp, Homo sapiens
  misc_feature: GYAE6OF01C4ZN2.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccaggaacgcccctaactcctgatctatgctgcatccagtttgcatagtgggtccatctagtcagtggcagtggatcgtgggacagtatttcactctacaccatcagcagtctgccaacctgaagtattttgactaacttactactgtacaacagtacgttaccggtaacccgtactaccgttttggaccgtaacggggaaccctaaaacgtggaaccgtaactaccgaaaaccggtaacttggtaggtacctacggacctaacccgtaactccgttggttaccc

SEQ ID NO: 191318 - DNA, 536 bp, Homo sapiens
  misc_feature: GYAE6OF01DHOHP.47.70.G04.1.454.CMB.1.raw
  modified_base (274)..(274): a, c, t, g, unknown or other
  misc_feature (274)..(274): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaacncccctaacctcctgatctatgctgcatccagtttgcataggtgggtccatctaggttcagtgcagtggatcgtgggactagtatttcactctcaccatcagcagtctagacaacctgaatatttgactaacttactactgtacaacgtacgtacgttaccggtacccgttacttacgttttcggaccgtaacgggtaccaaacgtacggactaacgtacgaaacgtaacgtacgtggtacgtcgacacctactcgtcgttac

SEQ ID NO: 191319 - DNA, 597 bp, Homo sapiens
  misc_feature: GYAE6OF01EVCPT.47.70.G04.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (469)..(469): a, c, t, g, unknown or other
  misc_feature (469)..(469): n is a, c, g, or t
tcagagctcacgtacacgaccggtgctcgatttagtgtagtgtgaaggggaaaggggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcacatcacttggccggnaagtcagagcaattaacagacgtaatttaaattggtatcaaccaagaaaccaggaaacgcccctaacctcctagatctatgctgcactcctagtttgctagttacggtcggggtaccctagtccgttaggttcagtcggcaggtggatcgtgggacagtatttcactctacacctatcagcagtctcgacaacctgaactactttactagacttaactttacttactgttactaccgtagttagttntacttcgtacctttaccccgtcggttaccgtttcccgggaacgtaaacggggaaccgtaaagggttaacggaaaacgttaaccgaaaacggtaacgttcggtacggaccgttcgacctaccgttaacg

SEQ ID NO: 191320 - DNA, 629 bp, Homo sapiens
  misc_feature: GYAE6OF01BD275.47.70.G04.1.454.CMB.1.raw
  modified_base (273)..(273): a, c, t, g, unknown or other
  misc_feature (273)..(273): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgaatttaaatggtatcacagaaacaggaaacncccctaactcctgatctatgctgcatccagtttgcagtaggtcgggtccatcgtaggtcagtggcagtggatcgtgggactagtatttcgactctaccaccatcagctagtctagacctaacctgtaaagttatttttacgaaccttaaaccgtttaacctaaccgtttagtaacctaaacgtacggtaaccggttttaacccgggttaacccccgttaacgttaccggtttttacgggaccccgttaaacgggggtaacccctaaaacgtacgggaaacctacgttaacccaaaaacggtaccgttacggttacggtacgtacggtacccaaccctacttccgttcgtttacccg

SEQ ID NO: 191321 - DNA, 502 bp, Homo sapiens
  misc_feature: GYAE6OF01C9HRA.47.70.G04.1.454.CMB.1.raw
tcagagctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgattaaattggtatcaccagaaaccaggaaagcccctaacctcctgatctatgctgcatccagtttgcatagtgggtccatctaggttcagtgcagtggatctgggacagatttcactctcacatcagcagtctgcaacctgaagtattttgctaactttactacttgtacaacagtaacgttaccggtacccgttactacttttggaccgtaagggaccaaacgtggacaatacaaaacgctagtgactgacaccatctgtc

SEQ ID NO: 191322 - DNA, 602 bp, Homo sapiens
  misc_feature: GYAE6OF01A5DOF.47.70.G04.1.454.CMB.1.raw
  modified_base (246)..(246): a, c, t, g, unknown or other
  misc_feature (246)..(246): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgttactctggttcccaggttccagatgcgacatccagatgacccagtctccatcttctgtgtctgcttctgtaggagacagagtcaccatcacttgtcggcgagtcagggtattagcaactggttancctggtatcaacagaaaccagggaaagcccctaactcctcatctctactgcatccactttgcaaagtgggtcccatcaaggttcagcggcagtgatcgtggacagattcactctcactatcagcagcctgcagcctgaagtattttaggaactttattattcgtacaacgtagggttaacctagtttccccgacttccgtaacccgtttccggggaccgggtaacgggtaacccgtaaggggttacggaagtaacgtaaggaaaaaacggtacgttaggttacgggacttacggccctaacccgtaattacccgttaggtttacccttactaacttcccgtttcccccggtaaccc

SEQ ID NO: 191323 - DNA, 603 bp, Homo sapiens
  misc_feature: GYAE6OF01B80KU.47.70.G04.1.454.CMB.1.raw
  modified_base (276)..(276): a, c, t, g, unknown or other
  misc_feature (276)..(276): n is a, c, g, or t
  modified_base (565)..(565): a, c, t, g, unknown or other
  misc_feature (565)..(565): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattaacagcgtaatttaaatggtatcaaccagaaaccagggaaacncccctaactcctgatctatgctgcatccagtttgctagttacggtcgggtacccagttccgtagggtttcaaggttcgggctaaggttgggtactcgggtagggaacgtagttactttacgaccttcctaccaactactacgacgtacgtacgtctacgacctaacgtagtaagtttactttacgacttaacttactactctaacaagtacgtaaccggttacccgtaaccgttactttacgttcgaccggtaacggaacctaacgtacgaactagtaaccaaacggtnttacggacgtacgtacgactaactacttgttcgttacc

SEQ ID NO: 191324 - DNA, 522 bp, Homo sapiens
  misc_feature: GYAE6OF01BNCXJ.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgcccctaacctcctgatctatgctgcatccagtttgcatagtgggtcccatctagttcagtggcagtggatcgtgggacagtatttcactctcaccatcagcagtctgacaacctgaagtattttgactaacttactactgtacaacagtacgttaccggtaccccgttactacgttttacggccgtaggggaccaaaacgtggaacctaagtaccaaaacgtactaggtgctgcaccattctgttcc

SEQ ID NO: 191325 - DNA, 554 bp, Homo sapiens
  misc_feature: GYAE6OF01BYAEQ.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaacagcgtaattttaaaattggtaatccaaccaagaaaccagggaaacgccccctaacctcctgatctatgctgcatcctagtttgctagtaggtcgggtcccagtcgtaggttcaggtggcaggtggatcgtgggacagtactttcacttctcaccatcagcagtctgacaactagtaagtatttagactaacttactactgtacaactagtacgttaccgtacccgttactacgtttacggccgtaacgggaaccaaaccgtaggaacctagtacgaaacgtacgtgtacggctacgacaaccgtactcgtgttcc

SEQ ID NO: 191326 - DNA, 717 bp, Homo sapiens
  misc_feature: GYAE6OF01B2ZWX.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctgctctggctctcaggtgccagatgtgacacccagatgacccagtctccatccctccctgtctgcatctggtaggagacagagtccaccatcacttgccgaggcgagtcaggacattagacaactattaaattggtatcagcaagaaccaagggaacaccctaagcctcctagactctacgatcgactactacctaagtttacgggaaaccgtacggggtaccctaacgttacgaaagggtttcgaaggttaggaagttcggaagtcggtagggaactaagtttaactttttactttaccgtaacctacgtacgtataccgtacgtaccgtacgtacctaacggacccgtttaggaaacgtaagtttaacgttaacggtaaaacttaacgtttaaactttaacgtacggttaacctaaaccgtaacggttaacttaaccttaaactttaaaccttaccccgtttaaccccccgttacggtttaccccgggtacccggttaaaccgggtaaaccccgtaaaaggttacggtaactaacgtaaccgtaaaacgtaccgttagtacggtactacggtaccaaccgtagttccgttaccg

SEQ ID NO: 191327 - DNA, 527 bp, Homo sapiens
  misc_feature: GYAE6OF01AW5WY.47.70.G04.1.454.CMB.1.raw
  modified_base (421)..(421): a, c, t, g, unknown or other
  misc_feature (421)..(421): n is a, c, g, or t
  modified_base (516)..(516): a, c, t, g, unknown or other
  misc_feature (516)..(516): n is a, c, g, or t
tcagagctcacgtacacgaccggtgctcgatttagtgtagtgtgaagggaaaggggtctgggagaggagcccagcactagaagtcggcggtgtttccattcggtgatcagcactgaacacagaggattcaccatggagtttgggctgagctgggttttcctcgttgctcttttaagaggtgtccagtgtcaggtgcagctggtggagtctggggggaggcgtggtccagcctgggaagtccctgagactctcctgtgcaacgtctggattcaccttcagtacctacggcatgcactgggtccgccaggctccggggaaggggctgggagtgggtctcaagtattgatgagaatggtggaagcacattctacgtggactccgtggaagggccgttcaccatctccagagactaattcaggancacgctgtatctaacaaatgaacagtctagagagccgaggacacggaccgtatacttctagtgacgtaagtctatagcagtcgccccctacgccnctcgttcttcg

SEQ ID NO: 191328 - DNA, 572 bp, Homo sapiens
  misc_feature: GYAE6OF01D6HN7.47.70.G04.1.454.CMB.1.raw
  modified_base (270)..(270): a, c, t, g, unknown or other
  misc_feature (270)..(270): n is a, c, g, or t
  modified_base (560)..(560): a, c, t, g, unknown or other
  misc_feature (560)..(560): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctagtaggagacagagtcaccatcacttgccgggcaagtcagagcattaacagcgatttaatgtatcacagaaacaggaacncccctaacctctagatctatgctgcatcctagtttgactagtacggtcgggtacccagttcgtagttcgagtggctaggtgagtcgtagggacagtactttcacttctcacatcagcagtcagtacaaccgtgaattctttagacttaaactttctactgtaccaacgtagtaacgttaccggttaaccccttagttaccgtttacggaccgtaacgggtaaccaaaccgtaggaacgtactaacgaaaccggttaactcgggtacgtacccgtacgtaccgaacccttntcctgtttaccc

SEQ ID NO: 191329 - DNA, 568 bp, Homo sapiens
  misc_feature: GYAE6OF01DDUZE.47.70.G04.1.454.CMB.1.raw
  modified_base (277)..(277): a, c, t, g, unknown or other
  misc_feature (277)..(277): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
tcagagctcacgtacacgaccggtgctcgatttagtgtagtgtgaagggaaagggggagtcagtctcagtcaggacacagcatggacatgagggtccctgctcagctcctgggactcctgctgctctggctcccagataccagatgtgacatccagatgacccagtctccatcctccctgtctgcatctgtaggagacagagtcacatcacttgccgggcaagtcagagcattaacagcgtaatttaaagtgtatacaccaagaaaccagggaaacncccctaacctctagatctatgctgactatcctagtttgactagtacggtcgggtccctattcgtaaggttcaggttggctaggtggtatcgtagggacagtatttcactcctacaccatcagctagtcctgacctaaccgtagtaacgttnttttagacctaacttactactntacaacgtagtacgttaccgtacccgtattacgtttcggaccgtaacgggaacctaaacgtcggaactagtaaaccaaaccgtaacgttaggtacggtactacgaacctactcttccg

SEQ ID NO: 191330 - DNA, 969 bp, Homo sapiens
  misc_feature: GYAE6OF01ADGXJ.47.70.G04.1.454.CMB.1.raw
  modified_base (204)..(204): a, c, t, g, unknown or other
  misc_feature (204)..(204): n is a, c, g, or t
tcagagctcacgtacacgaccggtgctcgatttagtgtagtgtgaagggaagggggaggtcgagtctcagtcaggacacagcatggacatgagggtccccgctcagctcctggggcctcctgctactctggctccgaggtgccagatgtgacatccagatgacccagtcctccactcctccctgtctgacattctggtacgganacagtagtccaaccatccacgttcggacccggggacctaagtccgaagaggacctaatttaaaccgaggtaccggttaaattttttaaaagtttacggggttaacttacccaaaccgaaacggtaaaacccgaaacggggggtaaaaccgtacccccccttaaacccgttacccgttacggtaacttacccttaacgttacggtcccgttaggtaaccctaacctttacccggttaagtttttcgggaacctttaacggttaacggggttcccgggggtttacccccaaacgtttttccggtttaaacggggtttttcggaaccggttttggggaacccgtttaaaggggttccggggtaagtttttcccgggaacggggggtaacccttaaagggttttaccgttttttacccgaacctttcccgttaccaacccgttaccgttaccgtaaacgtcgtacggttacccttgggaacccttaaaccggtttaggtaacgttaacgttttttaccgaaccgttttaaactttacccgtaacgttacggttaaccaaggtaaccggttaaccggttttaacccccgggttaaaccccgttacgtttaacccggtttttaccgggaacccgggtaaaccggggtaacccttaaaaccggtcgggttaaaccctaaaccgtttaaaccgggaaacccggtttacggttaccggtaaggaccccggttaccacggtttaaacccctagtttcccgtttccgtttaaccgg

SEQ ID NO: 191331 - DNA, 657 bp, Homo sapiens
  misc_feature: GYAE6OF01B8KWH.47.70.G04.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnagtcgagggtntgacaaatgtctttggccttggtttacagcagacaccgagggaacgccctaagcgcctgatctatggtgcatactatttgactaaaggtcgggtacccatcgaaaggttcaggcggcaggtaggtcgtaggggaacaggtacgttccaacttctaccgtactactcgacggccgtaccctggacctacgtcccgtagtaaacggttacttccgtacggtaccttaaacttttaacgtttaccgttacgttaccttacccgttaagttaacgtacgttacgttcgttaccccgtttaccccgttacgggttaccgtttaccgggacccgtaaacggggtacccgtaaaggggttaacggtaaaacgtaccgaaaaccggtaacgttacgggtacggtaccttaggaccctaacctagtttacccg

SEQ ID NO: 191332 - DNA, 664 bp, Homo sapiens
  misc_feature: GYAE6OF01DMC67.47.70.G04.1.454.CMB.1.raw
  modified_base (308)..(308): a, c, t, g, unknown or other
  misc_feature (308)..(308): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggcgagtcagggcgttgacaaatgcttttggccttggttttcagcaagaccaaccgaggggaacggcccctaagccgcctgatctatggtncatacactttgacaaaggtcgggtacccatacgaaggtttcagcggactaggtaggtcgtagggaccgagtacgttcaaccttcgtacctaacttactaccgacggacggtcccgttgactacggcccttaggaaacggtactttacgtcgtaaccttaacttttaacgtttacctcggttacccttccgtaaggtttacttacgtacttcggttaccccttttacccgttccgggttaaccccgtttttaccggggaaccccgtaaacgggggaacccgtaaagggtaacgggttaaaactaaccgtaaaacggtaacgtacgggttaggaccctacgaccaccgtacgttaccg

SEQ ID NO: 191333 - DNA, 571 bp, Homo sapiens
  misc_feature: GYAE6OF01D0ATA.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccttccaccctgtctgcatctgtcggagacagagtcaccatcacttgccggccagtcagagtattgataggtggttggcctggtatcagcaagaaaccagggaaacgcccctagaactcttaatctataaggcgtattattttagaaacgtgggtccatcaagttcagcgcagtgatcgtgggacagtagttcactctcaccatacaaccaccctgcagcctagattgtattttgacgttactttaattacctagaacctaaaagttaataagtagtcgtaacccttccgttccggtttccggcccttagggaacctaaggtcggtattacggtaactaaaacgtacgttcggtaggctcgacctactacttctacgttacctttctacttcccgttaccccg

SEQ ID NO: 191334 - DNA, 595 bp, Homo sapiens
  misc_feature: GYAE6OF01CFKKH.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagacgtattttaaattggtatcaaccaagaaaccagggaaacgcccctaacctcctgatctatgctgcatcctagtttgcatagtgggtcccatctaggttcagtggcagtggatcgtgggactagtatttcactctcaccatacagcagtctcgactaacctgtaagttattttcgaccttaactttactaacttgtaccaaacgtacgtaacggtttaccggtaccccgttactaccgttttcggaccgtaacggggtaaccctaaacggtacggaacctaacgtaaccgaaaaccggtaacgttacgggttacggaccttacggacccaaccttaacttccgttacggtttaccc

SEQ ID NO: 191335 - DNA, 520 bp, Homo sapiens
  misc_feature: GYAE6OF01DG9EP.47.70.G04.1.454.CMB.1.raw
  modified_base (272)..(272): a, c, t, g, unknown or other
  misc_feature (272)..(272): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccaggaancccctaactcctgatctatgctgcatcctagtttgcataggtgggtcccattctaggttcagtcggcagtggatcgtgggactagtatttcactctacaccatcagcagtctagcaactgaagtatttgctaacttactactgtacaatagtacgttaccggtaccctactacttttcggcccgtaagggtacccaaacgtggaactaagtacaaacgtactgtcggactcgacaccgattctgtacc

SEQ ID NO: 191336 - DNA, 566 bp, Homo sapiens
  misc_feature: GYAE6OF01DM1D2.47.70.G04.1.454.CMB.1.raw
  modified_base (294)..(294): a, c, t, g, unknown or other
  misc_feature (294)..(294): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctccatccctccctgtctgcatctgtaggagacagagtcaccatcacttgccgggcaagtcagagcattaacagcgatttaaattggtatcaccagaaaccagggaaacgcccctaactcctgatctangctgcatccagtttgcatagtgggtccatctaggttcagtgcagtggatcgtgggacagtatttcactctcacatcagcagtctgcaacctgtaagtatttgctaacttactactgtacaactagtacgttaccggtaccccgttacgtaccgttttacggaccgtaacggggtaaccctaaacgtacgggaacctaacgtaaccgaaaaccggtaacgtacggttacgggaccgttacggaccctaacccgtaacttccgttggtttaccc

SEQ ID NO: 191337 - DNA, 550 bp, Homo sapiens
  misc_feature: GYAE6OF01A74UB.47.70.G04.1.454.CMB.1.raw
  modified_base (443)..(443): a, c, t, g, unknown or other
  misc_feature (443)..(443): n is a, c, g, or t
  modified_base (541)..(541): a, c, t, g, unknown or other
  misc_feature (541)..(541): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagacgtaattttaaagttggtatacaccaagaaaccaggggaaacgccccctaacctccctgatctatgctgcactccagtttgctagtaggtcgggtcccagtctaggttcagtggacaggtggatcgtagggacagtatttaccacttctcacctatcgagctagtctcgactaacctgaattatttcgactaacttactagtntacaatagtacgttaccggtaccccttataccgtttggaccgtagggaacctaaacgtaggaactaactacaaacggtacgtcgtgactcgacacctntcctgttcc

SEQ ID NO: 191338 - DNA, 594 bp, Homo sapiens
  misc_feature: GYAE6OF01A0XVU.47.70.G04.1.454.CMB.1.raw
  modified_base (222)..(222): a, c, t, g, unknown or other
  misc_feature (222)..(222): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattaacagcgtatttaaatggtatcaccagaaaccagggaaacgcccctaacctcctgatctatgctgcatccagtttgctagtaggtcggggtaccagtcgtaggttcagtggcaggtggatcgtagggacagtactttcacttctacaccatacagtcacgtctcgacctaaccgtgtaagttattttacgaccttaactttactacttagtaactaacgtacggtaacggttaacccggtaccccgttactacgttttacggaccgtaacgggaacctaaacgtacggaactaacgtaccgaaacggtacgttacggtacggtaccgttacgaccctaacctacgttccgttgttaccc

SEQ ID NO: 191339 - DNA, 570 bp, Homo sapiens
  misc_feature: GYAE6OF01B1KB8.47.70.G04.1.454.CMB.1.raw
  modified_base (277)..(277): a, c, t, g, unknown or other
  misc_feature (277)..(277): n is a, c, g, or t
tcagagctcacgtacacgaccggtgctcgatttagtgtagtgtgaagggaaaggggggagtcagtctcagtcaggacacagcatggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagacaactatttaaattggtatcagcagaaaccagggaaacncccctaagctcctgatctacgatgcatccaatttacggaaactacgggggtcccaagtacgtaaagggttcaaggtcgggaagtcggatcgtaggtactagtactttttacttcaccatcagcacgcctgcagcctagaagattagtacgacaactagttaacttactgttacaactagttactctaattaactcccttaccctaccgtttccggacccgtagggaacctaaacggtagtaacttaacgaaccgaaacggtaacgttggtacggacctgtacccaacgttacg

SEQ ID NO: 191340 - DNA, 697 bp, Homo sapiens
  misc_feature: GYAE6OF01CYT2Q.47.70.G04.1.454.CMB.1.raw
  modified_base (370)..(370): a, c, t, g, unknown or other
  misc_feature (370)..(370): n is a, c, g, or t
tcagagctcacgtacacgaccggtgctcgatttagtgtagtgtgaagggaaaggggggagtcagtctcagtcaggacacagcatggacatgagggtccccgctcagctcctgggctcctgctactctggctccgaggtgccagatgtgacatccagatcgacccagtctccatcctccctgtctgcatctgtaggagacagagtcaccatcacgttgccgggcgagtcgagggtcttgacaaatgctttggcctggtttcagcagacacgaggaacgcccctaagcgctgatctagtggtgctatactactttgacgtaaaggtcgggtacccatacgtaaggttcaggccggacgtaggtacggttcgngggtaacaggtacgtttccactccgtaccaacttactaccgacggaccgggcccttcggaccgtaacgtcccgtaggaaagttactttaccgtacgtacctttaaactttactttaaccgttcgttacccgtaccctaagttacttagtaacgttaccggttacccgtttaccccggttaccgggttaacccgttttcccggggaaccccggtaaaacggggtaaacccggttaaacggggtaacggtaaaaaccgtaacccgtaaaaacccgggtaacgttacgggttacgggtaccttacggaccctaacccgtagtttacccgg

SEQ ID NO: 191341 - DNA, 650 bp, Homo sapiens
  misc_feature: GYAE6OF01CKPX4.47.70.G04.1.454.CMB.1.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatcacttgccggnaagtcagngcattaacagcgtatttaaattggtatcacagaaaccaggaacncccctaactcctgactctatcgctgcatccagtttgctagtacggtcgggtccctagttcgtaggtttcaggtcggcgtaggtggaatcgtagggactagttactttcgactcgtacacctatacgagtacgtacgtctacgacctaaccgtagtaaacgttacttttacggaccttaaactttacttaacgttagtaacctaacgtaacggtaaccggtttaacccggttaaccccgttacgttaaccgtttttacggaacccggtaacgggtaaccctaaaccggttacggaaccgtaacgttaacctaaaacggtaacgttacgggtacggtaccgtaccgtacctaaccgtacgttaccgttcgtttacccg

SEQ ID NO: 191342 - DNA, 517 bp, Homo sapiens
  misc_feature: GYAE6OF01BWD53.47.70.G04.1.454.CMB.1.raw
  modified_base (345)..(345): a, c, t, g, unknown or other
  misc_feature (345)..(345): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaacgcccctaacctcctgatctatgctgcatccagtttgcatagtcgggtccatctaggttcagtgcagtgatcngggacagatttcactctcaccatcagcagtctgcaacctgaagtattttcgactaacttactactcgtacaacagtacgttaccgtaccccttactacgtttcggccgtacgggaccctaaacgtaggacactacaaacgtactggtgcgtacgaccacctacttctgttcc

SEQ ID NO: 191343 - DNA, 534 bp, Homo sapiens
  misc_feature: GYAE6OF01A4WXO.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcaattaacagcgatttaaatggtatcaccagaaaccagggaaacgcccctaacctcctgatctatgttgcatccagtttgctatagtcgggtcccatcgtagttcagtgctagtgatcgtggacagtactttcactctcacatcagcagtctgacaacctgaagtatttcgactaacttactactgtacaacacgtaacgttaaccggtacccgttacgtacgttttacggaccgtagggaaccctaaacgtcgaactaagtaccaaacgaacgtggacgtctacgcacatcttgtcttacc

SEQ ID NO: 191344 - DNA, 615 bp, Homo sapiens
  misc_feature: GYAE6OF01A9LQQ.47.70.G04.1.454.CMB.1.raw
  modified_base (278)..(278): a, c, t, g, unknown or other
  misc_feature (278)..(278): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (600)..(600): a, c, t, g, unknown or other
  misc_feature (600)..(600): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagctaattaacagcgtaatttaaatggtatcaacaagaaaccaggaacncccctaacctctgactctatcgctgcatcctagttcgctagtaggtcgggtaccagttcgtaggttcaggtcgcgtaggtgagtcgtggactagtnttaccgacttctccaactnacagtctagtctagactaacgtagtaacgtttatttacgaccttaacgttactacgttactaaccaacgtacggtacggtttaacccccggttacccgttagtttacccggtttcggaaacccgtaacggggtaaaccctaaacgttacgggaacctaacgtaaccgaaaaccggtacgttaggtaccgactccgtaccaacccttntcccgttgtttaccc

SEQ ID NO: 191345 - DNA, 446 bp, Homo sapiens
  misc_feature: GYAE6OF01B11WW.47.70.G04.1.454.CMB.1.raw
  modified_base (439)..(446): a, c, t, g, unknown or other
  misc_feature (439)..(446): n is a, c, g, or t
tcagagctcacgtacacgaccggtgctcgatttagtgtagtgtgaagggaaaggggctggagtgggtggcatttatatggtacgatggaagtaattattactatgcagactccgtgagggccgattcaccatctccagagacaattccaagaacacggtgtatctgcaaatgaatagcctgagagccgaggacacggctgtgtattactgtgtgagagatggtaattggaactccgtcgactatcactactacatggacgtctggggcaaaggggaccacggtcaccgtctcctcagcctccaccaaggcccatcggtccttcccctggccaccctcctccaagacgcacctctcgggggcacagcggccctgggctgcctggtcaacggactacttcctacgtgagtctctgacgcgggctggcaagggcgcgatagnnnnnnnn

SEQ ID NO: 191346 - DNA, 580 bp, Homo sapiens
  misc_feature: GYAE6OF01AYBBW.47.70.G04.1.454.CMB.1.raw
  modified_base (434)..(434): a, c, t, g, unknown or other
  misc_feature (434)..(434): n is a, c, g, or t
tcagagctcacgtacacgaccggtgctcgatttagtgtagtgtgaagggaaagggggagtcagtctcagtcaggacacagcatggacatgagggtccctgctcagctcctgggctcctgctgctctggttcccaggtgccaggtgtgacatccagatgacccagtctccatcctccctgtctgcatctgtaggagacagagtcaccatcacttgccgggcagtcgagggcgttgcaaatgctttggcctggtttcagcagacacagggaacgccctaagcgcctgatctatggtgcatacactttgcgtaaaaggtcggggtcccaagtacaaggtttcaggcggcaggtaggtctagggacagtacgttcactctcactatcagccggcctgcagtcctagaacgtattcgtgactaaactttattaaccgtntaccttcctagttattagtattcggtacctttacccgtcggttaaccgtttccggaccgtaacgggtaaacccgtaagggttaacggaaaactaccgtaaaaccggtaaaccttgggtacggtcgtacggacctaccgtaattccg

SEQ ID NO: 191347 - DNA, 689 bp, Homo sapiens
  misc_feature: GYAE6OF01CK0GW.47.70.G04.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
tcagagctcacgtacacgaccggtgctcgatttagtgtagtgtgaaggggaaaggggggagtcagtctcagtcaggacacagcatggacatgagggtccccgctcagctcctggggctcctgctgctctggttcccaggtgccaggtgtgacatccagatgacccagtcctccactccctccctgtctgcatctgtagganacagactcaccatcacgttcggccgggcagtcgagggtcgttgacaaatgtcgtttcggccttggttcagcagacacgaggacgccctaagcgcctgactctatggtcgactatactacttcgacgtaaaggtcgggtaccatacgtaaggttcacggcggacgtaggtggtcgtacgggactaggtacgttactactctactaccttancgtacgcgaccgtgcgacgtcgtagacgtcttacgtacgtacttaactttactttacgttgttaccctaccgtaagttacgtacgttacgtaccgtttacccttacccgttaccggttaaccggtttacccgggtaaccggtaaacccggggttaaccgggtaaaacgggtttaaccgggaaaaacttaacccggaaaaacgggttaaccggttacggttaccgggttaactacccgggttaaccaaccccgggtttaagttccccgtttttaaccgg

SEQ ID NO: 191348 - DNA, 555 bp, Homo sapiens
  misc_feature: GYAE6OF01CZSKV.47.70.G04.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
tcagagctcacgtacacgaccggtgctcgatttagtgtagtgtgaagggaaagggggggagtcagtctcagtcaggacacagcatggacatgagggtccccgctcagctcctgggctcctgctactctggctccgaggtgccagatgtgacatccagatgacccagtctccatccctccctgtctgcatctgtagganacagagtcaccatcacttgccgggcaagtcagagcaattaacagcgtaatttaaattggtactacaaccaagaaaccaaggggaaacnccccctaacctcctgatctatgctgcatcctagtttncagtacggtcgggtaccctagtcgtagggttcaggtgctaggtggatcgtagggacctaggtactttccacttacctaccacctatccagtcctagtctacgacctaaccgtagtaagttatttcgacttaacttactactgtacaacgtagtacgttaccgtaccctacttacgtttcgacgacgggacaacgtgactatacaaacgtctcgtagctacacacactctgtc

SEQ ID NO: 191349 - DNA, 827 bp, Homo sapiens
  misc_feature: GYAE6OF01CU6IF.47.70.G04.1.454.CMB.1.raw
tcagagctcacgtacacgaccggtgctcgatttagtgtagtgtgaagggaaaggggggagtcagtctcagtcaggacacagcatggacatggacgggtccccgctcagctccgtggggctcctgctactctggctccggaggtgccagatgtgacatccagatcgacccagtcctccactccctcctgtctgctatcgtgtaggagacagagtcaaccatcacgttcggccgggactaagtcaaggacgactaattaacgagtacgttaatttaaagttggtaactacaaccgaaacgaaaaccgaacgggtaaaccgaccccttaaaccttccgtagaacttctaagtcgtcctacgacctacgttaccgttaacggtttcgaccgttaaggttaacgggttccggggttacccttaggttaccggttaacgggtttaccgtaagggttcgggtacgtaagggttcgggtaacgtttccgggtacgggtaaacctaaggtttacctttacccgtaacctttcctaaccgtaaccctacgttaccgtaacgtacgttacgttaccgtaacgtaaccgtaaaccgttaggttaaaggtttactttacgtaacctttaaaccgtttacgtaaccgttacggtaaaccctaacggttaaccgggtttaacccggtttaacccggttaaccccgttaacgtttaccggtttaccgggaaccggtaaacgggtaacccaaacggttacgggaacctaacggtaaaccgtaaaccggtaacgttcgggtacgttaccgtaccgacctaaccgttacttccgtcgtttaacccg

SEQ ID NO: 191350 - DNA, 575 bp, Homo sapiens
  misc_feature: GYAE6OF01BEJOA.47.70.G04.1.454.CMB.1.raw
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccaggatgacccagtctccatcctcctgtctgcatctgtaggagacagagtcaccatcacttggccggcaaggtcagagcattaacagcgtaatttaaatggtatcaccagaaaccagggaacncccctaactctgatctangctgcatcctagtttgctagtacggtcgggtccattccgtagttcagtggcaggtggatcgtgggactagtactttcatctcacctntcagcagtctcgactaacgtgtaaagtcgttttcgaccttaactttactaccgttgtaaccaacgtacggtaaccgtttacccgggtaccccttactaccggttttacggaccgtaacggggaacctaacggttacgacgtaactacgaaacggttatacggtcggtacctcgactacctagttcctgttacc

SEQ ID NO: 191351 - DNA, 684 bp, Homo sapiens
  misc_feature: GYAE6OF01DBEN9.47.70.G04.1.454.CMB.1.raw
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
tcagagctcacgtacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggaatccctgagacctctcctgtcgctaacgtctggtaacttccaccttcagttaccctacggcatgcacgtcgggtccnccgaggcctccgaggaccgaaggggctgggagtgggtggcttaatttanagtggtaacgatagggaaattattattactatcgactagacctcggtaggacggggtaccctattaccgaacctacgttacctaccgtaaggtaacgtaactaaactttaacccgaaacggtaaccgtacgggttagttaactcgtacgtaactaaacgtagtaaacgtaacgtaccgtaaggaacggtaacggacccggtaacgggacccgacggtccgttaggttagttaacgtttacgtggtaggtagtaacggtagtaacgttagggttaaacgtttccgggtaaacccttccggtaccgttaacttacgtaacccg

SEQ ID NO: 191352 - DNA, 636 bp, Homo sapiens
  misc_feature: GYAE6OF01C4MPY.47.70.G04.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (627)..(627): a, c, t, g, unknown or other
  misc_feature (627)..(627): n is a, c, g, or t
tcagagctcacgtacacgaccggtgctcgatttagtgtagtgtgaagggaaagggggagtcagtctcagtcaggacacagcatggacatgacgggtccccgctcagctccgtgggctcctgctactctggctccgaggtgccagatgtgacatccagatgacccagtctccatcctcctgtctgcatctgtagganacagagtccacctatccacttcggccggganaagtcagagcaattaacagacgtaatttaaattggtaatcaaccaacgaaaaccgaacgggaaaccgacccctaaacctcctacgtaactctatcgactgactactccgtagtttcgactagttacggtcgggtacctagttcgttaggttctaggtggcgtaggtcggattcggtacgggactaggttaactttccgtacttcctaccacctaacgtcgacgtacctacgttctacgacctaaccgtagtaaacgtttacgtttacgacctttaaacttcctaacgttcgtaactaaacgtaccgtaacgtttacccggttacccgttacttacgttcggacgacgggtaaccaacgtagacgactagaaacgtacgtacgtggactacgtacactacncgttcgtac

SEQ ID NO: 191353 - DNA, 627 bp, Homo sapiens
  misc_feature: GYAE6OF01DAYU2.47.70.G04.1.454.CMB.1.raw
  modified_base (101)..(101): a, c, t, g, unknown or other
  misc_feature (101)..(101): n is a, c, g, or t
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
tcagagctcacgtacacgaccggtgctcgatttagtgtagtgtgaagggaaagggggagtcagtctcagtcaggacacagcatggacatgagggtccccgntcagctcctggggctcctgctactctggctccgaggtgccagatgtgacatccagatgacccagtctccatccctccctgtctgcatctgtagganacagacgtcaccatcacttggccgggtcaagtcagagctaattaacagtacgtaattttaaaattggtaatccaaccaagaaaaccgaaggggaaaaccncccccttaaactcctagacttctatgctgcattcctagtttcgctaagtacggtcgggtaccctagttcgtaggttcaggttggctaggtggatcggnggaactagtactttcacttcacaccatcaagctagtctcgacctaacgtgtaaagttctttcgaacttaacgttactacgtacgtaactaacgaaggttaccgttaaccggtaaccccgttagtttaccggtttacgggacccgtaacgggtaaccctaaacggtcggtaaactacgtaacgaaaccggtacgtcggtcgtacgtcgaacctactactttcgttgttaaccc

SEQ ID NO: 191354 - DNA, 576 bp, Homo sapiens
  misc_feature: GYAE6OF01CEV7Z.47.70.G04.1.454.CMB.1.raw
  modified_base (387)..(387): a, c, t, g, unknown or other
  misc_feature (387)..(387): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccaggaaagcccctaactcctgatctatgctgcatccagtttgcatagtgggtccatctaggttcagtggcagtgatcgtgggacagatttcactctcaccatcagcagtctgcaacctgaatnttttgctaactttactaactgtacaaactagtaacgtttaaccggttaccccgttaacgtaccgtttttacgggacccgtaacggggtaaccctaaaaccgttgggtaaacctaacgttaaccgaaaaccggtaaaccgttggttacgggaccttacgggaccctaacccgacttccgtcggtttaccg

SEQ ID NO: 191355 - DNA, 623 bp, Homo sapiens
  misc_feature: GYAE6OF01C3JDE.47.70.G04.1.454.CMB.1.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
tcagagctcacgtacacgaccggtgctcgatttagtgtagtgtgaagggaaagggggagtcagtctcagtcaggacacagcatggacatgagggtccccgctcagctccgtggggctcctgctactctggctccgaggtgccagatgtgacatccagatgacccagtcctccatccctccctgtctgcatctgtaggagacagngtcaccatcacttcggccggacaagtcagagcaattaacagactaatttaaagttggtatacaaccaagaaaccgagggaaacncccctaactcctagactctatgctgtcagtcctagttnactagtacggtcggtacctagttcgtaagttcgagtggactaggtgacgtcgtgggtaacacgttatttccgaaccttctacccgaacctacttaccgaacggtctacgttactacggaaccctaaccgtaggtaaacgtttactttacgaccttaaacttacgtactacgtaactaacgtacgtaaccggttaacccgtacccgtacgttacgttacggaccgtaaacgggtaccaaagtacggaactaacgaagtaaacggtactggtctacgtcgactaacgtcgtctgttacc

SEQ ID NO: 191356 - DNA, 695 bp, Homo sapiens
  misc_feature: GYAE6OF01ERMWQ.47.70.G04.1.454.CMB.1.raw
  modified_base (201)..(201): a, c, t, g, unknown or other
  misc_feature (201)..(201): n is a, c, g, or t
tcagagctcacgtacacgaccggtgctcgatttagtgtagtgtgaagggaaagggggagtcagtctcagtcaggacacagcatggacatggacgggtccccgctcagctccgtggggctcctgctactctggctccgaggtgccagatgtgacatccagatcgacccagtctccatccctccctgtctgcatctgtagganacagagtccaccatcacttcggccggggcgagtcgaggggcgttagacaaatgctttggccttggtttcagacagacaccggaagggaacggacccctaagccgcctagactactacgatgctaactcctaagtttacggaaacgtacggggtaccctatacgtaaggttacaaggttagggaaaggttggacgttacggtagggtaactaaggtttaactttttaaccgttacaaccgattaccgaacgtaccacgttcccgtcgtaccgtaacgtacctaggaaagtaatttaacgttagaccaaactaattaactttaccgtagtaacaaactaagttaactactaaacgtttaaccttcccgttaacccccttaccgttacccggtaccccggttacgggaaacccgtaaaagggttcggtaaacttaacgaacctaaaacggaaccgttaggtcggtacttacgaacccgtaacttaacgttcttacgg

SEQ ID NO: 191357 - DNA, 747 bp, Homo sapiens
  misc_feature: GYAE6OF01A0KQD.47.70.G04.1.454.CMB.1.raw
  modified_base (229)..(229): a, c, t, g, unknown or other
  misc_feature (229)..(229): n is a, c, g, or t
  modified_base (736)..(736): a, c, t, g, unknown or other
  misc_feature (736)..(736): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccggaggtgccagatgtgacatccagatcgacccagtcctccactccctccctgtctgcatctgaggagacagacgtcacatctacgttcggccgggnaagtcgagagactaattaacgagtacgtaattttaaaagtggtaactaccaaaccgaacggaaaaaccgaacggggtaaaaccctacccccttaaacctccgtagtacttaccgtaacgatacgtacctaacgttacccgtaaagtttacgggaaaaccggtcggggttaacccctagttaccggtaaacggtttacgaagggttacggtaaaggtcggtaacgtacggtacggggaaacgtagttaacgttactaacctcttaacccaacccttaagtaccccaaaccgtaccccttagaccctacggtaccctagtaagttacgttaacgtttcggtaacttaaacgtttacgttacgaaccgtaaacgttaaaagttactttaacggtacgtacttaaccccggtttcgtttaccggttacccgtaccgtagggaacccgtaaggtacgtactacggaactaaacggcgttgtacggctacgacctactcgttctagttccctntccgttacccg

SEQ ID NO: 191358 - DNA, 647 bp, Homo sapiens
  misc_feature: GYAE6OF01CM2TQ.47.70.G04.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggganaagtcagagcaattaacgagcgtaatttaaattggtatacaaccagaaaccgaggaacnccccctaacctcgtgatctangctgctactccgtagtttcgctagttacggtcgggtcccagttcgtaggttcaggtcggactagggtggtatcggtagggaactaggttactttaccgacttcctaccaacctataccgtagccgtacgtcctagtaccgtaacgttagtaaacgttcttttacgaaccttaaaccgtttacttaactacgttaccaaacgtacggttaaccggttacccggttaaccccttacgttacgtttcggaaccggtacgggtaacctaaacggtcggaaactactacgaaaacggtacgttcgggtaacgtccgtaccgaccctaactccgttagttccgttaaccc

SEQ ID NO: 191359 - DNA, 516 bp, Homo sapiens
  misc_feature: GYAE6OF01A7DJM.47.70.G04.1.454.CMB.1.raw
  modified_base (222)..(222): a, c, t, g, unknown or other
  misc_feature (222)..(222): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacttgccgggnaagtcagggcttgcaatgctttggtctggtttcagcagacaccagggaagcccctaagcgcctgatctatggtgcatacactttgcaagtgggtccatcaaggttcagcgcagtaggtctgggacagngttcactctcactatcagcgctgcagcctgaanttcngctaacttatactgtcctaccagtatgatcgtaccttacccgtcggtacctttcggacctaaggggacccaagggtaggaaactaccgaaacgtacgttacggtcggacttaggacctaccgtattccg

SEQ ID NO: 191360 - DNA, 880 bp, Homo sapiens
  misc_feature: GYAE6OF01ERBPG.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctccgtggggcctcctgctactctggctccgaggtgccagatgtgacatccagatgacccagtcctccatccctccctgtctgcatctggtaggagacagagtccaccatcacgttcggccgggacaagtcagagactaacttaacaggtacgtaattttaaaagttggtaacttaccaaaccgaaacggaaaaacccgaacggggtaaaacccgtacccccccttaaacccgtaccgtacggtaacttaccgttaatcggtcctacgactacttcccgtaggtttcgactaacggttacgggtccggggtacccctaagttccgtttaagggttacgtacggtgggtaccgtaagggtcggtaagtccgggtaaggggtaacctaaggttaccttttccgaaccgtttccctaaccgtaaccccttaagtacccgtaaggtacccgttacggtaccgtaaccgtaaacccgttaaccgttaagggttaaacgttttaacgtttttaccggtaacccttaaacgtttttaacccgttaccggtttaacgttaacctaaaaccgggttaacggtttaaaccccggggttttaaaacccccgggtttaaacccccggttttaaccggtttaccgggttttaccggggaaaccccgggtaaaccgggggttaaaaccctaaacggtaccgggttaaaccgaacggtttaaacccgaaaacggttacggttcgggtacgtaccgttacgacctaaacctcttacccggttcgtttaccc

SEQ ID NO: 191361 - DNA, 688 bp, Homo sapiens
  misc_feature: GYAE6OF01BBI6P.47.70.G04.1.454.CMB.1.raw
  modified_base (202)..(202): a, c, t, g, unknown or other
  misc_feature (202)..(202): n is a, c, g, or t
tcagagctcacgtacacgaccggtgctcgatttagtgtagtgtgaaggggaaagggggggagtcagtctcagtcaggacacagcatggacatgagggtccccgctcagctcctggggctcctgctactctggctccgaggtgccagatgtgacatccagatgacccagtcctccactccctccctgtctgcatctgtagganacagagtcaccatcacgttcggccgggacaagtcagagactaattaacagtacgttaattttaaagttggttaactaccaaaccaaacggaaaaccgaacggggaaaaccgtacccccttaaacctcccgtagtacttactatcgctcgactactcctagtttcgactagttacgggtcgggtacctagttcgtacggttcgaggtggacgtaggtagactcggtagggactagttactttcacttcctaccaactatacgatctacgttctacgacctaacgttaggtaacgttacgttttacacctttaaactttactaacgttcgtaactaacgtaacggtaaccggtttaacccggttacccgttacttaccggtttaccggaccggaaacgggtaaccctaaacggtacgaacctaacgtaacgtaaacggtacgttcgggtacgtacgttaccgacctaaccgtcttccgttcttacccg

SEQ ID NO: 191362 - DNA, 537 bp, Homo sapiens
  misc_feature: GYAE6OF01DFX6C.47.70.G04.1.454.CMB.1.raw
  modified_base (199)..(199): a, c, t, g, unknown or other
  misc_feature (199)..(199): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (531)..(531): a, c, t, g, unknown or other
  misc_feature (531)..(531): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccggaggtgccagatgtgacatccagatgacccagtctccatccctccctgtctgcatctgtagganacagagtcaccatcacttgccggggcgagtcgaggggcttgacaaatgctttggctggtttcagcagacacagggacggccctaagccgctgatctatggtgcatacactttgacaaaggtgggtaccatacgaaggttcaggcggacgtaggtaggtctgggactagagttcactctcactancagcgctgcanctgagtattctgactaacttacttacttgtcctcctagttatgatcgtacttacccgtcggtaccgtttccgaccgtaacgggaaccgtaaacgggtaggaaactacgaaacgtaactcggtacggactgaccactnttaccg

SEQ ID NO: 191363 - DNA, 656 bp, Homo sapiens
  misc_feature: GYAE6OF01B1JAW.47.70.G04.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (302)..(302): a, c, t, g, unknown or other
  misc_feature (302)..(302): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagatcaccatcacttgccgggnagtcgagggcttgacaaatgctttcggccttggttctagctagacaccgagggaacggcccctaagcgcctgatctagtgngcatactactttgactaaacggttcgggtaccctatacgtaaacggttcgacggcggactaaggtaggtccgtaggggactaaggtacgttactacttcgttacacttacgtacgacggtcggtacccgtcgaccgacgtcctagtaacgtaacttcgtacgacttaaacctttacctaacttacggtacctaaacgtaacggtaacggtttaacccggttaacccgttaaccgttacgttttaccgggacccggtaaacgggaacccgtaaacgtacgggtaaacctacggtaaccaaacggtaaccgtaggtaccggtaccgtcgaacctaccgtacttcgtcgtttacccg

SEQ ID NO: 191364 - DNA, 550 bp, Homo sapiens
  misc_feature: GYAE6OF01CX38P.47.70.G04.1.454.CMB.1.raw
  modified_base (220)..(220): a, c, t, g, unknown or other
  misc_feature (220)..(220): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctcatccctcctgtctgcatctgtagagacagacgtcaccatcacttgccgggnaagtcagggcttggcaaatgtctttcggccttggtttcagctagacacgaggacggccctaagccgctgatctatggtgacatactacttgacaagtcgggtaccatacaagttcagcgcaggtacggtcgtagggacagtagttcacttcgacactatcgagcgcctgacagcctgaagtattcgtgactaacttcttacgtcgtctcaatgtagactcgtacttacccgtacgtacgtttacggacctaaacgggtaccaaacggggtacgtaaagtaccgtaaacggtaacgttcggtacggtacctaggaacctacctagtttacg

SEQ ID NO: 191365 - DNA, 726 bp, Homo sapiens
  misc_feature: GYAE6OF01C2TD1.47.70.G04.1.454.CMB.1.raw
  modified_base (101)..(101): a, c, t, g, unknown or other
  misc_feature (101)..(101): n is a, c, g, or t
  modified_base (201)..(201): a, c, t, g, unknown or other
  misc_feature (201)..(201): n is a, c, g, or t
tcagagctcacgtacacgaccggtgctcgatttagtgtagtgtgaagggaaaggggggagtcagtctcagtcaggacacagcatggacatgagggtcccgntcagctccgtgggctcctgctactctggctcggaggtgccagatgtgacatccagatgacccagtctccatccctccctgtctgcctatcgtagtagganacaggagtcaccattcacgttggccgggactaagtcaggactctaattaacagacgttaatttaaagttggtactcaaccgaacgaaaaccgaaggggaaaccaccccttaacctccgtagtaacttcgtaactcgtctcggactacgttccgtagtttcgactaaggttacggtcggggtcctaagttccgttagggttacgtaggttcggacgtaggtaggtacttacggtagggaactaggtactttcgacttccactactacgtcacggtactacgtctacggacctaacgtaggtaaacgttagttttacgaccttaacgttacttaacctaggtaacctaaacggtaccggtaaccggtttaacccgggtaacccctttaggttaacccggttttacgggacccggtaaacggggtaaccctaaaacggttacgggaacctaacgtaaccgttaaacggacgtttacgggtacggtaccgtacggaacctaacccgttagttccgttaacgggtttccc

SEQ ID NO: 191366 - DNA, 667 bp, Homo sapiens
  misc_feature: GYAE6OF01CO1PW.47.70.G04.1.454.CMB.1.raw
  modified_base (196)..(196): a, c, t, g, unknown or other
  misc_feature (196)..(196): n is a, c, g, or t
  modified_base (329)..(329): a, c, t, g, unknown or other
  misc_feature (329)..(329): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctcctgtctgcatctgtagganactagagtcaccatcacttgccgggcaagtcagagcaagttaacagacgtaatttaaattaggtatacaaccaagaaaaccagggaaacgacccctaacctcctagactctatcgctagctactcctagtttnactagtacggtcggggtaccctagttccgtaggtttccgaaggttcgggacgtaggttagggtacgttaccggtagggtaaccgtaaggttaacgtttacccacttaccttaccaacctaacgttaccgacgtacgtacgttacgtacggtacctaaccgttagtaacgttagttttacgtacttaaactttactacttacgtacaaccgtagtaaccgttaccgtacccttacgttacgtttacggaccgtaacgggtaacctaaacgtacggaactacgtaacgaaaaccgtacgtacggtcggtactacgacctaacctcttcgtcgtttacccg

SEQ ID NO: 191367 - DNA, 698 bp, Homo sapiens
  misc_feature: GYAE6OF01DEI2B.47.70.G04.1.454.CMB.1.raw
tcagagctcacgtacacgaccggtgctcgatttagtgtagtgtgaagggaaagggggagtcagtctcagtcaggacacagcatggacatgagggtcccccgctcagctccgtggggctcctgctactctggctccggaggtgcaagatgtgacatccagatgacccagtcctccatccctccctgtctgcatctgtaggagacagagtcaccatcacgttcggccgggacaaggtcaaggacgcaattaacgagacgttaaatttaaagttggtaactaccaaccaagaaaaccgaagggaaaccgaccccctaacctccgtagaactctatcgctgacactcctagtttcgactagtacggtcgggtacctagttacgtaggttcgaggtggacgtaggtggtactcggtagggaactaggttactttcctaccgtcttacctaacttacgtacgacggtcccggtacctggccaacggtcccgtaaggtaacggttcttaccgtagtaacctttaaccgtttatttaccgttcgttaccctacgtaagttagtacgttacgttccgttacccttaacccggttccggttaaccgtttacccgggaaccggtaaacggggtaaccgtaaagggtaacgtaaaaccgttaaccgtaaaacgtacgttacgggtacgtacgtaccgaccgtacgttacg

SEQ ID NO: 191368 - DNA, 640 bp, Homo sapiens
  misc_feature: GYAE6OF01DJGPV.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagagtccaccatcacttggccgggacaagtcagagcaattaaacagtacgtaatttaaattggtaactacaaccaaggaaaaccgaaggggaaaaccgaccccccttaaacctcccgtagaactcttaatcgctcgactacttcccgtagtttcgactaagttacgggtcggggtaccctagttaccgttagggtttacgaggttcgggacgtagggttggacttcggtagggaactaggttactttcacgttctaccacctataccagtctacgtctacgacctaaccgtagtaaacgttattttacgaccttaacttactacttgtaacaacgtacgtacgttaccgtacccgttacttacgttacggaccgtaacgggaacctaaacgtgaacctactaacgaaacgtacgtgtcgactacgactactctcgttgttacc

SEQ ID NO: 191369 - DNA, 599 bp, Homo sapiens
  misc_feature: GYAE6OF01CG8C2.47.70.G04.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (483)..(483): a, c, t, g, unknown or other
  misc_feature (483)..(483): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcactctgtagganacagagtccaccatcacttggccggganaagtcaagagacaattaacagtcgtaattttaaattggtaatccaaccgaagaaaaccgacgggaaaccgtacccctaaacctcctagatcctatcgctagtcatacctagtttcgactaagtacggtcgggtccctagttcgtaggttacgagtggactaggtggacgttcgtagggacaagttacgtttccacttcgtcactacgtacagtcagttcagacctaacgtagagttatttcgaacttaatactactnacaacgtactaacgttaccggtacccttacgtacgtttcggacgtaacggtaccaaagtaggaacctagaaccaaaggtcttagtcggactacgacaccgtattcccgtgtttacc

SEQ ID NO: 191370 - DNA, 697 bp, Homo sapiens
  misc_feature: GYAE6OF01BSTQ4.47.70.G04.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (303)..(303): a, c, t, g, unknown or other
  misc_feature (303)..(303): n is a, c, g, or t
tcagagctcacgtacacgaccggtgctcgatttagtgtagtgtgaaggggaaagggggagtcagtctcagtcaggacacagcatggacatgagggtccccgctcagctccgtggggctcctgctactctggctcgaggtgcagatgtgacatccagatgaccagtctcatcctcctgtctgcatctgtagganacaggactcacctatcacgttcggccggganaacgtcgagganacctaattaacagtacgttaaattttaaacgtggttaatccaaaccgaagaaaaccgaagggaaccnccccctaacgtctagactctagtcgactgactactcgtagtttcgactaagttcgggtacggtacctagtcgttaggttcgaaggttgggactagggtcggtactacgggtagggaactaggttaccttcgtaaccttaccgtaccaacccgtataccgtaacgcctaacgttctacgaaccgttaacctaaggtaacttcgtttacgaaccgtttaaactttacgtacgttacgtaactaaacggttacgtaaccgtttaacccggtaaccccgttagtttaccggttacggaccggtaaccgggttaaccaaagtcgggtaactaacgtaacccggtaaaacggttctacgggtacgacctaggtacccctaagtacgttcgtttacgtacc

SEQ ID NO: 191371 - DNA, 798 bp, Homo sapiens
  misc_feature: GYAE6OF01DGD2Q.47.70.G04.1.454.CMB.1.raw
  modified_base (101)..(101): a, c, t, g, unknown or other
  misc_feature (101)..(101): n is a, c, g, or t
tcagagctcacgtacacgaccggtgctcgatttagtgtagtgtgaagggaaagggggagtcagtctcagtcaggacacagcatggacatgagggtccccgntcagctcctggggctcctgctgctctggctctcaggtgccagatgtgacacccagatgacctacgtactcctactaccttccccttccgtcgtcgtcactacttcgttagggaggaacgaacgaacggtactacccaactactaccgtacggttccggggccgggtaacgtacggtcggggtacgggttcgttacgaactaaggtcgtttcggttccgtccggttttcgtacgacgacgaacgaaccgacggggaacgggtaccccgtaaccgagcccgtacgtagtactacgttagggtcgactaacgtaactacccgttaggttacgaacggttaacggggttcccggtaactacgttaacggtacgtacgacggaccgtaggtaacgggtcggttacgggacgaagtacggttcgtacctaccttacgtactaactcgtacgccggtcccggtacgtaccggacgttcccggtagtaacgggtaacttccgttcggtaactaaccgtttaactttacgttacgttcccgtacgttaaccgtagttagtacgttaccgttccttaacccggttacccggtttacccggttccggttaacccgggtaacgggaaaccgggttacgggtaaacgggtaaataaacccgggtaaacgtaacggtacggttaggcccgttaacgtcgtaaccgtaaccg

SEQ ID NO: 191372 - DNA, 672 bp, Homo sapiens
  misc_feature: GYAE6OF01C7W86.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgttgctctggttcccagggtgccaggtgtgacatccagatgacccagtctccatccctccctgtctgcatctgtaggagacagagtcaccatcacttggccgggcgagtcgagggcgttgacaaagtgtctttgggccttgggtttcaggcagaacaccgaagggaaggccccctaaagcgcctagatctaatggtgctaatactacgttttagacgtaaaaggtggggtacccaagttcgaaaggtttcgaggtacggcgtaaggtaacgggtcgtagggacaggtagttcacttctactactatcaggcggcctagccagacctaggaaaggctttctacggtaccaaacttttacgtttaaccttacggttccttaccgtaagttaacgttcggtaatttccggtaaccctttaaccccggttacgggtaccgttttaccgggaacccgtaaacgggaaccccgtaaagggttacgggtaaaactaccggaaaaaccgtaccgtaggtacggaccgtacggacctaacccgtacttccgtggtttaccc

SEQ ID NO: 191373 - DNA, 561 bp, Homo sapiens
  misc_feature: GYAE6OF01A1W19.47.70.G04.1.454.CMB.1.raw
  modified_base (418)..(418): a, c, t, g, unknown or other
  misc_feature (418)..(418): n is a, c, g, or t
  modified_base (505)..(505): a, c, t, g, unknown or other
  misc_feature (505)..(505): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaacagcgtatttaaatgtatcacagaaacagggaaacgcccctaacctctgatctatgctgcatccagtttcgctagtagtcggggtcccagtcgtaggttcgaggcggcgaggtggatcgtgggactaaggtactttcactctaccacctatacagactagtctcgacaaccgtgtaagtnttttacgactaacttactactgtacaacacgtacgttaccgtacccgttactaccgtttacggaccgtaacgggtaacctaaaccgngtaaacctactaacgaaacggtctacgggtagctagacctaccacttcgtcgttac

SEQ ID NO: 191374 - DNA, 1023 bp, Homo sapiens
  misc_feature: GYAE6OF01CV3UB.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggcctcctgctactctggctccgaggtgccagatgtgacatccagatcgacccagtcctccactccctcctgtctgcatcgtgtaggagacagatccaccatcacttggccgggcaagtcagacgactaattaacagtacgttaaattttaagtttaggttactaccgaaaccaaggaaaaaccccggaaacggggaaaaccgtaccccccttaaacccttacccgtacgtacttacctaagttcggacctcggacctacgttaccccgttaggttttacgcgttaaacgttacggggttacccggggttaaccccctaggtttaccggttaaggggtttaccgtaacggggttcgggtaaccggttaagggtttacgggtaacggtttccgggttaacgggggtaaccccttaagggttttaaccttttaacccctacccgtttacccgttaaccctaaaccccgttaaccgtttaaccgaaccggtaaccccgttaaccggtttaaccgttaccggtaaaccccgtttaaacccggttaaacggtttaaaacggtttttaaccgttttttaaccggtaaccccttttaaaaccccgttttaacccgtttaaacccgttacgggtttaaacccttaaaacccgggttaaccgggttttaaaacccccggggttttaaaccccccggttttaaacccccgggttttaacccgttttaacccgggtttttacccgggggaaacccccggggttaaaaccgggggtaaaccccttaaaaacccgggttaaccggtaaaccgttaaaaccgttaaacccggtaaaaaccggttaaccggttaccggggtaccggttaccgttaacccggtacccgtaaacccgtttccgttaacccgtttccggtttaaccccg

SEQ ID NO: 191375 - DNA, 640 bp, Homo sapiens
  misc_feature: GYAE6OF01ENFOM.47.70.G04.1.454.CMB.1.raw
  modified_base (196)..(196): a, c, t, g, unknown or other
  misc_feature (196)..(196): n is a, c, g, or t
  modified_base (367)..(367): a, c, t, g, unknown or other
  misc_feature (367)..(367): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgagganacagagtcaccatcacttgccgggcaagtcagagcattaacagcgatttaaatggtatcacagaaacaggaacgcccctaactcctgatctatgctgcatcctgtttgcataagtcgggtcccatctaggtcagtggctagtgatctgggacagtattcactctccacatnagctaacgtctgtaccaaaccgttagaagttatttttacgacctaaacctttacttaacgttacgtacgaaacctaacgtaacgggtttaacccggttaaacccccgtaaccttaccgttttttaacgggacccggttaaaggggggaaacccctaaaaccgtaacggtaaccggtaacttaaacggtaaaaccccggtaaaaaacgttcgggttacggtacccggtacgggtaacccaaacccctacgtttaaaccgtcggttttaaccccg

SEQ ID NO: 191376 - DNA, 757 bp, Homo sapiens
  misc_feature: GYAE6OF01E2T7X.47.70.G04.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccggaggtgccagatgtgacatccagatcgacccagtcctccatccctccctgtctgcatctgtagganacagatcaccatcacgttcggccgganaagtcagacgctaattaacagtacgtaagttttaaattggtaactcaaccgaaacggaaaaaccgaacggggaaaaccgtaccccccttaaacccttccgtagtaacttacgtagtacgtctcgactaacgttcccgtaggtttcgactaaggttacgggtccggggttaccctagttacggttaggttaccgtaggttcggacgtacgggtggtacgttcggtacgggtaacgtacgttactttaccgaccttaccgtacctaacccgtactccggaacgtacgttaacggttcctacggaccctaaccggttaagtaacgtttacgttttaccgtaaccttaacctttaacttacgtacgtaaccgtaaacggtaacggttaccggtttaaccccggttacccgttacgtttaccggtttaccgggaaccgtaacggggtaaccctaaacggtacgtaacgtacgtaaacgtaaacggtacgtcggtaccgaccgtacgacccaaacttcgttccgtcgtttacccg

SEQ ID NO: 191377 - DNA, 609 bp, Homo sapiens
  misc_feature: GYAE6OF01E2XS7.47.70.G04.1.454.CMB.1.raw
  modified_base (198)..(198): a, c, t, g, unknown or other
  misc_feature (198)..(198): n is a, c, g, or t
tcagagctcacgtacacgaccggtgctcgatttagtgtagtgtgaaggggaaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatccacttcggccggggcaagtcagagcaattaacagcgtaattttaaattggtactacaaccaacgaaaaccaagggaaacgaccccttaacctcctagatctatgctgccattcctagtttcgactagtacggtcggggtcctagttcgttaggttcgaggtggacgaggtggatcgtagggacagtactttacacttctacacctatcacgctacgtctacgaccacgtagtaattacttttacgactaaactttactacgtacgtaacaacgtagtaacggttacccgttaacccttacttacgtttcggaccgtacgggaacctaaacggtacgtaaccgaactaaccaaacgtacgttagtggtacctcgaaccaaccctattccgtcttcccg

SEQ ID NO: 191378 - DNA, 778 bp, Homo sapiens
  misc_feature: GYAE6OF01EFCFJ.47.70.G04.1.454.CMB.1.raw
tcagagctcacgtacacgaccggtgctcgatttagtgtagtgtgaagggaaagggggggagtcagtctcagtcaggacacagcatggacatgagggtccccgctcagctcctggggcctcctgctactctggctccgaggtgccagatgtgacatccagatcgacccagtcctccatcctccctgtctgcatctgtaggagacagatcaccatccacttcggccgggacaagtcagagactaattaacagacgttaattttaaaattggtaactaccaaccaaagaaaacccgtaaggggaaacctaccccccttaaacctccctaggtaacttaccttaatcggaccttacggacctaacttcccgtaaggtttttcgaccttaagtttaacggggttccggggtacccctaagttccggtttaaacgggttcgtaagggttcgggacgttagggtacggtaactttccgggtaggggtaaccttaaggttactttttacccaaccgttcccttaaccaaccctatccgaaacggtcctaacggttactacgtaacctaacccgttaaggtaacgtttacttttacgaacctttaaactttaaccctacgttacgtaaccctaaacgtaacggttaacccggtttaacccggtaacccccgtttaagttaccgtttaccggaacccggtaagggtaaaccctaacgtacggaactaaccggtaacaaaacggttcgtagtacggtaccgtacgaacctaacgtcttgtcgttaaccc

SEQ ID NO: 191379 - DNA, 705 bp, Homo sapiens
  misc_feature: GYAE6OF01DN2BT.47.70.G04.1.454.CMB.1.raw
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
tcagagctcacgtacacgaccggtgctcgatttagtgtagtgtgaaggggaaagggggggagtcagtctcagtcaggacacagcatggacatggacgggtccccgctcagctccgtggggctcctgctactctggctccggaggtgccagatgtgacatccagatcgacccagtcctccactccctccctgtctgcatcgtggtaggagacagacgtccaccatccgtacgttcggaccggactaagtcaagganactaactaacgagtagttaatttaaagtgtaactaccgaacgaaacggaaaccgacgggaaaccctccccttaaccgtcgtagtacttcgtacngtacctcgtactactcgttagttcgactagggttacggtcgggtacctagtttccggtaagggttcagggtcggacgtaggttacggtacgttcgggtaagggacttaacgtttctttacccgacccttaccaccgtaactacgtacgacgtaacccggttacgtaccgtaactaaccgtacgttagttaaacgtttctaacgtacttaactatacgtacaacgtaacgtacgtacccggtttaacccgtacttacgttccggtacggaaccggtaacggtacgtaacgtacgaaacttacgaaacgtaacgtcggtacgtagtaccctacaaccgtattacgttccttagttccc

SEQ ID NO: 191380 - DNA, 576 bp, Homo sapiens
  misc_feature: GYAE6OF01CBKC7.47.70.G04.1.454.CMB.1.raw
  modified_base (277)..(277): a, c, t, g, unknown or other
  misc_feature (277)..(277): n is a, c, g, or t
  modified_base (404)..(404): a, c, t, g, unknown or other
  misc_feature (404)..(404): n is a, c, g, or t
  modified_base (562)..(562): a, c, t, g, unknown or other
  misc_feature (562)..(562): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattaacagcgtaatttaaatggtatcaaccaagaaaccagggaaacnccccctaacctcctagatctatgctgctatcctagtttcgactataggtcggggtaccctagttccgtaggttctagtcggactaggtggatcgtagggactagtactttcacctctccactatcancgtacgtctcgacaacctagtaacgttattttacgacctaacttactaactcgtacaacgtacgtacgttaaccgtacccttactacgtttggaccgacgggaacctaaacgtagaaccagtaaccaaacggtacttacggtacgcgtacgacacctnttaccgtcgttacc

SEQ ID NO: 191381 - DNA, 607 bp, Homo sapiens
  misc_feature: GYAE6OF01ADUBT.47.70.G04.1.454.CMB.1.raw
  modified_base (279)..(279): a, c, t, g, unknown or other
  misc_feature (279)..(279): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcaattaacagcgtaatttaaattggtatcaccagaaaccagggaaacncccctaacctcctgactctatgctgcactcctagtttcgactagttaggtcggggtcccagttcgtaggttcaggttggcaggtggatcgtagggactagtatttccactcctacaccatacagctagtctcgaccaacccgttagtaaacgtacttttacgaccgttaactttactacttacgtaccaaacgtaggtaacggtttaacccggtaccccgttacttaccggtttacggaccggtaacgggaaccctaaacgtcggtaaccactaaccgaaacggtccgttaggtacggcctacggaccaacctcgttcttggttaccc

SEQ ID NO: 191382 - DNA, 641 bp, Homo sapiens
  misc_feature: GYAE6OF01E18EE.47.70.G04.1.454.CMB.1.raw
  modified_base (322)..(322): a, c, t, g, unknown or other
  misc_feature (322)..(322): n is a, c, g, or t
  modified_base (519)..(519): a, c, t, g, unknown or other
  misc_feature (519)..(519): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtcctccatccctccctgtctgcatctgtaggagacagacgtcaccatcacgttggcccggggcgagtcgagggtccgtttgactaaatgcttttggccttggtttcagcagaccgaccgaggggaacggaccccgtaagccgcctgatctagtggtnctactactactttagacaaagggttcggggtaccccaagttacgaacgggtttcaggtccggtacgaaggttaacgggtcgtaggggacgtaacggtacgttccacttcctactactactacgtacggccggtccgtgccgtagccgtagacgtattccgtcgtacctaactttattaccgtgtacctcgtaacgtntagtatacgtccgtttacccgtacggttaccgtttcggaccgtaaacgggacccgtaagggtaacgtaaagtaaccgaaacgtaaccgtgggttaggcgttacaccgacctgtcgtttaccg

SEQ ID NO: 191383 - DNA, 695 bp, Homo sapiens
  misc_feature: GYAE6OF01B911T.47.70.G04.1.454.CMB.1.raw
  modified_base (142)..(142): a, c, t, g, unknown or other
  misc_feature (142)..(142): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (334)..(334): a, c, t, g, unknown or other
  misc_feature (334)..(334): n is a, c, g, or t
tcagagctcacgtacacgaccggtgctcgatttagtgtagtgtgaaggggaaagggggggagtcagtctcagtcaggacacagcatggacatgagggtccccgctcagctcctggggctcctgctactctggctccgaggtnccagatgtgacatccagatgacccagtctccatccctccctgtctgcatctgtagganacagagtccaccatcacttggccggganaagtcagagcaattaacagcgtaattttaaattggtatacaaccaagaaaccgagggaaacaccccctaacctcctagactctatcgctgctactcctaggtttcnctagtacggtcgggtcccattcgttaggttcgaggtgacgtaggtggatcggtaggactagtactttccacttcctacctacctacgtacacgtctaagttcctacgtacctaaccgttaggtaagttacgttttacgaaccttaaaccgttttactaccgttacttaaccgaaacgttaaccggttaaccgggtttaaccccggttaccccgttaacgtttacccggtttacggggaaccccgtaaccggggtaaaccctaaacggtacgggtaaacccttacgtaacccgaaaacggtaccgttggttaccggtacccgtacggtaccctaaccgttacgttcccgtttagttaccccg

SEQ ID NO: 191384 - DNA, 798 bp, Homo sapiens
  misc_feature: GYAE6OF01CSGIN.47.70.G04.1.454.CMB.1.raw
  modified_base (100)..(100): a, c, t, g, unknown or other
  misc_feature (100)..(100): n is a, c, g, or t
tcagagctcacgtacacgaccggtgctcgatttagtgtagtgtgaagggaaagggggagtcagtctcagtcaggacacagcatggacatgagggtccccntcagctcctggggctcctgctactctggctcggaggtgccagatgtgacactccagatcgacccagtcctccactccctcccgtgtcctgcctatcgtaggtaggacacgagacgtacaacctattcacgttcggcccgggataagtcgaagacgtactaattaaccgagtaccgttaatttaaagttaggtaactaccaaccgaaacggaaaaccgacggggaaaacctcccccttaaacttccgtagtaacttccgtagtcgaccgtaggtcctaacgttccgtaaggttttcgacgttaaaggtttcgggtaccgggtacccttaagtttccggttaacgggtttaccaagggttcggaaccgttagggtacggtaacgtttcggaacggggtaacttacggttactttccaaccttccgttaccgaacctagttaccgaacgtcgtaacgtcgtacgtaaccgtaacgttcggtaagtttactttacgaaccttaacctttactaccgtaacgttaacccaaacggttacggttaacccggtttacccggttaaccccgttacgttaaccggtttacgggaccccggtaaaaggggttaccccaaaggtacggtaaccctaacgttaaccgaaacggtccggttaggacccgttacgtaccgtaccctaacgttccgttgttaccgtttaaccc

SEQ ID NO: 191385 - DNA, 823 bp, Homo sapiens
  misc_feature: GYAE6OF01BA0M0.47.70.G04.1.454.CMB.1.raw
  modified_base (103)..(103): a, c, t, g, unknown or other
  misc_feature (103)..(103): n is a, c, g, or t
  modified_base (218)..(218): a, c, t, g, unknown or other
  misc_feature (218)..(218): n is a, c, g, or t
tcagagctcacgtacacgaccggtgctcgatttagtgtagtgtgaaggggaaaggggggagtcagtctcagtcaggacacagcatggacatgacgggtccccntcagctccgtggggctcctgctactctggctccggaggtcgaccagtatgtgaactatccaagactcgaaccctagtcctccacttccctcctgtctgctatcgtaggtaagganacagtacgtaccaacctatacctacgttcggaccgggactaagtcgaagacgtactaaacgttaacgagtaacgtttaaattttaaacggtgttaacaccaaacgaaacggaaaaaccggaacgggaaacctaccccctaacttcgtaagtacttactagtcgtactcgtactacgttccgtaggtttcaacgttaggtacgggttccggtacctagttaccggttgttacgagggtacgacggtagggtagtaaccgttcggggaacgtaaactagttacgttaccctacttaccgtaccaaccttgtacgaacgtcttaacgttccgaacgttaaccgtaacgttagttaaacgttttacgtttacccgtaaacctttaaacgtttaccgtaacgttaaccggaaacttaaacggttaaccgggtttaacccggtttaaccccgggtaccccttttaagttacccgggttacggaaccccggggtaaacggttaaaccgtacgtaaaccgggtaacttaacccggtaaagtaaaacccggtggttcccgttaaccggacttaccggaaccctacccggtttaacttcccgggtttcctacccg

SEQ ID NO: 191386 - DNA, 706 bp, Homo sapiens
  misc_feature: GYAE6OF01DIIK7.47.70.G04.1.454.CMB.1.raw
  modified_base (102)..(102): a, c, t, g, unknown or other
  misc_feature (102)..(102): n is a, c, g, or t
tcagagctcacgtacacgaccggtgctcgatttagtgtagtgtgaagggaaaggggggagtcagtctcagtcaggacacagcatggacatgagggtccccgntcagctcctgggctcctgttgctctggttcccaggttccagatgcgacatccagatcgacccagtctccatcttctgtgtctgcttctggtaggagacagagtccaccatcctacgttggtcgggcgtagtcgaggggttattagacctaacgttggttagcctaggtactacaaacaacgaaaccgagggaaacgtccccctaactcctactattcctactactgactacttcctactttcgactaaagggtccgggtacccatacgtaaggtcaggcggcaggtgactcgtagggaactgtacttttacacgttctacctatactacacgactacgtccctgaccgagtccttaaggtaatttagttttacggtaaactttaatttacgttacgtaaccgtaaacggtaacgggtttaaccttacggtttccccgtaccgttaccgtacccgggttacggggacgggtaacgggaaccggtagggttagggaactaaaggttaaacgaaaaggtccgtttaggggaccggtacttacgaaccttacccgttacgtttcccgttacggtttacctttaccgtaccgttccccgtttacccccg

SEQ ID NO: 191387 - DNA, 634 bp, Homo sapiens
  misc_feature: GYAE6OF01DWGVO.47.70.G04.1.454.CMB.1.raw
  modified_base (101)..(101): a, c, t, g, unknown or other
  misc_feature (101)..(101): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
tcagagctcacgtacacgaccggtgctcgatttagtgtagtgtgaagggaaagggggagtcagtctcagtcaggacacagcatggacatgagggtccccgntcagctccgtggggctcctgctactctggctccgaggtgccagatgtgacatccagatcgacccagtctccatccctccctgtctgcatctgtagganacagagtccaccatcactgggccggngagtcgaggggtcttgactaaagtgtcgtttcggccttggtttcagcagaccacgaggacgccctaagccgctgactctagtgtgcagtactactttgaactaaggtcgggtaccagtacgtaaggttcgaggcggacgtaaggtggtcgtagggacaggtacgttcactctacgtaactcagacggtcgtcctgacgacgccgtagaagttacttccgtagtaccttaactttacttactcgttacctacgtaagttagtacgttacgtccgttaccgttaccccggttcgggtaacccgtttccggaaccggtaaacggggtaaccgtaaacggggtaacgtaaacgttaaacccggaaaacgtacggttacgtaacggtcctaacgaccctaaccgtacgttaccg

SEQ ID NO: 191388 - DNA, 570 bp, Homo sapiens
  misc_feature: GYAE6OF01BMS5C.47.70.G04.1.454.CMB.1.raw
  modified_base (426)..(426): a, c, t, g, unknown or other
  misc_feature (426)..(426): n is a, c, g, or t
tcagagctcacgtacacgaccggtgctcgatttagtgtagtgtgaagggaaaggggggagtcagtctcagtcaggacacagcatggacatgagggtccctgctcagctcctgggactcctgctgctctggttcccaggtgccagatgtgacatccagatgacccagtctccatcctccctgtctgcatctgtaggagacacagtccaccatcacttgccgggcgagtcaggacattagctaatttatttagcctggtatcagacaagaaaccagggaaagttcctaagcctcctgatctatgttacatcctactttgacaagtttccgggccctatccttcgggtcaggtgcagtggatcgtggactagtatttccactcacacctatccagcagccctgaccacgcctaggaagtagttggttanactaactttattacctaagtaactaaaaagttataaacgacgttcgaccccgtctcctaccgtttccgggacgggtaacgggaccgtaagggtgggaacgtacgtaacgaaaacggtacgttacggaggtctggaccgtaaccg

SEQ ID NO: 191389 - DNA, 598 bp, Homo sapiens
  misc_feature: GYAE6OF01BNFAA.47.70.G04.1.454.CMB.1.raw
  modified_base (104)..(104): a, c, t, g, unknown or other
  misc_feature (104)..(104): n is a, c, g, or t
  modified_base (281)..(281): a, c, t, g, unknown or other
  misc_feature (281)..(281): n is a, c, g, or t
  modified_base (584)..(584): a, c, t, g, unknown or other
  misc_feature (584)..(584): n is a, c, g, or t
tcagagctcacgtacacgaccggtgctcgatttagtgtagtgtgaaggggaaagggggggagtcagtctcagtcaggacacagcatggacatgagggtccccgntcagctcctggggctcctgctactctggctccgaggtgccagatgtgacatccagatgacccagtcctccatccctcctgtctgcatctgtaggagacagagtcaccatcacttcggccgggcaagtcagagcaattaacagcgtaatttaaatggtatcacaagaaaccaggaacncccctaactcctgatctatcgactgctactcctagtttcgactagtaggtcgggccctagtcgttaaggttcaggtgacgaggtcggattcgtagggactagtactttcacctctacacctatcacgtctacgttctacgacctaacctgtaagttacttttacggacctaacgttactacgttcgtacaacgtagtaaccgttaccggttacccgtacgttaccgtttacggaccggtacgggaacctaacgtaggtaactaacgtacgaaacggtacgtacggtcgactacggtacacctntccgttgttacccg

SEQ ID NO: 191390 - DNA, 784 bp, Homo sapiens
  misc_feature: GYAE6OF01COXKT.47.70.G04.1.454.CMB.1.raw
tcagagctcacgtacacgaccggtgctcgatttagtgtagtgtgaagggaaagggggagtcagtctcagtcaggacacagcatggacatggacgggtcccccgctcagctccgtggggctcctgctactctggctccgaggtgccagatgtgacatccagatgacccagtctccatccctcctgtctgcatcgtggtaggagaccacacgtcacctatcctacgttcggccgggcgtagtcgaaggactagttagactaatttattacgccgttggtactcagacaacgaaaccgagggtaacttacgtaacgtcctctgtacttactacttacgttacacttaccttacgtttcgacgtaacggtttcccggggtaccctacgttccgtacgttacgtacggtcggtagtacggttgacgttcggtacgggtaactacggttactttaccgaccgttcctaccctaacctacgtaccgacgaccgtacgtccgtacgaccgacgtcccgtaaggtaacgttagtttacggttacgtaaccgtttaacgttttaaccgttaacgtttaacggtaaaacctaaaacgtttaaactaacccgtaaccggttaccccgtaccccgttaccgttaaccgtttacccgggttttaccgggaaacccggggtaaccgggtaaaccgggtaaagggttaccgggtaacgttaaacccgtaaacccggttaaaaccggttacgggttacgggttacggtacccgttaccggtacccgtaaccgtttacccgg

SEQ ID NO: 191391 - DNA, 698 bp, Homo sapiens
  misc_feature: GYAE6OF01C06EQ.47.70.G04.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccggaggtgccagatgtgacatccagatgacccagtctccatccctcctgtctgcatctgagganacagagtccaccatcacgttcggccggcaagtcagnactaataacagctaatttaattggtataccaacgaagaaaccgaagggaaccgtacccctaaacctccgtagacttactactcgactcgactacttcctagtttcgactaaggttacggtcgggttaccctagttcgtacgttcgacggttgacgtaggtggacttacggtacgggactaagttactttaccgacttcctaccaccgtactaccgacggtactaacgtcgtacgtacctaacgtagtaacgtttagttactaacttacgttaactaactacgtaactaacgtaacggttaaccgttaacccgtacccgttaacgtttacggttttacccgggaaacggtaacccgggtaaaccttaaacggtaacgggaaacctaacgttaaaccgaaaccggtaaccgttcggtaaccggtccttaaccggaaccttacccgttaactcccggtttcgttaaccc

SEQ ID NO: 191392 - DNA, 741 bp, Homo sapiens
  misc_feature: GYAE6OF01C3SQA.47.70.G04.1.454.CMB.1.raw
tcagagctcacgtacacgaccggtgctcgatttagtgtagtgtgaaggggaaagggggagtcagtctcagtcaggacacagcatggacatggacgggtcccccgctcagcctccgtggggctcctgctactctggctccggaggtcgccagatgtgacatccagatcgacccagtcctccacttcccgtccctgtctgctatcgtggtaggagacagacgtaccacctatccgtacgttcgggccgggataaggtcgaagacgactaattaacgaggtacgttaattttaaagttggtaactaccaaccgaaacggaaaaccgaacggggaaaccctacccccttaacctccgtagtaacttctaatcgcgtacgacctacttaccgttagttacgacgtaggttacgggtcggtaccctagttaccgttaggtcgaggtcgagtaggtggtacgtcggtacgggtaactagttacttccgtaactacctacctactactacgacgtacgtacgtacgtacgtaaccgtaaccgtagtaacgtttacgttacgtaacttaacttacttaacgttacgtaacgtaacgtaacggttaaccggttaacccggttacccgttaccgttaccggttaccggtaaccggtaacggtaaccgtaacgtacgtaacgtaacgtaacgtaaactacgggggggggggtactacggtaccgtacgtacctacgtacctcgttcgttaccg

SEQ ID NO: 191393 - DNA, 749 bp, Homo sapiens
  misc_feature: GYAE6OF01C2E3W.47.70.G04.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagagctcacgtacacgaccggtgctcgatttagtgtagtgtgaagggaaagggggagtcagtctcagtcaggacacagcatggacatgagggtccccgctcagctccgtggggcctcctgctactctggctccgaggtgccagatgtgacatccagatgacccagtctccatccctccctgtctgcatctgtagganacagngtcaccatcgacttggccggacaagtcagngcaattaacngacgtaattttaatggtactacaaccaagaaaccgagggaaaccaccccctaactctagactctatcgactcgctacgtacctagtttcgctaaggttacggtcggtaccctagttacgttacggtactaggtcggacgtaaggtcggttacgtacggtaggggtaaccttaggttaaccttttccgaccgtttacctaccctaaaccgtactaccgtaccgtactacggttccgtaacgtacccgttaacgttaggttaaacggttttccttttaacgaccctttaaaactttccgttaacgttcggtaaacccttaaacggttaacggttaacccgggttttaacccggtaacccccttttaagtttacccggtttaacggggaacccggtaaaccgggttaaaccgtaaacgttccggaaaaccttaaccggtactaaaaaccgggtcgttacggttacggaccttaaccggacctaccttaacttcccgttagtttacccc

SEQ ID NO: 191394 - DNA, 614 bp, Homo sapiens
  misc_feature: GYAE6OF01EDM8F.47.70.G04.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (273)..(273): a, c, t, g, unknown or other
  misc_feature (273)..(273): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgggnaagtcagagcattaacagcgtatttaaatgtatcaccagaaccaggaacnccctaactcctgatctatgctgcatccagtttgcataggtcgggtccagtctaggttcagtggcagtgatctgggacagtatttcactctacacctatcagcagtctcgaccaaccgttgtaaagttattttacgacctaaactttaaccttacgttacgtacctaaacgacggttaacggtttaacccggttacccccgttaccttaccgttttaccgggaacccgttaacggggaaccctaaaacggttacgggaacctacgttaaccgtaaaaccggtaaccgttaaggtcgggtaccgttacggaccctaacccctaagttcccgtttggtttaccc

SEQ ID NO: 191395 - DNA, 552 bp, Homo sapiens
  misc_feature: GYAE6OF01EY5XS.47.70.G04.1.454.CMB.1.raw
  modified_base (223)..(223): a, c, t, g, unknown or other
  misc_feature (223)..(223): n is a, c, g, or t
  modified_base (413)..(413): a, c, t, g, unknown or other
  misc_feature (413)..(413): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggnagtcgagggtcttgacaaatgctttggccttggtttcagcagacaccgagggaacgcccctaagcgcctgatctatggtcgctatactactttgacgtaaaggtcgggtccatcgtaaggttcaggcggacaggtagtcgtgggacaggtacttcactctcactatcgagcgcctgcacgtctagaagtnttcagtactaactttactactcgtctaccgtaagtatgtattcgtcttacccgtcgtaccgtttcggaccgtaagggacctaagggtaggtaaactacgaaacgtaattacggtcggtacgtagcctaacgtgttaccg

SEQ ID NO: 191396 - DNA, 735 bp, Homo sapiens
  misc_feature: GYAE6OF01B6PL9.47.70.G04.1.454.CMB.1.raw
  modified_base (233)..(233): a, c, t, g, unknown or other
  misc_feature (233)..(233): n is a, c, g, or t
tcagagctcacgtacacgaccggtgctcgatttagtgtagtgtgaaggggaaaggggggagtcagtctcagtcaggacacagcatggacatgagggtcccccgctcagctccgtgggctcctgctactctggctccgaggtgccagatgtgacatccagatcgacccagtctccatccctccctgtctgcatctagtaggagacagagtccacctatccacgttcggaccggnaacgtcaaggagactaattaacgagacgttaatttaaagttggtactaccaaccaagaaaaccgaagggaaaccgaccccctaacctacctagtacttactatcggctgacctactccgtagtttgacgtagttacgggtcggggtacccctagttaccggttaaggttcgtacggttcggacgtagggttacggtattccgggtacgggtaacgtagttacgttttacctaccttaccctacctaaccgtaacgtccgtaacgtaccgtacgttcctacggtaccctaaccggtagttaaacgtttcgtttaacgacttaaacgtacttaattacgtacgtactaaacgtagtaactaccgtaattaaccctacccttaccccgttaacccgttccggacccgttaaacgggtaaccgtaaaggttagtaacgttaacgtaaacccgtaaaaccggtacgttacgggtacggtaccccgtcgtaacccgtaccgttaaccg

SEQ ID NO: 191397 - DNA, 773 bp, Homo sapiens
  misc_feature: GYAE6OF01DXZHE.47.70.G04.1.454.CMB.1.raw
  modified_base (207)..(207): a, c, t, g, unknown or other
  misc_feature (207)..(207): n is a, c, g, or t
tcagagctcacgtacacgaccggtgctcgatttagtgtagtgtgaagggaaaggggggagtcagtctcagtcaggacacagcatggacatgagggtccccgctcagctccgtggggctcctgctactctggctccgaggtgccagatgtgacatccagatcgacccagtcctccacttccctccctgtctgctattcgtagtagganactagacgtccaacctatcctacgttcggccggactaagtcgagacgactaattaacgagtacgttaaattttaagtcggtaactaccgaaccgaaaacggtaaaccgaaaccggggtaaaccctaccccccgttaaacctccgtagtaacttacgtaacgtcgtaccgtacgtacctacgttaccgttagttttcgacgttaacggttacggggttacgggtaccccttaagttcccgggtttaaggttaccgtaggtcgggtacgtaagggttcggtaacttccgggtagggaaccttacggtttaactttccgtaccttactaaccgtactacgtaccgtagtacctaacgtcgaacgtaccgtaacttaagtaatttactttacgtaacttaaccgtttaactctaacgtaccgaaacgttacggtaacccggtttaacccgtaacccgttgttaacccggttacggaacccggtaaggtaacccttaaagggacgtaaccgtaaacgtaccgtaaacgtcgtcggtaacgcctacgtaaccgtatccgttcgtcttacccg

SEQ ID NO: 191398 - DNA, 959 bp, Homo sapiens
  misc_feature: GYAE6OF01CL6JF.47.70.G04.1.454.CMB.1.raw
tcagagctcacgtacacgaccggtgctcgatttagtgtagtgtgaagggaaaggggtctgggagaggagcccagcactagaagtcggcggtgtttccattcggtgatcagcactgaacacagagactcaccatggagtttgggctgagcttgggtttcctcgttgcttctttaagaggtgtccagtgtcaggtgcgccgtggtggaggtcggggggaggcggtcgggtccaggccgtgggaccgtccctgagactccgtcctgtgcacgtcctcgtggtccttcaccctttacaaattaaatttatcgacttaattcggacgtacggttccggggtccccgaccgacgggtccctaccggacgggacgaaagggggtcttaagggaggggttcgggggtgggtccggtacgtaagttaccgttccgggtaacccgtaagggttccgggtaacttaactttcccgttttacgtaaacggttaacgtttaacccggaccgtaaacggtaccccgttaccccggttggggaacccgggggtcccggttaaacttccccgaaacccgttacgttacccccgtaaccgtaaaccgggtaaccgtaaaacccgttaaaaccccgtttaccccccggaaacgggtaaaacccgttaaaccccgggttacctttaacccgtttaccccgtaacccggttaaccccctaaacccccggtttacggtaaaacccccgtaacccggggttaaccccgtttaaaccgggggaaacccttaaaacccgggtaacccggggtaaacccgtaacccccgttaaaccgtttacccgttaacccctttacccgttaaaccccgttttaacccgtgggtttaaccgggaacgggttaaacggtaaacgggttaacgggttaacccggtaacccggttaacgtttaccggtaacgtttggggttacgggttaaacccg

SEQ ID NO: 191399 - DNA, 791 bp, Homo sapiens
  misc_feature: GYAE6OF01DLR6T.47.70.G04.1.454.CMB.1.raw
  modified_base (105)..(105): a, c, t, g, unknown or other
  misc_feature (105)..(105): n is a, c, g, or t
  modified_base (131)..(131): a, c, t, g, unknown or other
  misc_feature (131)..(131): n is a, c, g, or t
  modified_base (439)..(439): a, c, t, g, unknown or other
  misc_feature (439)..(439): n is a, c, g, or t
tcagagctcacgtacacgaccggtgctcgatttagtgtagtgtgaaggggaaaggggggagtcagtctcagtcaggacacagcatggacatggacgggtccccgntcagctccgtgggctcctgctactcnggctcgaggtgccagatgtgacactccaagatcgaccctagtcctcctactccctcctgtctgctattcgtaggtagacgaacagacgtccaacactccgagttcggaccgggactaagacgaggactaactaacaacggtagttaactttaaagttaggtactaccaaccaaacggaaaaccggtaacggaacccgtaacccctactaccgtgtaactaccgttagatccgctacgtacctacgttagttacggacttaacgtaagggttccgggtaacctaccgttaaggttcggtttaagacggnggtacccgtaagggtacgttacgtacggttaacggaaggttaccttaacggttaccttaccaaccgttaccaccgtaactcaacggtacacgttacgtaccgaacttaacgtacgttaactttacgttaaccttaacgttaaccttaagtttaagtaacccgttaacggaacctttaaacgggtaacccggttttaaacccccggtcccgtttaaaccggttttaaccgtttacggggaaccccggtaaacccgggtaaacgtaaccgtaaacgaaacggtaaacgtaaaccggtaacgtaacggtcggaacgtacggtaccacgttacctacgtcgttacttcggtaaccc

SEQ ID NO: 191400 - DNA, 615 bp, Homo sapiens
  misc_feature: GYAE6OF01CYL04.47.70.G04.1.454.CMB.1.raw
  modified_base (342)..(342): a, c, t, g, unknown or other
  misc_feature (342)..(342): n is a, c, g, or t
tcagagctcacgtacacgaccggtgctcgatttagtgtagtgtgaaggggaaagggggggagtcagtctcagtcaggacacagcctggacatgagggtccctgctcagctcctggggctcctggctgctctggctctcaggtgccagatgtgacacccagatgacccagtcctccatccctcccgtgtcctgcatcgtggaggacgacaggtactcaaccatctacttggccagggacgagtcaaggacagttacgactaattaatttaaaattaggtatacgaagacgaacgaaaccgaagggaaactaccccgtaaagcctacctagactacgtagactnacaactacctaagttacggaaacgacgggtacccagtaacgtaaggttacgaggtaggaagtagagtcggaggtactagttatttacttacgactactacaggtacacggcctagcaacgacgttagaacgtattaagtacgacaactagttaatactagtacaaagtataactactaattaaccgtcctacccgtacgtttccggaccgtacggaaccgtaagtagtaatacgaactaacgaacgtacgtgggactaggtaccactcgtacg

SEQ ID NO: 191401 - DNA, 698 bp, Homo sapiens
  misc_feature: GYAE6OF01CXGM6.47.70.G04.1.454.CMB.1.raw
  modified_base (146)..(146): a, c, t, g, unknown or other
  misc_feature (146)..(146): n is a, c, g, or t
  modified_base (214)..(214): a, c, t, g, unknown or other
  misc_feature (214)..(214): n is a, c, g, or t
tcagagctcacgtacacgaccggtgctcgatttagtgtagtgtgaaggggaaagggggagtcagtctcagtcaggacacagcatggacatggacgggtccccgctcagctccgtggggcctcctgctactctggctccggaggtcnccagatgtgacatccaagactcgaccccagtcctaccacttccctccctgtctgctatcgtggagganacagactcaccatcgacgttcggaccggactaagtcgaggacgactaagttaacaggtacttaattttaagtgtactaccaacgaacggaaaaccgacgggtaaacccaccccttaacctccgtagtacttactagtcgtaccgtgtacctacttacgtaagtttcgacgtagggttacggtcggttacccttagttacggtacggttacgtaggtacgggacgtagggtcgtatcgggttaagggacttaaggtttactacctacgtcctaccaacgttacgacgacgtacgtaccgtactacgtaaactacgttaagtagtttaactacctaacgttaaccttatacccgtagtaaccgaacgttaccggttaacccgtttacccgtaccgttatttaccggtacggaccgaacggtaaccacgtagaacctctaacgaacctgtcggtacgtcaccctacgtaacctacgttcgaccgttc

SEQ ID NO: 191402 - DNA, 644 bp, Homo sapiens
  misc_feature: GYAE6OF01CLTVV.47.70.G04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
tcagagctcacgtacacgaccggtgctcgatttagtgtagtgtgaagggaaaggggggagtcagtctcagtcaggacacagcatggacatgagggtcccccgctcagctccgtggggctcctgctactctggctccggaggtgccagatgtgacatccagatcgacccagtcctccactccctccctgtctgcatcgtgtagganacagagtccacatcgacgttcggccgganaagtcagngactaataacgagtacgttaatttaaagttgtactaccaacgacgaaaaccgaggaaaccnccccctaactcctagtactctacgcgactcgactacgtcgtagttcgactaggttcgggtccggtacctagtcgttacggtcgaggtcgacgtaggtcgtacgtcggtaggactaagttcttaccacttacctaacaccgtatcgaacgtctacgtctacggacctaacgtagtaacgtttactttacgaacttaaccttactacttacgtacaaacggttagtaacccgttaccccgtaaccgttacttacggttcggaaccggtaacggaacctacgtacggactaaacgtacaaacggtgtacggtcgactcgaacctcgttactccgttcgttaccc

SEQ ID NO: 191403 - DNA, 747 bp, Homo sapiens
  misc_feature: GYAE6OF01ADB22.47.70.G04.1.454.CMB.1.raw
  modified_base (198)..(198): a, c, t, g, unknown or other
  misc_feature (198)..(198): n is a, c, g, or t
  modified_base (729)..(729): a, c, t, g, unknown or other
  misc_feature (729)..(729): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctggtagganacagacgtcaccatcacgttcggccgggacaagtcaaggacgactaattaacaggaccttaaattttaaagttggttaataccgaacccaaaggtaaaacccgaacggggtaaaaccccgtaccccccttaaacctcccgtagtaactccgttatcggaccttagacctaacttcccgtagtttacgacctaagttacgggtccgggtaccctacgttcggttaggttcgacggttgggactaggtaggtatcggtagggacgtaagttactttacgaccttaccgtacctacctaacgtacgacgtaccgtaacgttccgtacgtacctaacgtaggttaacttacgttttacgtactaacctttctaacttacgtaaccaacgtagttaacccggttaacccggttaccccgttatttacccggtttacgggaacccgggtaaccgggtaacctaaaccggtacggtaaacgtaaccgtaacccgtaaacggttacgttacggtacggacctacgtacctaacccggtnttccggttaccgtttccg

SEQ ID NO: 191404 - DNA, 789 bp, Homo sapiens
  misc_feature: GYAE6OF01DMD75.47.70.G04.1.454.CMB.1.raw
  modified_base (188)..(188): a, c, t, g, unknown or other
  misc_feature (188)..(188): n is a, c, g, or t
tcagagctcacgtacacgaccggtgctcgatttagtgtagtgtgaaggggaaagggggagtcagtctcagtcaggacacagcatggacatggacgggtccccgctcagctccgtggggctcctgctactctggctcggaggtcgccagatgtgacatccagatcgaccagtctaccactccctccctntctgctattcgtaggtaggacgaccactagtaccaacctatctacgtcggccgggactagtacgaggatacttagacttaaatttagttacgtaccgtaggtactacgacgaaccgaaacgtaaacccggtaaagggttaaacgtttaccctaagtccgtaccgttagaccttcgttaagtacgttaacaccttccttaacgttcggtaacgttaaccggttacccgggtaccttaggttccgtttaccggttagtacgggttcggtacgtaggttaggtacgtacggttagggaccttaagttaccgtttactacttcctaccgacctatccgagtccgtaccgtaccgtacggtccgtacgtacgtacggtaacgttgttacgttaacctaccgtttaaagtttaactaacgttaaagtaaaccttaaaacttaacgtaaccgtaaccggttcccgtacccgttacggttaacccgttcgggttaccgggtaaacgggtaaccgggtaacgggtaaacgggttaacgggaccgttaaacggtaacccgtaaaacggtcgttaacgggtcggtaccctaacggtccctaacggtttaccg

SEQ ID NO: 191405 - DNA, 838 bp, Homo sapiens
  misc_feature: GYAE6OF01A6D0J.47.70.G04.1.454.CMB.1.raw
  modified_base (201)..(201): a, c, t, g, unknown or other
  misc_feature (201)..(201): n is a, c, g, or t
tcagagctcacgtacacgaccggtgctcgatttagtgtagtgtgaagggaaagggggagtcagtctcagtcaggacacagcatggacatgagggtccccgctcagctccgtggggctcctgctactctggctccgaggtgccagatgtgacatccagatcgacccagtctccatccctccctgtctgctatctggtagganacagacgtccaccatccaccgttggcccgggcgtagtcgagggtcgttagactaaagtcgtcgtttcggccttggtttacgacgacgaacgaccaaccggaaggggtaacccggaccccgtaaacggccgtcccgttacgacttacccgttaagttcgggtacgtactaacgttaaccttacgtttacggaaacgtaaacgggttccgggtacccctaagttaccggtaaaggtttaccgacggtccgggacgtaacgggttacggtacccggtagggaaacgtacggtaggtttaccctaaccgttacctaccgtaacccgtttactaccggacggaccccggtccgttacggtaacccgtaacggtccccgtaaggtaacgtttacgttacgttaccggtacctttaaaccgttttaacttaacccggtttgtaacccgtttacccgtaggtttaacgtacggttaacgttacccgttaccgtttaacccccggtttaccggttaccggtttacccgggtaaacccgggtaacgggttaaacccgggtaaggttaaaccgggtaaaaccgttaaccggtaaaacccgtaggttacggtaccgttacgtaaccggtccttaaccgtcctttaccgg

SEQ ID NO: 191406 - DNA, 719 bp, Homo sapiens
  misc_feature: GYAE6OF01EGUNP.47.70.G04.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
tcagagctcacgtacacgaccggtgctcgatttagtgtagtgtgaaggggaaagggggggagtcagtctcagtcaggacacagcatggacatgacgggtccccgctcagctccgtggggctcctgctactctggctccgaggtgccagtatgtgacatccagatcgacccagtcctccactccctccctgtctgcattcgtgagganacagacgtaccactatctacgtcggaccggganaagtcgagagactaattaacagtacgttaattttaaagttgtaataccgaacgaaacggaaaccggaacgggtaaaccctacccccttaaccgtcctagtacttactacgcgtactgtacctacttccgtagttcgtaataacggttacgggtccggtaccctagtttacggttacggtaggtacggttcggacggttacgggtaggtacgttaccgggaggggtaacttacggttacctttaccggaccttacctacccgtaacaccgtacgagtaccgtacgtcgtacgaacctaagtacgttaagtttacttacgaacttactactacgtacgacctaaggtaccgtaaccggttacccgttaaccttacgttaccggttacgacccgggtaacggtaaccgtaagacggtaaacctaaccgttaaccgaaacggtgtaccggtagactaccgtacaccttcttccgtcgttaccc

SEQ ID NO: 191407 - DNA, 866 bp, Homo sapiens
  misc_feature: GYAE6OF01EAWO9.47.70.G04.1.454.CMB.1.raw
tcagagctcacgtacacgaccggtgctcgatttagtgtagtgtgaaggggaaagggggggagtcagtctcagtcaggacacagcatggacatggacggggtcccccgctcagctccgtggggcctcctgctactctggcctccggaggtgaccagatgtgacatccgagatacgaccctagtcctccactccctcctgtcctgacctagtcgtaggtaacggacgacgaggtactccaacctatccgtacgttccgggacccggggtaacctaaggtccgaaaggacctaacttaacgttaaaccgaacggttaacgttttaaagttttaaaagttaccgggttaactaacccggaaaccgtaaaccggaaaaacccggggtaaccgggaaaccccccttaaccccccgtttaacccgtacgttaacggttaaccttacgtttaccgtcggtaccgttcaccctttaccgttacgtttaaggttcgaacggttaggtaccggggttaccggttaccctagttccgggtttaacggttaccgtagggtcggtaacggtagggttacggtacgttacgggtaagggtaactcgtttaaccgttcctaacgttcctaacccgaaccgtcgtacgctaacggtcgtaccgtacgtaacgtaccgtaaggttagtttaccgttaacttaacttaactttacgtacgtacttaaccgaacggttaccggtacccgggtttaaccgtacccgttaacgttaccggttacccgggaacgtaaccggtaacgtaacctaacggaaccgtaaacctaggtaaccgttacggcgttcggaacccgtttcgacttaccgtacgttcctcggtttaacc

SEQ ID NO: 191408 - DNA, 814 bp, Homo sapiens
  misc_feature: GYAE6OF01CVRMN.47.70.G04.1.454.CMB.1.raw
  modified_base (246)..(246): a, c, t, g, unknown or other
  misc_feature (246)..(246): n is a, c, g, or t
tcagagctcacgtacacgaccggtgctcgatttagtgtagtgtgaagggaaagggggagtcagtctcagtcaggacacagcatggacatgacgggtccccgctcagctcctgggctcctgctactctggctccgaggtgccagatgtgacatccagatgacccagtctccatccctcctgtctgcatctgtaggagacagagtcaaccattaccacgtttcggacccgggtactaaggtccaaggngtactaaatttaaccgaggtacgttaaattttaaacgtttagggtaactaccaaacccgaaaggaaaaccccggtaaaggggtaaaccccgtacccccccttaaaccgtttaccccgtagtaacttaccgtaacgttcggtaccgtcggtacctaacgttaccccgttaaggttttcgaaccgttaacgggtttaacggggttcccgggggttaacccttagttaccggtttaaacggggtttcccgaaaggttcgggtaccgtaagggttcggttaacgtcgggtacgggaacttaggttaaccgttttcaccgttactaccgtaacctacgtaccacgacctagtacgaacgtacctaacgttagtaacgttactttacgtaacccttaacttacttaaccttagaacctaaacgtacggttaaccgttaccgttacccgttacgttaaccgtttacggaaccgtaacggggtaaccctaaacggtacgtaactaaacgtaccgtaaaacggtacgttacggtacggtaccgtaaccgccaaccgttactccgtttacggttaccc

SEQ ID NO: 191409 - DNA, 813 bp, Homo sapiens
  misc_feature: GYAE6OF01DF1U5.47.70.G04.1.454.CMB.1.raw
tcagagctcacgtacacgaccggtgctcgatttagtgtagtgtgaagggaaagggggagtcagtctcagtcaggacacagcatggacatgacgggtccccgctcagctcctgggctcctgctactctggctccgaggtcgcagatgtgacatccagatcgaccctagtctccactcctccctgtctcgactattcgtaggtaaggacgacaggacgtaccaaccagtccgtaccgttcgggacccggggactaaacggtacgaacggtactacgtaaacttaaaccgaggtaaccgttaaattttaaaacgttcggtaactaaccgaaccgaaacggtaaaacccgaaacgggaaacccgtaacccccctaaccgttccgtaacgtactccgttaagtcgtaccgtacgtacctacgttccgttaaggtttacgacgttaacgggttacggttccggggtaacctacggttaaccgttacgggttacgtagggtacggacgtacggtacggtagttacgggtacggtaaccgtaagtttacgttaccgtaccttaccgtacctaacccgtaactacgtacgtaccgttacggtaccgtacggacccttaacggtaacggttaactttacggtttactaaccgtttaaccttaaccgttacgtaccgttaaaccgaaacgtaaccggtttacggttaacccgttacccgtttaccttacggtttaccaacccggtaggtaaaccacggtacgtaacaaccgtaaccgaacggtcgtacgttacgccgtactacctacctcgttcgttactcccg

SEQ ID NO: 191410 - DNA, 651 bp, Homo sapiens
  misc_feature: GYAE6OF01BJ3MO.47.70.G04.1.454.CMB.1.raw
  modified_base (640)..(640): a, c, t, g, unknown or other
  misc_feature (640)..(640): n is a, c, g, or t
tcagagctcacgtacacgaccggtgctcgatttagtgtagtgtgaaggggaaagggggagtcagtctcagtcaggacacagcatggacatgaggggtccccgctcagctcctggggctcctgctactctggctccgaggtgccagatgtgacatccagatcgacccagtctccactccctccctgtctgcatctggtaggagacagagtcaccatctacgtcggaccgggacaagtcaagagactaattaacgagtacgttaaattttaagttcggtaactaccaaccgaaacggtaaaaccgaacgggaaaccctaccccctaaacctccgtagtaacttcgtagtcgtctacgactactctaggtttcgacgtaggtacggggttccgggtacctacgttcggttacgtcgtaggtggtcgtaggtggtcgtacggtaggatacgttacgttacacttaccgactacactacgcgtactacgtactacgacgtaactaggttaactttcgttacaaccttaacttactacgtactaacaacgtacggtaacccgttaaccgtacccttaacgttgtacccggacggtaacggaactacggtatacgaactacgaacgtgacgtcgactacgactacgnttcgtcgttac

SEQ ID NO: 191411 - DNA, 804 bp, Homo sapiens
  misc_feature: GYAE6OF01B4MGN.47.70.G04.1.454.CMB.1.raw
tcagagctcacgtacacgaccggtgctcgatttagtgtagtgtgaagggaaaggggggagtcagtctcagtcaggacacagcatggacatgagggtcccccgctcagctcctggggctcctgctactctggctccgaggtgccagatgtgacatccagatcgacccagtcctccatccctcctgtctgctatctgtaggacgacagacgtacaccatcacgttcggcccgggacaagtcgagacgactaacttaacgagtaccgttaaattttaaagttggtaacttaccaaccgaaacgaaaaccgaacgggaaaacccgtacccccctaaacctccgtacgtaacttctaacgtgtcctcgacctacttacccgtagtttacgacgttacgtacgggtccgggttaccctaagtttccgtaaggtttacgaaggttcggaccggttaaggtggtacttaccggtacgggtaacgtaacgttaccgtttaccgtaacccgttctaacccgtaacctacgtaccgaacgttccgtaaccgttccgttaacgaaccttaaaccgtaggtttaaactttacgttttacccgaactttaaaccgtttacgttaccgttaacgtaccctaaacggtacggtttaacccgggttttaacccccggttaacccgttacgttacggtttaccccggaaccgggtaaacccgggtaaacctaaaccggtaacgtaaccgtacgtaacccgttaaacggtccggtacggtacctaccgtactaccgtaaccctcgtttccgtaccggtttccc

SEQ ID NO: 191412 - DNA, 732 bp, Homo sapiens
  misc_feature: GYAE6OF01D57PB.47.70.G04.1.454.CMB.1.raw
  modified_base (323)..(323): a, c, t, g, unknown or other
  misc_feature (323)..(323): n is a, c, g, or t
tcagagctcacgtacacgaccggtgctcgatttagtgtagtgtgaagggaaaggggtctgggagaggagcccagcactagaagtcggcgttgtttccattcggtgatcagcactgaacacagaggacctcaccatggagtttgggctgagtcttgggtttttccctcgttgtcttcgtttttaaagaggtgtcctagtgtcaggtgcagtctggtggagtcggtgggggaggcggtggtccacgcccgtagggaacgtccctgaagtcctctccgtgtcgacaacgttctgtacttcaccttcacgtaccctacggctagtcncgtaccggtcgggtccccgtaccgacggtcctccggaagggacggaacgggggtcgtgggtaggtacgggttctacgacgggtgtagttgggttggtaggttcgggcgaccgtaacggactaacggtactttaacggtaaccgtcccgtggaccgtacgggtaccgtttagtttacctttaagtcctacgacgtaacgaacccttaactaccgaaacgtaacctacttaccgtagtactttcgtacgtacgtacgttacaaccgtagtacggtacgagtacggtaccgaacgccgtacggtacctttaacgttaagtttacttggttagttaacggtagggtagttgggtaacgtccgttaacggtcggtttaccggggtacggggcccgggtaccgtcgggtaccccg

SEQ ID NO: 191413 - DNA, 854 bp, Homo sapiens
  misc_feature: GYAE6OF01AKQGL.47.70.G04.1.454.CMB.1.raw
  modified_base (144)..(144): a, c, t, g, unknown or other
  misc_feature (144)..(144): n is a, c, g, or t
  modified_base (162)..(162): a, c, t, g, unknown or other
  misc_feature (162)..(162): n is a, c, g, or t
tcagagctcacgtacacgaccggtgctcgatttagtgtagtgtgaaggggaaaggggggagtcagtctcagtcaggacacagcatggacatgacgggtccccgctcagctccgtggggctcctgctactctggctccggaggtnccaggatgtgacatccanatgacccagtctccactccctcccgtgtctacgctatcgtaggtaggagaacaggactcacctatctacttgggcccgggactagtcaggacgactactaacacggacttaattttaaagtggttaacgtaccaaccgaaacgaaacccggaaacggggaaaccgtacccccctaaccctaccgtacgtaacttacctaagttgccgttacgcttaccgtacttacggttagtacgtaacgttcgggtacccgggtaccttaacgttacggttacggtccgtaaggtcggtacgtacggtaggtaccgttacgggtacggtaacctaggttccttaacgtaccgtcctttaacccgacccttaagtacctacggtacccgtacgtttaaccgtccggtaaacccgttaacccgttaaggttaaccggttttacggttttaaccctaaacggtttaaccccttttaacgtaccgttaacgtaaccgttaaacgtacccgggtttaaaccccgttaacccgggggtttaaaccccctcggtttaaccggtttaccgggtaaacccgggtaaccgggtaacccgtaacggtaaaccgtaccttaaaccggtaaacccggaaacttaccggggttaacggtaccgttaccgttaaccgacccgtttacccgtacctttccgttaccggtttacccc

SEQ ID NO: 191414 - DNA, 838 bp, Homo sapiens
  misc_feature: GYAE6OF01EDWGB.47.70.G04.1.454.CMB.1.raw
tcagagctcacgtacacgaccggtgctcgatttagtgtagtgtgaaggggaaagggggagtcagtctcagtcaggacacagcatggacatggacgggtcccccgctcagctccgtggggcctcctgcctactctggctccggaggtcgccagatgtgacatccagactcgacccagttcctcctactcccttccctgtctgctatcgtaggtaggacgaacgagtacgtaccaacctacttctaaccggttcggaccgggactaacgtacaggactactaaagttaaaccgagtaacgttaaagttttaaacgttcggtaaacttaccaaaccgaaaacggtaaaaacccggaacggggaaacccctaccccccgttaaaccttaccgtaggtaacttcgttaacgtcggtcctacgtacctacgttacccgttagtttcgacgttaaggttacgggttaccgggtacccttaagttccggtttaacggttaccggtagggtacggtacggtacgggttacgggtaacggttccgggtaaaggggtaacctttacgttaccttttacccgactaccgtacctaccgtacgtacacgtacgtacgtactacgtaactaacgtagtaacgtttactttacgaacctttacttaactacgtacgtaacgtaaaccggttacggttaacccgggttaacccggttaacccggttacgtttaccgggtttacggaacccggtaacccggggaaaccttaacgggtaacgtaaccgtaaacgttaaccaacggttaaccgcgggttaacgccgttactaccctacttacttccgtcgtttaccc

SEQ ID NO: 191415 - DNA, 706 bp, Homo sapiens
  misc_feature: GYAE6OF01E34EL.47.70.G04.1.454.CMB.1.raw
  modified_base (673)..(691): a, c, t, g, unknown or other
  misc_feature (673)..(691): n is a, c, g, or t
  modified_base (693)..(706): a, c, t, g, unknown or other
  misc_feature (693)..(706): n is a, c, g, or t
tcagagctcacgtacacgaccggtgctcgatttagtgtagtgtgaagggaaaggggctggagtgggtggcatttatatggtacgatggaagtaattattactatgcagactccgtgaggggccattcaccatctcagagacaattccaagaacacggtgtatctgacaaatgaatagcctgagagccgaggacacggctgtgttattacgtgtgtagagagtagttaggtaattgggaaaccttccggtacgtaactactactaaccttaactaactagtacggtaccggtcggtacgggggaacgtaaaaaccgggaccgaaccggtacctacccgttacccgtccctaccaccgtcccctaacccgaacccggtaaccgggcccctaaccggttcccggttcccctttcccccggtcggtacccctaacccccgttacccgtaacccgaaacggacgaccctaaccgtaccgggtcggggggaaccctaccggacgggccccgggtccccggtggggtcccgttacgggtaccccgtttacgggtaaccggtaaacgggttaccctttaccccggttttacgttaaccgggtcggtaaccgtttccgtacgacggggtacgggtccggggacggttccgggaaacggaccgggtaccgagtaagtacgcgnnnnnnnnnnnnnnnnnnngnnnnnnnnnnnnnn

SEQ ID NO: 191416 - DNA, 924 bp, Homo sapiens
  misc_feature: GYAE6OF01EM3OC.47.70.G04.1.454.CMB.1.raw
  modified_base (104)..(104): a, c, t, g, unknown or other
  misc_feature (104)..(104): n is a, c, g, or t
  modified_base (780)..(780): a, c, t, g, unknown or other
  misc_feature (780)..(780): n is a, c, g, or t
tcagagctcacgtacacgaccggtgctcgatttagtgtagtgtgaaggggaaagggggagtcagtctcagtcaggacacagcatggacatggacgggtccccgntcagctccgtggggcctcctgctactctggcctccggaggtcgccagtattcgtacgaacactccgagtacgtaccgaccctacggttcctacctaccttccccgttcccgttggttcctcggtacctacgtttccggttaaggggtaagggaacgaaccgtaaggtaaccgttacccaaccctacttaccgttacccgggttccgggggccccggggtacggtacggttaccggggtacggggttaccgtttaacggacttaaacggtttccggtttccggttttccggtccggttttacggtttacgacgtaccggaaccggaaccggtaacccgggaacgggtaccccggtacccaacggccgtaccgtaggttaccgttacggttggtaccggtacgtacttaaacttaccgtttacggttacgtaaaccggttaccggggtacccgttcgtaaaccgttacggttaaccggtaccgtacgggtacgggtaacggtaacgggttacggggtacgggttaacgggaaccgttttaacggtacccgtttaccttacccgtttaacgtacccgttacgtaccggtaccggtaccgggtccgttcccgaacgtacgtaccggtaacgtagttaccggttcttaccgtagttaaaccctttacgtttacccgttacncggttacccttacgtagttacgttccgttaacccgttcgttaccccgttacggtaccggttaccacggttaagggaacgttaaccggaagttacaaacggttacaagggttactacggtacgactaccgtacgtcttggttccg

SEQ ID NO: 191417 - DNA, 822 bp, Homo sapiens
  misc_feature: GYAE6OF01BRA99.47.70.G04.1.454.CMB.1.raw
  modified_base (150)..(150): a, c, t, g, unknown or other
  misc_feature (150)..(150): n is a, c, g, or t
  modified_base (207)..(207): a, c, t, g, unknown or other
  misc_feature (207)..(207): n is a, c, g, or t
tcagagctcacgtacacgaccggtgctcgatttagtgtagtgtgaagggaaaggggggagtcagtctcagtcaggacacagcatggacatgagggtcccccgctcagctccgtgggctcctgctactctggctccgaggtgccagatgtnacatccagatcgacccagtctccatcccctcccgtgtcctgcactcgtaggtagganaacacgataccaaccattccgacgttcggcccgggcgtaacggtacaacgggtaactagtttacggaaccttaaattttaagttacgccttaggtatccgaagacgaaacgaaaccggtaagggtaaaacttcccgtaaagtcctccgttagtacttactaacgtttacgtaactaccttacctaacgttttacgaacttaaccggtttaccgggtacccgttaacgtccggtttacggtttaccgaggttacggaccgttagggtagtacgttcggtaacggggtacttaacggttacctttacctaaccttaccctaccgtaacccttaacgtaccgtaacgtaccgtaacgtcccgtaaccggtacgtacgacccgttaagggaaacgttacgttacggtttaacgtaacgtttaaaactttaacgtttaaacgttaacgaaaactaaaaacgttaactaaaccgttaacgtacccggtaccccgtaacgttacccggttaccggttaaccggggaacgggtaaccgggtaaccgtaacggggtacgtaagtacctaaaacggaaaccgtttaacgtccggtacggtacgtacccgttaccgacccgttacg

SEQ ID NO: 191418 - DNA, 764 bp, Homo sapiens
  misc_feature: GYAE6OF01E5MXK.47.70.G04.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
tcagagctcacgtacacgaccggtgctcgatttagtgtagtgtgaagggaaagggggagtcagtctcagtcaggacacagcatggacatgagggtccccgctcagctcctggggcctcctgctactctggcctccggaggtcgccagatgtgacataccagatcgaccctagtcctccactccctcctgtctgcattctggtagganacgagacgtcaccatcacgtcggccgganaagtcaagngactaagttaacagtacttaagttttaatacggtactaccgaaccgaaacgaaaaccggacgggtaaacccgtacccccttaacctacgtacgactttaccgtatcgtcgtcgacctacgttccgtagttcgacgtaggttaccgggtcgggttacctacgttacggttacggtacgtagggtacggtacgtacgggtaggttaccttcgggtacgggtaactaggtttacctttaaccgtaccgttcctaacccgtaccctacgttaaccgacggtccgtaacgttccgtacgtaaccgtaaccgttaagtaaccggttttattaaccgtaaccttaacgttaccttacgtagtaaccgaaacggtacggtttacccggttaaccccggtacccgttaacgtttaccgtaccgggacgtaaccggtaaaccctaaggaccgtaacgtaacctaaagggtaaaccgtcgtacggccgtaccgtacgtaaccctacccgttagttcccgtgttaaccccg

SEQ ID NO: 191419 - DNA, 605 bp, Homo sapiens
  misc_feature: GYAE6OF01B8EO7.47.70.G04.1.454.CMB.1.raw
  modified_base (212)..(212): a, c, t, g, unknown or other
  misc_feature (212)..(212): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (562)..(562): a, c, t, g, unknown or other
  misc_feature (562)..(562): n is a, c, g, or t
  modified_base (576)..(576): a, c, t, g, unknown or other
  misc_feature (576)..(576): n is a, c, g, or t
  modified_base (589)..(589): a, c, t, g, unknown or other
  misc_feature (589)..(589): n is a, c, g, or t
  modified_base (596)..(596): a, c, t, g, unknown or other
  misc_feature (596)..(596): n is a, c, g, or t
tcagagctcacgtacacgaccggtgctcgatttagtgtagtgtgaagggaaagggggggagtcagtctcagtcaggacacagcatggacatggacgggtcccccgctcagctccgtggggctcctgctactctggcctccgaggtcgccagatgtgacatccagatcgaccccagtcctccacttccctccctgtctgcatctaggtagganaacagagtaccacctatccacgttcggaccgggactaagtcaagacgactaattaacgagtacgtttaaatttaaagttcggtaactacgaaaccaaacggaaaaccgaacgggaaacctaccccccttaacctctagacttctatcgctcnctacttcctagttcgactagtacggtccggacctatcgtagtcnggtcgagtaggngtatcgaggtactagtcttcactcncacntcgancgtactcgacaccaatatagttattacactttactatcgtataacaggttacgtacgtttaccccgtacctttacgtacgttacgggaccgtaacggaactagacganacttaacaacgttnggtacgacctacngtacctnttcctcgtc

SEQ ID NO: 191420 - DNA, 799 bp, Homo sapiens
  misc_feature: GYAE6OF01E1C31.47.70.G04.1.454.CMB.1.raw
  modified_base (101)..(101): a, c, t, g, unknown or other
  misc_feature (101)..(101): n is a, c, g, or t
tcagagctcacgtacacgaccggtgctcgatttagtgtagtgtgaagggaaagggggagtcagtctcagtcaggacacagcatggacatgagggtccccgntcagctcctggggctcctgctactctggacctccggaggtcgccagtatgtgacatccagatcgacccagtcctccactccctccctgtctgctatcgtggtaaggacgacaggactccaacctatctaccgttcgggccgggacaacgtcaagacgactaattaacgagtacgttaattttaacgttcggtaactaccgaaaccgaacggaaaaccgaacggggaaacccctaacccccttaaccctccgtagtaacttactagtcgactacgacttaccgttaccgttaggtttgaccgttaagggtttaccgggtaccgggtacccttacgttccggttaacggttacgtaggtacggacgtagggttaggtacggtacggtagggacgtacgttactttacccgtaactttacccgccctaaacgtcgttacgacgtcgtaaccgtcgacggttaacctaaccggtaaggttaaccgtttaatttaccggaacctttaaacctttaccgtacgttaaccgtaacgaaacgttacggtttaacccggttaaccccggtttaacccttacggttaccggtttaccgggaacccggtaaacgggttaacctaaaggtaacggtaacttaaccgtaaaccgaaacggttccgtagggtccacgtaccgacctaacccttcgttaaccgtctttacccg

SEQ ID NO: 191421 - DNA, 809 bp, Homo sapiens
  misc_feature: GYAE6OF01D9K6S.47.70.G04.1.454.CMB.1.raw
  modified_base (101)..(101): a, c, t, g, unknown or other
  misc_feature (101)..(101): n is a, c, g, or t
  modified_base (246)..(246): a, c, t, g, unknown or other
  misc_feature (246)..(246): n is a, c, g, or t
tcagagctcacgtacacgaccggtgctcgatttagtgtagtgtgaagggaaagggggagtcagtctcagtcaggacacagcatggacatgagggtccccgntcagctccgtgggctcctgctgctcgtgttcccgaggtcgccaggtgtgacatccgagatcgacccagttcctccacttccctcccgttgtctgactatcgtaggtaaggagacgagtagtccacctatccgtactcggaccggngtacgtcgagggtcttgaactaagtcgtcgttacggccttggttacagcagtaaccaccggtaaggaacccgacccgtaacgccgtaccgtagtaacgttaccgtaggttacgggactaaccgtagtttaacccgttaccgttaaggaaaccggttaaaaggggttcccggtaaccgtaaacgtaaccggttaacggttacggtaacgggaccggtaagttacgggttaaccggtcggggttaacggaaaccgttaaggtacgttaaaccgtacgttaccgtacgttaaccttaacgtaccgtacgggtacccgtcccgttagaaccgacggttaccgtaacgtaaagtttcccttcgtaaccgttaaactttacgttaactttcgttacgtccgtaactaggttacgtagtcgttaccgttaccgttacccggttacgtaacggtttaccccggaacgttaaaaccgggaacgttaaacgggttaacgaaaaccgtaacccggtaaaacggttaccggtagtaccgtaccgtaccaaccgttacctaggtttcccttacggg

SEQ ID NO: 191422 - DNA, 870 bp, Homo sapiens
  misc_feature: GYAE6OF01D2Q1A.47.70.G04.1.454.CMB.1.raw
  modified_base (103)..(103): a, c, t, g, unknown or other
  misc_feature (103)..(103): n is a, c, g, or t
tcagagctcacgtacacgaccggtgctcgatttagtgtagtgtgaagggaaaggggggagtcagtctcagtcaggacacagcatggacatgacgggtccccgntcagctccgtggggcctcctgctactctggctccggaggtgccagatgtagacatccagatcgacccagtcctaccatcccctcctgtctgcctattcgtggtaggagtaacgagtacgtccaaccattccgtaacgttcgggcccgggacggtaggtccggaggggtccgttagaacgtaaatcggttcgttttcgggtccgtttggtttccgaacgtcgaacgaccgaaccggaacggggaacccggtacccccgtaaaggcccgtaccgtacggtaacgttacttaggtcggttacgacttaacgtaaccttacgtttacgaacggtaaacggggttcgggtaccctagtaccggtaaacgggttcacgggtaccggtacgtaaggttacggtaccggtagggacgtaacggttacgttacctaccgttccgtaactaccttaacgtacgacggtccgtaccgtcgaccgtacgtccgtaagtaacgttattaccttagaaccgtttaactttaatttaccgtgtttaccttaacttaggttaacgttcgttaacgttcccgtttacccgtttacccggtttaacgggttaccccggtttaaccgggtaacccggtaaacggggggttaaaacccgtaacggggttaaaacgggtaaaaacccgttttaaaccggaaaaacccgggtttaaccggttaacggggttaccggttaccgttaaaccccgggtaacccttaaaccggttccgttttaaacccccggg

SEQ ID NO: 191423 - DNA, 742 bp, Homo sapiens
  misc_feature: GYAE6OF01BW6R1.47.70.G04.1.454.CMB.1.raw
  modified_base (102)..(102): a, c, t, g, unknown or other
  misc_feature (102)..(102): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (502)..(502): a, c, t, g, unknown or other
  misc_feature (502)..(502): n is a, c, g, or t
tcagagctcacgtacacgaccggtgctcgatttagtgtagtgtgaaggggaaagggggagtcagtctcagtcaggacacagcatggacatgagggtccccgntcagctcctgggctcctgctactctggcctccgaggtgaccagagtgtgacatccagatcgaccctagtctccatccccttcccgtgtctgctatcgtggtaaggacanggactccacctntcacgttggccgggcagtcggagggtcgttagacctaagttcggtcgtttcggccgttcggtttacagtaccacggaacctacccggacggggtaaccggaccccgtaacggccgtcctagaacttcgtatgggtcaccgtaatccgtacgttagaaccggtaaggtccggtaccctagtaccgtacgggttagacggtcgtacgagggttaccggtcgtaggggtactacggttatccgtaccgtactccgtacttacgccgtaacgggcccgttacncggaacctaggtacccgttaagacgtttaattcccgtaagttaccgttaacttttacgtaccgtaccgttacctaacggtacgtttagtccgttacttacccggtaaacttcccggttaaacccgttcgtttacccgggaaacccggtaaacggtacggtaaaccggtaagtaaacctaaacccggtaaagttccccgggaggtaccggactacccgtaacttcccggtactttcccggg

SEQ ID NO: 191424 - DNA, 772 bp, Homo sapiens
  misc_feature: GYAE6OF01AVN4P.47.70.G04.1.454.CMB.1.raw
tcagagctcacgtacacgaccggtgctcgatttagtgtagtgtgaagggaaaggggggagtcagtctcagtcaggacacagcatggacatgacgggtccccgctcagctccgtggggctcctgctgctctggctcccaggtgccaaatgtgacatccagatcgacccagtctccttccaccctgtctgctatctgtcggagacagacgtccaacctatctaccgttcggcccgggccagtcagagttattgtagttagggtggttggtccgttaggtatcgagacgaacgaaaccgaacgggtaaccgaccccgtagtaaccttacttaacgttacctaagtaacggtacgtttactttaaacgttttaacggtaaacggttcgggtaccctagttacgtaacggttacgacggacggacgaaggtggacgtacgtacgggaactaggtacgttctaccgttacctccgaacctactaaccaacccaccgtacgaccgtaacgtccgtaagtacgttacgttactttacggtaccggtttaactttaacgtttaaccgtaacggtaaaccccttaaaaggtttaaccttaacgttaacggttacccgttaacccggtttaccccggtttaccgggtttacccgggtacccggttaaccgggtaaaccgtaacgggtacggtacgttacgtaaaccgtaaccgtagttcgggtagtacgttcgacccgtaactaccgttcgttacgtaccgttaccttcgttcccgtaccccg

SEQ ID NO: 191425 - DNA, 719 bp, Homo sapiens
  misc_feature: GYAE6OF01BM6XG.47.70.G04.1.454.CMB.1.raw
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
  modified_base (253)..(253): a, c, t, g, unknown or other
  misc_feature (253)..(253): n is a, c, g, or t
  modified_base (439)..(439): a, c, t, g, unknown or other
  misc_feature (439)..(439): n is a, c, g, or t
  modified_base (464)..(464): a, c, t, g, unknown or other
  misc_feature (464)..(464): n is a, c, g, or t
tcagagctcacgtacacgaccggtgctcgatttagtgtagtgtgaagggaaagggggagtcagtctcagtcaggacacagcatggacatggacgggtccccgctcagctccgtggggctcctgctactctggctccggagtgccagatggtcgacatccgagatgacccagtccnccactcctccctgtcngcacttcgtgtaaggagaacgagtacgccaccaattcacgttcggccgggacaagtcaaggnacctaattaagagtacgtaagtttaaattggaactacaaccgaaagaaaccgaacggaaacctaccccttaacctaccgtagacttacttacacgtcactcaactcgtaactttgaatacgtagggcggtccaagttccgtagttacgaggtcggataggtacggattacggtacggataaacgtntttaccagttccacacctacacganacggtactacgttacaaccgtaacgtaggtaaatttacggtttactaactaaacctttaacgttaccgtacgtaactaaacggtaccgttaaacgttacccggtaaccccgttacggttaaccgttttacgggaaccggtaacggggtaaaaccctaaagggtaacgtaacccgaaattaaacccggaaaacgtaccgtacggtaacggacccgttaacggaccttaaaccgtactttcccggtagtttaacccc

SEQ ID NO: 191426 - DNA, 831 bp, Homo sapiens
  misc_feature: GYAE6OF01E3RNA.47.70.G04.1.454.CMB.1.raw
  modified_base (104)..(104): a, c, t, g, unknown or other
  misc_feature (104)..(104): n is a, c, g, or t
  modified_base (790)..(790): a, c, t, g, unknown or other
  misc_feature (790)..(790): n is a, c, g, or t
  modified_base (823)..(823): a, c, t, g, unknown or other
  misc_feature (823)..(823): n is a, c, g, or t
tcagagctcacgtacacgaccggtgctcgatttagtgtagtgtgaagggaaagggggagtcagtctcagtcaggacacagcagtggacatggacgggtccccgntcagctccgtggggctcctgctactctggctcgaggtgcagatgtgacatccagatcgaccagtctccactcctccgtgtctagcatcgtaggtaggagacgagacgtcaaccatcgaccgttcggaccggggactaaggtccgaggaacgactaaacttaacgacggtaacgttaagttttaaaacgttggtaactactaaacccggaaaggtaaacccggaacgggggaaacctaccccccgttaaaccgtccgttaaggacttaccggttaatcggtaccgtacggtactaacgtttacccgttaagggtttcaaccgtaagggtttaccgggtacggggttacccctaacgttcggttaacggttacgtacggttaggggaaccgtaggttacgggaacgttcggtaacggggtactacggttactttacctaccgtaccaccctaacttaacgtcgtaacggcttaaggtccaacggtaaccctaacgggtaagtacgtttacgtttaccggaacctttaaccgttaacttaccggtaacgtaacctaaaccgggttagtaaacccggtttacccggttaaccccttacggttttacgttaacccggggaaccggtaaccgggtaaacccgtaaacggtccttaaaccggacttaaaaccccggtaaaggtcgtttccggnggtaccctacggtaccaacggttattcccgttnttaaccgg

SEQ ID NO: 191427 - DNA, 753 bp, Homo sapiens
  misc_feature: GYAE6OF01AZV8M.47.70.G04.1.454.CMB.1.raw
  modified_base (202)..(202): a, c, t, g, unknown or other
  misc_feature (202)..(202): n is a, c, g, or t
tcagagctcacgtacacgaccggtgctcgatttagtgtagtgtgaagggaaagggggagtcagtctcagtcaggacacagcatggacatggagggtccccgctcagctccgtggggctcctgctactctggctccgaggtgccagatgtgacatccagatcgacccagtcctccatccctccctgtctgcatctggtagganacagacgtccaccatcctaccttggcccgggactaagtcgagtacgactaagttaacgaggtacgttaaatttttaaagttggtactaccgaaccgaacgaaaaccgaacggggaaaccctaccccccttaaacctccgtagtaacttcgtagtcgtcctagctaacttccgtagtttcgacgtaggttacggtccgggttacctagttcggttaacggttcgtaggtcggacgtaggttacggacgttacggtacgggaacttacgttacctttccgaacctttccctaaccgtaaccctagttaccgacgtacgtaccgttacgtaacggtaacctaacccgttagttaaacgtttacttttaccgaacctttaactttacccgtaagttaccgttaacaaacggttaacggtttaacccgggttaacccgttaacccgttaccgtttaccggtttacgggacccgtaaccggggaacctaacggtacgaacctaacgtaacccgaaacggtcgttggacgtctacgacctaacgtcttcgtcgttacc

SEQ ID NO: 191428 - DNA, 807 bp, Homo sapiens
  misc_feature: GYAE6OF01DKO94.47.70.G04.1.454.CMB.1.raw
  modified_base (534)..(534): a, c, t, g, unknown or other
  misc_feature (534)..(534): n is a, c, g, or t
  modified_base (759)..(759): a, c, t, g, unknown or other
  misc_feature (759)..(759): n is a, c, g, or t
tcagagctcacgtacacgaccggtgctcgatttagtgtagtgtgaagggaaaggggagtcagtctcagtcaggacacagcatggacatgaggtccccgctcagctccgtgggctcctgctgctcgtcggttcccaggtcgccaggtgtcgacagtccaagtactcggaacccctagtcctacctactccctccctgtctagctacgtcgtaggtaacggagaaccaggtacgtacccaaccgtattaccgtaccgtttccggggacccgggtacgtaacggtcggacggggttcgttacgaacctaaagttcgtcgtttaggtccgttagttaccagtcaacgccgaaccggaggaccgtaccccgtaaggaccgtccgtaggacttacgtacggttcggtctacctattaaccgttcgttacgaacggtaaacgggtccggtacctaagtacggttaacggtcgaacgggtccgaaggttacggtaacggtgacggtaacgtagtacgtaccgtactaccgtctacgttaacnccggtaacgggtccgtacgtcggacgtacggtactacggtaactcgttaccgtacgtaccgttaacgttttagtaacccgttcgtaacgtaaccgttagtttaccgtaggttacctccggtttaaacccgtttcccggttaccggttacggtttaacccggaccggtaaaccggttaccggtaaaacggttaccggaaaaccttcggtaaaaccgttaccgggtntaaaccccggtcctaaaccgggccttaaccgtcggtttcctaaaccgg

SEQ ID NO: 191429 - DNA, 726 bp, Homo sapiens
  misc_feature: GYAE6OF01EC1CI.47.70.G04.1.454.CMB.1.raw
  modified_base (61)..(61): a, c, t, g, unknown or other
  misc_feature (61)..(61): n is a, c, g, or t
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagagctcacgtacacgaccggtgctcgatttagtgtagtgtgaagggaaagggggagtnagtctcagtcaggacacagcatggacatgagtgtccccgctcagctcctggggctcctgctactctggctccgaggtgccagatgtgacatccagatcgacccagtcctccactccctcctgtctgcatcgtgtagganacagacgtaccaccatcacttcggccggtanaagtcagtacgctaataacagtacttaatttaagttggtaactacaaccgaagtaaaccggacggaaacccgtacccccttaacgtcctagtaacttactaacgtcgtactcgtaccgtaacttacctaggtttacaccggtaacggtttacgggtaccggggttacccctagtttacggttaaccgggttcgaagggtcggtacggtaaggtacggtacgtcggtaggtaacccgttaagttaccgtttacctaccgttaccctaccgtacctaacgtacgtacccgattaccggtacgtacccgaacccgtttaacgtaagtaaccgttttaacttaccgtaaacctttaacttaccgtaacttgaacccgtaagtaccgttaaccggttaacccgttacccgttataccgggttaacgaccgtaaggtacccaagtacgactaacgtaactaacgacgtcgtacgtacgtcgaacctcttaactcggttacc

SEQ ID NO: 191430 - DNA, 733 bp, Homo sapiens
  misc_feature: GYAE6OF01AWTW8.47.70.G04.1.454.CMB.1.raw
  modified_base (104)..(104): a, c, t, g, unknown or other
  misc_feature (104)..(104): n is a, c, g, or t
  modified_base (159)..(159): a, c, t, g, unknown or other
  misc_feature (159)..(159): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (479)..(479): a, c, t, g, unknown or other
  misc_feature (479)..(479): n is a, c, g, or t
  modified_base (724)..(724): a, c, t, g, unknown or other
  misc_feature (724)..(724): n is a, c, g, or t
tcagagctcacgtacacgaccggtgctcgatttagtgtagtgtgaagggaaagggggagtcagtctcagtcaggacacagcagtggacatggacgggtccccgntcagctccgtggggcctcctgctactcgtcggcctccggaggtcgccagatgtanactacaccagatccgacctagtcctaccacctccctcccgtntccgtnctacgtcgtaggaggacacgagacgtaccacatacctacgtcggaccggataacgcaganacttaacgtaacgcgttaagttaaactttaaggttacggtacctaccgaaaccgtaaaacggaaaccggaaaccgggtaacccccgttaccccctaaaccgtctaaactcgttagtactcggttaccaacgttcccttaaccgtttacgtttaggttcgaacgttacgggtttaccggtccggtaccttaaggttccgtagggtacgtaggnggtaccggtacggtgtcgggttacgaacggttatacgttacccttaacgacccgtacctactaaccgtactacgactcgtacgtcgtaccgaccgtaagtcgttaattcttaccgtaacttacgttactacctagactaacgtacgtaaccgtaccgtaccttagtaccggtacgacgggaacgtaactacgagtacgtaactacggaaacgtgacggttaacgcgacgtaccttacgactttcncggttaacc

SEQ ID NO: 191431 - DNA, 812 bp, Homo sapiens
  misc_feature: GYAE6OF01DKLFT.47.70.G04.1.454.CMB.1.raw
  modified_base (104)..(104): a, c, t, g, unknown or other
  misc_feature (104)..(104): n is a, c, g, or t
tcagagctcacgtacacgaccggtgctcgatttagtgtagtgtgaaggggaaagggggagtcagtctcagtcaggacacagcatggacatggacgggtccccgntcagctccgtcgggcctcctgactactcgtcggcctccggaggtgccagtatggtacacactccagactccgaccctagtcctcctaccttccctcccttgtcctgtactacgttacgtagggtaaggacgtacgaaggactacccaactacgtaccgtacgtccggccgaagggtacggacgtacgaacggtacttaagtacctaaccgttaaagttttaagtttaaacgttcggtaactaccggaacgaaccgaaaccggaaaaccggtaaaccggggaaccccttaccgtaaccgtccttaccgagttacgttaccgacgtacgtaactaccttacgttaaccggttaaaggtaccggtaaaccgggtaccgggttactaaacggtacggttaaacgtggggttaacgggtaggtacggttaaggacgttacgggaacgggttactttacgttttactttaaccgttaccacgtatacgacgtccgtacgtccgtacgtacgtaccgtacgtaacgtacgtaacttacgtaacgaactaacttaacgttacttaccgttaactaacgtaaatacttactaacttaccttacccttacccgttacccgttacccgtaccggtacccgtaacggtaccgttaacggtacttaacgtaacaacggttaacgtacggtacgtactacggtacacctcctgttccgttac

SEQ ID NO: 191432 - DNA, 906 bp, Homo sapiens
  misc_feature: GYAE6OF01DGB3S.47.70.G04.1.454.CMB.1.raw
  modified_base (871)..(871): a, c, t, g, unknown or other
  misc_feature (871)..(871): n is a, c, g, or t
tcagagctcacgtacacgaccggtgctcgatttagtgtagtgtgaaggggaaaggggggagtcagtctcagtcaggacacagcatggacatggacgggtccccgctcagcctccgtggggctcctgctactctggcctccggaggtcgccagagtgtacgactactaccgaaggtacaccgaccctacgttcctccctaccttccccttcccttgtctacgctacgttcgtagggacggaacgaacgacggtactaccaacctactacgtacgttaccggaccgggtaactacgtacgagggactaacgtaacgttaacgaacgttaacgtttaagtttaaacgttacggtactaacccgaaaccgtaaacggaaacccggtaaacgggtaaccccgtaaccccgttaacccttacgagtacttaaccgtacgtacggtcctacgtaccttaacgtaccgtttacgttcgtaccgtagggtaccggttccgggttacctaacggttcggttaacggttacgtacggtcgggtacttagggacggtttcggtaccgggtaacggttacttaaacggttccttaaccgtaccgtcccgtaaccgtacttaccggtacgtaacccggttacgttacgttaacgtaccggtaaactaaccgggttaactttacggtttacttaaacggttaccctttaaatttaccggtactttaacccggaagttaaaccccggtaggtttacccggtttaaccccggtttacccgttaacggtttacccgggaccggggaaacccgttaaacgggtaaccgtaccgggtaacttaaaccgggaacctaacgggttaaacccacggggtttccgcggttaaccnccgggtaccttacttccggtttatccgtttacccg

SEQ ID NO: 191433 - DNA, 663 bp, Homo sapiens
  misc_feature: GYAE6OF01BVHZX.47.70.G04.1.454.CMB.1.raw
  modified_base (141)..(141): a, c, t, g, unknown or other
  misc_feature (141)..(141): n is a, c, g, or t
  modified_base (162)..(162): a, c, t, g, unknown or other
  misc_feature (162)..(162): n is a, c, g, or t
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (434)..(434): a, c, t, g, unknown or other
  misc_feature (434)..(434): n is a, c, g, or t
  modified_base (625)..(625): a, c, t, g, unknown or other
  misc_feature (625)..(625): n is a, c, g, or t
  modified_base (630)..(634): a, c, t, g, unknown or other
  misc_feature (630)..(634): n is a, c, g, or t
  modified_base (637)..(654): a, c, t, g, unknown or other
  misc_feature (637)..(654): n is a, c, g, or t
  modified_base (656)..(659): a, c, t, g, unknown or other
  misc_feature (656)..(659): n is a, c, g, or t
  modified_base (661)..(663): a, c, t, g, unknown or other
  misc_feature (661)..(663): n is a, c, g, or t
tcagagctcacgtacacgaccggtgctcgatttagtgtagtgtgaagggaaagggctggagtgggtggcatttatatggtacgatggaagtaattattactatgcagactccgtggaggggccattcaccatcctccaganacaattccaaagaacacggtntatctgacaaatgaatcccccccgntgaggacgccggaggaccncggctgtgtattactggtgtgagagtagttggttaattcggaaccttccggtactaactactccaactacctacagtcgggaccgttcggtcgggggaaccaaaacgggggacccacgggtcccaacccggttctcccctcacgcccctacccgaacccgaacggggccccctaagttcccggttacccttccccccgtggccctaccccctcccgtaccaacgaccnccctaaccgttcggtcggggggaccaacgaccggggcccggccccggttggggtccctacgggtcccgtgggtaacctaaacgggtacccctttacgttcccggttaacggtcgtaaccggtcccgttacggttcgggaacgggtccgggtacggtcgggtaaccgaacgggccgtaaccggagttaggcncgtannnnngcnnnnnnnnnnnnnnnnnncnnnncnnn

SEQ ID NO: 191434 - DNA, 746 bp, Homo sapiens
  misc_feature: GYAE6OF01B0YHC.47.70.G04.1.454.CMB.1.raw
  modified_base (101)..(101): a, c, t, g, unknown or other
  misc_feature (101)..(101): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
tcagagctcacgtacacgaccggtgctcgatttagtgtagtgtgaagggaaagggggagtcagtctcagtcaggacacagcatggacatgagggtccccgntcagctcctggggctcctgctactctggctccgaggtgccagatgtgacatccagatgacccagtcctccatccctccctgtctgcatctgtagganacagngtcacatcacttggccgganaagtcgagagactattaacgagtacgttaatttttaaaagtggttaactaccaaaccgtaacggaaaaacccgtacgggggtaaaaccctaccccccccgttaaaccgtccgttagacgtttactagtcggtcctaggtacctacgttaccgtagttttcgacctaagttacgggtccgggtacctagttcgttaggtcgaggtgacgtagtcgagtcggtaggtactagttactttaccgacttctacctacctagtactacgacctacgtactacgaaccgtaaccgttaggtaaagtttccgtttacggaacctttaaacttacgttaacgttacgtaaacctaaacggttacgggtttaaaccccggtttaacccgggtttaccccttaaccggtttacggttttacccggaccgggttaaaccggggaaccctaaacggtaccggtaccaaacgttaaccgaaacggtaccgttcggtaccgggctaccgtacccgaattcgttccgttggttacccc

SEQ ID NO: 191435 - DNA, 825 bp, Homo sapiens
  misc_feature: GYAE6OF01BQKZD.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctccgtggggctcctgctactctggctccggaggtcgccagatgtgacatccagatcgacccagtcctccactccctcccgtgtctcgctacttcgtaggtaggacgacagtacgtccaaccatcacttcggcccggggcaacgtcagacgactaataacaggtacttaatttaaacgttggtaactaccaaccgaacgtaaaaccggaacggggaaaccctaccccctaaccttccgtagacttctacgtcgtctcgtctacgtcctagtttcgacgtacggttagggtccgggtacctaacgttacgttacggttcggtaggtaggtcgtaggtcgtacggtacggtagggactacgttacgtttcctaccttacctaccctacctacgtacgtaacgttcccgtacggtaccttacggtaacccgtaaccgttacggttaaacgtttacgtttttacccgtaaccgtttaaaccttttaccgttaaccgttaacgttaaccgtaaaccgttaaacgggtttaacccgggtttaaacccccggtttaacccgtttaaccgtttacccgggtttaccgggaacccggggtaaacccggtaaaccgttaaaccggtaaccgggtaaacctaccgttaaacccggaacggttaaccgttcgggtaccggtacccgttacggaccccttaaaccttccggtttaaccgtccgttttaacccg

SEQ ID NO: 191436 - DNA, 485 bp, Homo sapiens
  misc_feature: GYAE6OF02GJDGB.47.70.G04.1.454.CMB.1.raw
tcagagctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcagggcgttgcaaatgctttggcctggtttcagcagacaccagggaagcccctaagcgcctgatctatggtgcatacactttgcaaagtggggtcccatcaaggttcagcggcagtaggtctgggacagagttcactctcactatcagcggcctgcagcctgaagattctgcaactttatactgtctccagtatgatgcttacctgactttcgaccaaggacctaaggtggaaatcgaaacgactgtcggctgcaccatcg

SEQ ID NO: 191437 - DNA, 498 bp, Homo sapiens
  misc_feature: GYAE6OF02FXJK9.47.70.G04.1.454.CMB.1.raw
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (493)..(493): a, c, t, g, unknown or other
  misc_feature (493)..(493): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatcccagatgacccagtctccatcctccctgtctgcatctgtaggagacagagtcaccatcacttgccgggcaagtcagagcattaacagcgatttaaattggtatcaccagaaaccagggaaacgcccctaacctcctgatctatgctgcatccagtttgcatagtgggtccatctaggttcagtggcagtggatcgtgggacagtatttcactctcaccatcagcagcctagngcctgaanattttgctactttattactgtcagcagcgtagcaacgtggtcctctctactttcggacggtacgggaccaggggtcgaagatcgagacgtaactggtaggntacgg

SEQ ID NO: 191438 - DNA, 488 bp, Homo sapiens
  misc_feature: GYAE6OF02GZQ45.47.70.G04.1.454.CMB.1.raw
tcagagctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagattttgcaacttactactgtcaacagagttacggtacccgtactacttttgccagggaccaactggacatacaaacgaactgtggctgcaccatctgtc

SEQ ID NO: 191439 - DNA, 496 bp, Homo sapiens
  misc_feature: GYAE6OF02H3NB1.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaaggtgggtccatcaaggttcagcggcagtaggtctgggacagagttcactctcactatcagcggcctgcagcctgaagattctgctaacttattactgtctcagtatgatgtcttaccctcggtactttcggacctaagggaccaagggtagaaatcgaaacgactgtacggctgcaccatccg

SEQ ID NO: 191440 - DNA, 511 bp, Homo sapiens
  misc_feature: GYAE6OF02HV2VR.47.70.G04.1.454.CMB.1.raw
tcagagctcacgtacacgaccggtgctcgatttagtgtagtgtgaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttacttcaccatcagcagcctgcagcctgaagatattgacaacattattactgtacaaactagtatcaattaactccttacccctactttccggcccttagggaccctaagttggaatataccaaacgaactgtaggctgacaccatctgtc

SEQ ID NO: 191441 - DNA, 552 bp, Homo sapiens
  misc_feature: GYAE6OF02H3J2K.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaaacctcctgatctatgctgcatccagtttgcatagtgggtcccatctaggttcagtggcagtggatctgggacagattttcactctcaccatcagcagtctgcaacctgaagtattttgactaacttactactgtacaacagtaacgttacggtaccccgttaactaccgttttaggccgtaacggggaacccaaacgttcgggaactaacttaaccaaaacggtaaccttaggtcgggtactacggacctaaccctaattccgtggttccc

SEQ ID NO: 191442 - DNA, 530 bp, Homo sapiens
  misc_feature: GYAE6OF02I7LWQ.47.70.G04.1.454.CMB.1.raw
  modified_base (270)..(270): a, c, t, g, unknown or other
  misc_feature (270)..(270): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattaacagcgatttaaatgtatcaccagaaaccaggaaancccctaactcctgatctatgctgcatccagtttgcatagtgggtcccatctaggttcagtgcagtgatctgggacagtatttcactctcacatcagcagtctgcaactgaagtattttgactaacttactactgtacaactagtacgttaaccgtaccccgttatacgttttggaccaacggggtaccaacgttcggaactaacgttaccaaacgtaacgtgttcggacttcggacctaaccctagttacctagttaccc

SEQ ID NO: 191443 - DNA, 507 bp, Homo sapiens
  misc_feature: GYAE6OF02GR90Z.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaagcccctaacctcctgatctatgctgcatccagtttgcatagtggggtcccatctaggttcagtggcagtggatctgggacagatttcactctacacatcagcagtctgcaacctgaagattttgactaacttactactagtcaacagtagttaccggtacccgtactactttggacctaggggacctaacgtcggacaataccaaacgactagtaggctcgacaccatctgttcc

SEQ ID NO: 191444 - DNA, 494 bp, Homo sapiens
  misc_feature: GYAE6OF02HRKUS.47.70.G04.1.454.CMB.1.raw
  modified_base (492)..(492): a, c, t, g, unknown or other
  misc_feature (492)..(492): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaagcccctaaacctcctgatctatgctgcatccagtttgcatagtgggtccatctaggttcagtggcagtggatctgggacagatttcactctcaccatcagcagtctgcaacctgaaagtattttgactaacttactactgtcaaactagacgttacgtacccgtactactttgcctagggaccaactggacaatacaaacgaactgtgctgcaccatctntc

SEQ ID NO: 191445 - DNA, 505 bp, Homo sapiens
  misc_feature: GYAE6OF02JDYKX.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggttttcagcagacaccagggaaggcccctaagcgcctgatctatggtgcatacactttgcaaagtggggtcccatcaaggttcagcggcagtaggtctggggacagagttcactctcactatcagcggcctgcagcctgaagattctgcaacttattactgtctcctagtatgatgcttaccctcggtactttcggcctagggaccaagggtcggaaatcgaaacgtactggtacggcgtacgcaccatcctcg

SEQ ID NO: 191446 - DNA, 507 bp, Homo sapiens
  misc_feature: GYAE6OF02IZT0B.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaaggttcagcggcagtaggtctgggacagagttcactctcactatcagcgctgcagcctgaagattctgcaacttattactgtctccagttatgatgtcctttaccctcggtactttcggacctaagggacctaagggtggaaaactcgaaacgaactggtaggcttgccacctatctcg

SEQ ID NO: 191447 - DNA, 502 bp, Homo sapiens
  misc_feature: GYAE6OF02HUXII.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaagcccctaacctcctgatctatgctgcatccagtttgcatagtgggtcccatctaggttcagtggcagtggatcgtgggacagtatttcactctcaccatcagcagtctgccaacctgaagtatttgactaacttactactgtacaacagtacgttacggtacccgttactacgtttcgaccgtagggaccaacgtggacatacaaacgaactgtagctcgcacatctgtc

SEQ ID NO: 191448 - DNA, 511 bp, Homo sapiens
  misc_feature: GYAE6OF02HU6XP.47.70.G04.1.454.CMB.1.raw
  modified_base (273)..(273): a, c, t, g, unknown or other
  misc_feature (273)..(273): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaacncccctaacctcctgatctatgctgcatccagtttgcataggtgggtcccatctaggttcagtggcagtggatcgtgggacagtatttcactctcacatcagcagtctgccaactgaagtatttgactaacttactactgtacaacagtacgttaccggtacccgttactacgtttcggaccgtacgggaccaacgtgaacaataccgaaacgtaactgtggctcgaccacactctgtc

SEQ ID NO: 191449 - DNA, 520 bp, Homo sapiens
  misc_feature: GYAE6OF02IVQKF.47.70.G04.1.454.CMB.1.raw
tcagagctcacgtacacgaccggtgctcgatttagtgtagtgtgaagggaaagggggaggtcagtctcagtcacggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcagggcttgcaaatgctttggcctggtttcagcagacaccaggaaggcccctaagcgcctgatctatggtgcatacactttgcaaagtggggtcccatcaaggtttcagcggcagtaggtctgggacagagttcactctcactatcagcgcctgcagcctgaagattctgcaacttattactgtctcccagtatgtatgtcttacccgtcgtacttttcggacctaagggtacccgaagggtaggaaactacgaaacgtaacttacggtacggtctggacctaccgattaccg

SEQ ID NO: 191450 - DNA, 526 bp, Homo sapiens
  misc_feature: GYAE6OF02H5HUP.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtcgggtcccatctaggttcagtggcagtggatcgtggacagatttcactctcacatcagcagtctagcaacctgaagtattttcgactaaacttactacttgtaccaacagtacgttaccggttacccctaacttacgttttcggaccgtaggggaaccaacgtcggaactaataccaaacgtaactgtaggctggccacctatcctgttcc

SEQ ID NO: 191451 - DNA, 532 bp, Homo sapiens
  misc_feature: GYAE6OF02G4A7Y.47.70.G04.1.454.CMB.1.raw
  modified_base (396)..(396): a, c, t, g, unknown or other
  misc_feature (396)..(396): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaacagcgatttaaattggtatcaccagaaaccagggaaacgcccctaacctcctgatctatgctgcatccagtttgcatagtgggtcccatctaggttcagtggcagtggatcgtgggacagatttcactctcaccatcagcagtctgacaacctgaagtnttttagactaacttactactgtacaactagtacgttaccggtacccgttactacgtttcggaccgtacgggaccaacgtggaacctaataccgaaacgtaacgtggtacggctacgacctaaccattcctgttacc

SEQ ID NO: 191452 - DNA, 507 bp, Homo sapiens
  misc_feature: GYAE6OF02GIL03.47.70.G04.1.454.CMB.1.raw
  modified_base (391)..(391): a, c, t, g, unknown or other
  misc_feature (391)..(391): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaagcccctaacctcctgatctatgctgcatccagtttgcatagtgggtcccatctaggttcagtggcagtggatcgtgggacagtatttcactctcaccatcagcagtctgcactgaagtnttttgactaacttactactgtacaacagtacgttaccggtacccttactacttttcggaccgtaagggaccaacgtcggactaatacaaacgaactgtaggctcgcaccatctgtc

SEQ ID NO: 191453 - DNA, 548 bp, Homo sapiens
  misc_feature: GYAE6OF02I7WWU.47.70.G04.1.454.CMB.1.raw
tcagagctcacgtacacgaccggtgctcgatttagtgtagtgtgaagggaaagggggaagtcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaacgcccctaactctgatctatgctgcatccagtttgcatagtcgggtccatcgtagttcagtggcagtgatcgtgggacagtatttcgactcctacaccatcagcagtctgaccaacctgaagtattttgactaacttactactatacaactagtacgtttaaccggtaccccgttagttaccgtttcggaccgtaacgggacctaacgtggaacctacgtaacctaaaccggtacgttggtagtaccgtagacccgtaactagttaccttgtaccc

SEQ ID NO: 191454 - DNA, 511 bp, Homo sapiens
  misc_feature: GYAE6OF02IHXRR.47.70.G04.1.454.CMB.1.raw
  modified_base (309)..(309): a, c, t, g, unknown or other
  misc_feature (309)..(309): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaaactcctgatctatgctgcatccagtttncatagtgggtccatctaggttcagtgcagtgatctgggacagatttcactctcaccatcagcagcctgcagcctagaagtatgttgactaaacttattactagtcaacagtacgttaccggtacccgtactacgttttcggaccgtaggggaccctaaacgtcggaacagtacaaacgaactggtaggcctgacaccatccg

SEQ ID NO: 191455 - DNA, 502 bp, Homo sapiens
  misc_feature: GYAE6OF02HANW6.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcacagaaaccaggaaacgcccctaacctcctgatctatgctgcatccagtttgcatagtgggtccatctaggttcagtgcagtggatcgtgggacagtatttcactctcaccatcagcagtctgcaacctgaagtatttgactaacttactactgtacaacagtagttaccggtacccgttactacgtttcggaccgagggaccaagtcggaacatacaaacgaactgtacgctgaccactatctgtc

SEQ ID NO: 191456 - DNA, 505 bp, Homo sapiens
  misc_feature: GYAE6OF02GF1AM.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaagcccctaactcctgatctatgctgcatccagtttgcatagtggggtcccatctaggttcagtgcagtgatctgggacagatttcactctcaccatcagcagtctgcaacctgaagtattttgactaacttactactgtacaacagtacgttaccggtacccctaactactttcggccgagggaccaacgtaggacaatacaaacgaactgtgactcgaccaccattctgtcc

SEQ ID NO: 191457 - DNA, 562 bp, Homo sapiens
  misc_feature: GYAE6OF02I2VU0.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattaacagcgatttaaattggtatcaccagaaaccagggaaagcccctaacctcctgatctatgctgcatccagtttgcatagtgggtcccatctagttcagtgcaggtgatcgtgggacagtatttcactctcacatcagcagtctgcaacctgaagtatttgactaacttacgtactgtacaaacagtacgttaccggtacccgttactacgttttcggaccctaaggggaccctaaacgtgggtaaaccaacgttaaccaaaaccggtaaaccgtttcggtacgggtacctacgggtaccctaaccctaacgttccgttaggttaaccc

SEQ ID NO: 191458 - DNA, 763 bp, Homo sapiens
  misc_feature: GYAE6OF02F8E72.47.70.G04.1.454.CMB.1.raw
  modified_base (250)..(250): a, c, t, g, unknown or other
  misc_feature (250)..(250): n is a, c, g, or t
tcagagctcacgtacacgaccggtgctcgatttagtgtagtgtgaagggaaagggggggagtcgagtctcagtcgaggacacagcagtggacatggacgggtccccgctcagcctccgtggggcctcctgctactcgtggcctccggaggtcgccagatggtgacatccagatcgacccagtcctccactccctcctgtctgcatcgtggtaggagacagacgtaccacctatctacgttcggccggganaagtcaggagactaattaacgagacgttaattttaaagttaggtaacttaccaaccgaaacgaaaacccggaaaggggaaacccgtaaccccctaaccctccgtacgtacttactacgtcgtcgtcgactacttccgttagtttcgactagttacgggtccggggtaccctacgttacgttacgggttacgtagggtcggtacgtagggtaggtacgttcgggtacggggtaacgtaaggttacttttacctaaccgttccgtaaccctaaccctaacgtacgaacggtacgtaccgttccgtacgaaccctaaccgttaggtaaacgtttacgttttacgaaccttaaacctttacttaccgttacgtaaccaacgtacggttaaccggtttacccggttaacccgttaccgttacgtttaccggaccggtaacgggaaccctacggtacgaacgtaactaaccgaaacgtacgtaggtacgtacgtacgaccactacgttcgttacgttcc

SEQ ID NO: 191459 - DNA, 545 bp, Homo sapiens
  misc_feature: GYAE6OF02I3R78.47.70.G04.1.454.CMB.1.raw
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaattggtatcaccagaaaccagggaaagcccctaactcctgatctatgctgcatccagtttgacatagtgggtcccatctagttcagtgcagtgatcgnggacagtatttcactctcaccatcagcagtctgacctaacgtgtaagtntttgactaacttactactgtacaactacgtacgtttaaccggtaccccgttaacttaccgttttacggaccgtaagggaacccaacgtaggaacctataaccgaaacgtaacgttaggtacggtcgtacgtaccaacctacttcgtgttacc

SEQ ID NO: 191460 - DNA, 550 bp, Homo sapiens
  misc_feature: GYAE6OF02H8PN5.47.70.G04.1.454.CMB.1.raw
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
  modified_base (547)..(547): a, c, t, g, unknown or other
  misc_feature (547)..(547): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggcaagtcagagcattaacagcgtaatttaaattggtatcaaccaagaaaccagggaaacgacccctaacctcctagatctatgctgcatcctagtttgactagtacggtcggggtaccctagttccgttaggttcaggtggactaggtggatcgtgggacagtacttttcacttctcaccatcagcagtctcgactaacgtgaagttatttacgacttaacttactactgtacaacgagtacgttaccggtacccgtatacgtttcggaccgtagggaacctaacgtgaacnctaacaaacgtactgngctacgaccacctattctntcc

SEQ ID NO: 191461 - DNA, 550 bp, Homo sapiens
  misc_feature: GYAE6OF02JF45A.47.70.G04.1.454.CMB.1.raw
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
tcagagctcacgtacacgaccggtgctcgatttagtgtagtgtgaagggaaagggggaggtcgagtctcagtcaggacacagcatggacatgagggtcccgctcagctcctgggctcctgctactctggctcgaggtgccagatgtgacatccagatgacccagtctccatcctccctgtctgcatctgtaggagacagagtcaccatcacttgccgggcaagtcagagcaattaacagcgaatttaaattggtatacaccagaaaccaagggaaacgcccctaacctctagattctatgctgcatcctagtttnctagtagtcggggtccatctaggttcaaggttggcaggtggatcgtagggacagtatttcgctactcacatcancgtatctcgacacctagaacgtatttagacctaacttactactagtacaactagacgttaccggtacccgttactacttttacggacgacggtaaccactacggactacgtaacaacgtaaccttagtacgtacttacgacctaaccattacgtgttaccg

SEQ ID NO: 191462 - DNA, 568 bp, Homo sapiens
  misc_feature: GYAE6OF02H6C2Q.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcaccagaaaccagggaaacgcccctaacctcctagatctatgctgcatcctagtttgctagtagtgggtcccatctaggttcaggtgcagtgatcgtgggacagatttcactctacaccatcagctagtctgaccaaccgtgaacgttatttcgactaacttactacttgtacaactacgtacgtttaccggtacccgttacttaccgtttacggaccgtacggggaaccctaaacgtcggaactaacgttaaccgaaaccggtaacgttaggtacggtactacggacctaacccgtattacccgttgttaccc

SEQ ID NO: 191463 - DNA, 530 bp, Homo sapiens
  misc_feature: GYAE6OF02FRBPK.47.70.G04.1.454.CMB.1.raw
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaactcctgatctatgctgcatccagttttgctagtagtcggggtcccagttctaggtttcaggtggcaggtggatcgtagggacagtatttcactctcaccatcagcagtcngcactgaantgttnctattatactgtaacaaaatataaacagttcgcccctatactacgttcggacgaacgggaccgtaagggtggaacgtaacgtaacgaaacgtacgttaggtacggaccttcggaccctactaacg

SEQ ID NO: 191464 - DNA, 568 bp, Homo sapiens
  misc_feature: GYAE6OF02I6OAV.47.70.G04.1.454.CMB.1.raw
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagacgtaatttaaattggtatcaccaagaaaccagggaaacncccctaactctgatctatgctgcatccagtttncagtaggtcgggtccagtctaggttcaggtgcgaggtgatcgtggactagtactttcactctacactatcagctagtctagacaactagtaagttatttcgacttaacttactacttgtacaaacgtagtacgttaaccggtacccgttaactacgtttacggaccgaacgggtaacctaacgtacgtaacgtaacgtaaccgaaacggtacgtaggtaccggctacgacctacccgtacttaccgtagttaccc

SEQ ID NO: 191465 - DNA, 482 bp, Homo sapiens
  misc_feature: GYAE6OF02G7IV9.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtccatcaaggttcagcggcagtaggtctgggacagagttcactctcactatcagcggcctgcagcctgaagattctgcaacttattactgtctccagtatgatgcttaccctgactttcgcaagggaccaaggtagaaatcaaacgactgtggctgcacatcg

SEQ ID NO: 191466 - DNA, 541 bp, Homo sapiens
  misc_feature: GYAE6OF02IE1IW.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcaattaacagcgtaatttaaattggtatcaaccaagaaaccaggaaacgcccctaactcctagatctatgctgcatcctagtttgctataggtcgggtccatcgtagttcagtgcagtggatcgtagggacagtatttcacttctacaccatcagcagtctcgactaacctagaagttatttgactaacttactactgtacaacgagtacgttaccgtacccgtacttacgtttacggaccgtaacgggaccaacgtcggaactaacgtacaaacgtacgtagtcggctacgaccaccgtatcctgttacc

SEQ ID NO: 191467 - DNA, 573 bp, Homo sapiens
  misc_feature: GYAE6OF02FUMTR.47.70.G04.1.454.CMB.1.raw
  modified_base (276)..(276): a, c, t, g, unknown or other
  misc_feature (276)..(276): n is a, c, g, or t
  modified_base (314)..(314): a, c, t, g, unknown or other
  misc_feature (314)..(314): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgtaatttaaattggtatcaccagaaaccagggaacncccctaacctcctagactctatgctgcatcctagtttnctagtaggtcgggtcccagttcgtaggttcaggtggcaggtggatcgtgggactagtactttcactctacaccatcagcagtctcgacaactagtaagtatttcgactaactttactactagtacaacgtagtacgtttaccggtaccccgttattaccgtttcggaccgtaacggggtaacctaacggtcggtaactaactaaccgaaaacggtaacgttggtacggacgttcgacctacctagttaccgtgttaccc

SEQ ID NO: 191468 - DNA, 642 bp, Homo sapiens
  misc_feature: GYAE6OF02H2S1V.47.70.G04.1.454.CMB.1.raw
  modified_base (320)..(320): a, c, t, g, unknown or other
  misc_feature (320)..(320): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttcggccggacaagtcagagcaattaacagcgtaatttaaagtggtaatcaccagaaaccgtagggaaacgcccctaactcctagactctatgctgcatcctagttnactagtacggtcgggtaccctattcgttaggtcaggtggctaggtgatcgtagggaactagtacttttcacttctacctacatcacgtacacgttctgacctaacgtagtaaacgtttatttacgtaccttaaacttactacgttagtaacctaaacgtaacggttaaccggttaacccggttaaccccgttaacgtttaccggttttacggacccggtaaccgggtaacccgtaacgttacggtaacctaaacggtaaccgaaacggtaaccgttaggtacggtacctacggacctaaccgtacgttccgtacgttacccg

SEQ ID NO: 191469 - DNA, 569 bp, Homo sapiens
  misc_feature: GYAE6OF02HMHL8.47.70.G04.1.454.CMB.1.raw
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcgagggcttgacaaatgctttggccttggtttcagcagacaccgagggaaggcccctaagccgcctgatctatggtgcaatactactttagacgtaaaaggtcggggtacccatacgaaggtttcacggcggacgaggtaggtcgtagggacaggtagttcactctacactancgacggcggacctgactagcctagaagtnttcagtactaactttattactgttacctactagtatgtatcgtaccttaccgtacgtacgtttccggacgtaacggaaccgtaagggtaacgaaactaacgaaacgtaacgtacggtacggactacggactaccgtattccg

SEQ ID NO: 191470 - DNA, 746 bp, Homo sapiens
  misc_feature: GYAE6OF02JBLGA.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctgggctcctgctactctggtctccgaggtgccagattgttgacatccaagatgacccagtctccatcctcctgtctgcatctgtaggagacagagtccgaccatcacttgccggcaagtcagagcattaacagcgtatttaaattggtatcaaccagaaaccaggaacgcccctaacctcctagactctatgctgacatccgtagtttcgactagttacggtcggggtaccctagttaccgttaggtttccaggtcggactacggttggaatcggtacggggaactagtacttttccacttcctaccaaccgacttaccgacgtaccgtagttacctaggtaacctaaccgttaggtaaacgttacgttttttacgacctaaaacgtttttaccgtaaaccgttttacggtaacctaaaccggtaaacggtttaaccgggttttaaaccccgggtttaacccccgttaacctttaaccgggtttttaccggaacccgttaaacgggggtaaacccctaaaccggttcgggaaaccgttaacgttaacccggaaaaacggttaaccggtttacggggttaaccgacccggttacggtaccccgtaaccgtaaccgtttccggttaccggtttacccc

SEQ ID NO: 191471 - DNA, 574 bp, Homo sapiens
  misc_feature: GYAE6OF02HG1X1.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcacagaaaccagggaaacgcccctaactcctgatctatgctgcatccagtttgctagtagtggggtcccattcgtaggtttcagtggcaggtggatcgtgggacagtatttcactctcaccatcagcagtctgaccaacctgaatatttgactaaactttactacttgtaccaacgtacgtacgtttaacccggtaccccgttaacttaccgttttcggacccgtaacggggtaaccctaaacgtcgggaacctaacgttaaccgaaaaacgtaacgttggtacggacttacggacctaacccgtattcccgtgttaccc

SEQ ID NO: 191472 - DNA, 738 bp, Homo sapiens
  misc_feature: GYAE6OF02IGI6J.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtctcactccctcctgtctgctattcgttaggtaggacgacgaggtacgtaccaacctactacctacgttcgggcccggggacgtacgtacgaggacgactaacttaaacgaggtacgttaaattttaaagttggtactaccgaaccaaacgaaaacccggaaagggaaacccgtaccccccttaaacccttccgtagtaacttacttacgtcgctgactacttccgttagtttcgactaagttacggggtccgggtacctagttacgttacggttacgtagggttggacgtagggtacggtacgttcgggtacggaactaagttactttacctaccgttctaccacctactacgaacgacgtacgtcgtacgaacctaacgttagtaagtttacgttttacgaacttaacctttacttactacgtacaaacgtaggttacgttaacccgttacccgttaacgttacgtttacggaccggtaacgggtaacctaacgtacgaactaacgtaaccgtaaacgtaacgtaggttacgacgtacgacctaaccgtacttacgttccgttacttaccg

SEQ ID NO: 191473 - DNA, 529 bp, Homo sapiens
  misc_feature: GYAE6OF02FODMJ.47.70.G04.1.454.CMB.1.raw
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaacagcgatttaaattggtatcaccagaaaccagggaaagcccctaacctcctgatctatgctgcatccagtttgcatagtggggtcccatcaaggttcagcggcagtaggtctgggacagagttcactctcactatcagcggctgcagcctgaanttctgcaacttattactntctcctagtatgattcgtacctttacccgtcggtacctttccgggaccgtaacgggaccgtaaagggtacggaaaactaccgaaaacgtacgtaggtacggcgtacgcctaccattaccg

SEQ ID NO: 191474 - DNA, 527 bp, Homo sapiens
  misc_feature: GYAE6OF02FZ6PJ.47.70.G04.1.454.CMB.1.raw
  modified_base (371)..(371): a, c, t, g, unknown or other
  misc_feature (371)..(371): n is a, c, g, or t
  modified_base (521)..(521): a, c, t, g, unknown or other
  misc_feature (521)..(521): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgcccctaacctcctgatctatgctgcatccagtttgcatagtggggtcccatctaggttcagcggcaggtagtctgggacagagttcactctcactntcaggcggcctgcagccctagaagtattctgactaactttattactgtcctctagtatgattcgtctttacccgtgtacctttccgaccgaacgggacctaaagggtagtaaactaacgaaacgtaacgttaggtacggtctgccgtacnttaccg

SEQ ID NO: 191475 - DNA, 512 bp, Homo sapiens
  misc_feature: GYAE6OF02I4Q0Z.47.70.G04.1.454.CMB.1.raw
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (492)..(492): a, c, t, g, unknown or other
  misc_feature (492)..(492): n is a, c, g, or t
tcagagctcacgtacacgaccggtgctcgatttagtgtagtgtgaagggaaagggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgaatttaaatggtatcaccagaaaccaggaaacgcccctaacctcctagatctatgcctgacatcagtttgctagtagtcgggtcccattcgtaggttcagtgnagtggatctggacagtattcactctcaccatcagctagtctncaactgaagtatttgctaatacctatcgtacaacgagtagttaaccggtaccctactacgtttcgacgtacggacctaacgtgaacaatactaaacgagttcgngactgacctacatcctgtac

SEQ ID NO: 191476 - DNA, 540 bp, Homo sapiens
  misc_feature: GYAE6OF02GQHD2.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaatggtatcacagaaaccagggaaagcccctaacctcctgatctatgctgcatccagtttgcatagtggggtcccatctaggttcagtggcagtggatctgggacagatttcactctacaccatcagcagtctgccaacctgaagtattttgacctaaacttactactgtaccaaactagtaacgtttaccggtaccccgttactaaccgttttcggaccctaaggggacccaacgtcggaacctaataccaaacgaacgttcggtaggacttcgaccaccattccgtagttcc

SEQ ID NO: 191477 - DNA, 513 bp, Homo sapiens
  misc_feature: GYAE6OF02F1JV3.47.70.G04.1.454.CMB.1.raw
  modified_base (393)..(393): a, c, t, g, unknown or other
  misc_feature (393)..(393): n is a, c, g, or t
  modified_base (510)..(510): a, c, t, g, unknown or other
  misc_feature (510)..(510): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgcccctaacctcctagatctatgctgcatccagtttgcatagtggggtccatctagttcagtggcagtggatcgtggacagtatttcactctcaccatcagcagtctgcaactgaatnttttagactaacttactactgtacaacgagtagttaaccggtacccgttaactacttttcggacctaggggaccaacgttggaactatacaaacgtactgtggctacgccacatctntcc

SEQ ID NO: 191478 - DNA, 546 bp, Homo sapiens
  misc_feature: GYAE6OF02GAM28.47.70.G04.1.454.CMB.1.raw
  modified_base (222)..(222): a, c, t, g, unknown or other
  misc_feature (222)..(222): n is a, c, g, or t
  modified_base (401)..(401): a, c, t, g, unknown or other
  misc_feature (401)..(401): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacacagtcaccatcacttgccgggngagtcaggacattagcaattatttagcctggtatcagcagaaaccagggaaagttcctaagctcctgatctatgttacatccactttgctaagttcgggtcccagtctcggttcagtcggctagtggatcgtgggactagtatttcactctcaccatcagcagcctgcagcctagaagntgttgactaacttacttactagtaactaaaatataacagtcgcccctctcgtaccgtttcgggacggtaacgggaccgtaagggtacggaagtaacgtaaccgaaacggtaacgttgggtacggcgtacggacctaaccgtaacg

SEQ ID NO: 191479 - DNA, 596 bp, Homo sapiens
  misc_feature: GYAE6OF02H9LXZ.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaacagacgtaatttaaatggtatcaaccaagaaacagggaaacgacccctaacctcctagatctatgctgctactcctagtttgctaagtacggtcgggtccctatacgttaggtttcaggtggactaggtggtatcgtagggactagtactttcactctactaccatcagcagtctagactaacgtgaagttatttcgaaccttaacttactaacttgtaacaacgtacgtaacgttaacccggttaacccgttacttacggtttacggaccggtaacgggaacctaacgtacggaactaactaaccgaaacgtaacgttacggtacgtacgtacgacctaacctacttccgtagttacc

SEQ ID NO: 191480 - DNA, 489 bp, Homo sapiens
  misc_feature: GYAE6OF02FQKR8.47.70.G04.1.454.CMB.1.raw
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcgagtcagggcttgcaaatgctttggcctggtttcagcagacaccagggaaggcccctaagcgcctgatctatggtgcatacactttgcaaagtggggtcccatcaaggttcagcggcagtaggtctgggacagagttcactctcaccatcagcagtctgcaacctgaagattttgctaacttactactgtacacagagttacgtacccgtacacttttggccagggaccaacgtggacatcaaacgacngtgctgcaccatctntctc

SEQ ID NO: 191481 - DNA, 618 bp, Homo sapiens
  misc_feature: GYAE6OF02FJEGE.47.70.G04.1.454.CMB.1.raw
  modified_base (276)..(276): a, c, t, g, unknown or other
  misc_feature (276)..(276): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattaacagcgaatttaaatggtatcaccaagaaaccagggaaacncccctaacctcctagatctatgctgcatcctagtttgctagtaggtcgggtcccatcgttaggttcagtggctagtggatcgtgggacagtactttcactctacacctatcagcacgtctcgaccaaccgtagtaagttacttttagtacctaactttaccgggggttacttacgtactaacgtagtacggtttaaccggttaaccccgttaaccgttaccgttttacggtaccggtaaccgggtaacccgtaacgtacggaaccgtaacgtaaccgtaaaccggtaaccgttacggtacggtaccgtacgtaccgtacccgtacgttacgttcgtttaccg

SEQ ID NO: 191482 - DNA, 728 bp, Homo sapiens
  misc_feature: GYAE6OF02HXK7C.47.70.G04.1.454.CMB.1.raw
  modified_base (201)..(201): a, c, t, g, unknown or other
  misc_feature (201)..(201): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatcgacccagtcctccactccctccctgtctgcatctgtagganacagagtcaccatcacgttcgccgggacaagtcagagactaattaacagtacgtaaattttaaaattggtaactaccgaaaccaaacggaaaacccgaacggggaaaaccgtacccccctaaccttaccctagaacttcgtaatcgcctagcctaacttccgttaaggtttcgactaggttacgggttccgggtaccctagttcgttacggtttcaaggtcggactaggtggtagtcgtaggaactagtactttcgacttcctacacctatcacgtacagttccacgtaccctaacgttaagtaacgtttactttcgaacctttaaacttacgtaacctgttaaaccaaacggttacggttaacccgtttaacccgggttaccccgttaagttacccgggtttagggaaccccggttaacgggaacccttaaacggtccggtaaacctaacgttaaaccgtaaacgggtaacgttacgggtaggtacccgttacgaaccccgtactaggtttcccttagtttacccg

SEQ ID NO: 191483 - DNA, 688 bp, Homo sapiens
  misc_feature: GYAE6OF02F5D6U.47.70.G04.1.454.CMB.1.raw
  modified_base (221)..(221): a, c, t, g, unknown or other
  misc_feature (221)..(221): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnagtcgagggcttgacaaatgctttggccttggtttcagcagacaccgagggaacgccctaagcgcctgatctagtggtgcatactacgtttgacgtaaaggttcggggtacccagtacgtaaacggtttcacggtaccggacgtaggtaacgggtcgtaggggaactaagggtacgtttccgaacttcctacctaaccttacgtacgaacggtccggtccctacggaccgtacgtcccgtaggtaaacggttactttacgtacgtaccttaaaccgttttaatttaaccgttacgttacccttaccgtaagtttaacgttcgtaacgttccgttaccctttaaccccggttacggttaccgtttacccgggacccgtaacggggtaacccgtaagggtaacggtaaaccgttaacgtaaaccggtaaccgttggtacggtaccgtaggaccctaccgtagtttaccg

SEQ ID NO: 191484 - DNA, 531 bp, Homo sapiens
  misc_feature: GYAE6OF02GI9IE.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagcattaacagcgatttaaattggtatcaccagaaaccagggaaacgcccctaacctcctgatctatgctgcatccagtttgctatagtgggtcccatctaggtcagtggcagtggatcgtgggacagtatttcactctcaccatcagcagtctgctaaccgtgaagttatttcgactaacttactactacgtacaacgtagtaacggtttaccggtaccccgttacgttacgttttcggaccgtaggggaccaaacgtgactacgtacaaacgtaactgtcgctgacacctatctctcttac

SEQ ID NO: 191485 - DNA, 542 bp, Homo sapiens
  misc_feature: GYAE6OF02HA5EM.47.70.G04.1.454.CMB.1.raw
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcgagggcgttgacaaatgctttggcctggtttcagcagacaccgagggaacggcccctaagccgcctgatctatggtgcatacactttgctaaaggtcggggtaccatacaaggttcagcggnaggtaggtcgtagggacagagttcactctcactatcagcgctgcacgcctagaagtnttctgactaacttattactcgttctcctagtatgattcgtacctttacccgtcggttaccgttccggaccgacgggtaaccgtaaggtaggaaactacgaaacgtaacgtggtacggctacgactacctatcgttcg

SEQ ID NO: 191486 - DNA, 545 bp, Homo sapiens
  misc_feature: GYAE6OF02GVOTH.47.70.G04.1.454.CMB.1.raw
  modified_base (222)..(222): a, c, t, g, unknown or other
  misc_feature (222)..(222): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcaattaacagcgtaatttaaattggtatcaccagaaaccagggaacacccctaacctcctgactctatcgctgcatcctagtttgactagtacggtcggggtaccctagttcgtaggttcaggtggcaggtggatcgtgggacagtatttcactctacaccatcagctagtctgaccaactagtaacgtattttgactaacttactactgtacaactagtacgttaccgtaccctagtactttcggaccgagggacctaacgtggaacactaaccgaaacgtactggtacgactcgacctaccattctgttacc

SEQ ID NO: 191487 - DNA, 569 bp, Homo sapiens
  misc_feature: GYAE6OF02GS3GC.47.70.G04.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (385)..(385): a, c, t, g, unknown or other
  misc_feature (385)..(385): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggcaagtcagagcaattaacagcgatttaaaattggtatcaccagaaaccagggaaanacccctaacctcctgatctatgctgcatccagtttgctagtaggttcggggtccctagtcgttaggttcaggtggacgaggtggatcgtgggacagtatttcaccttcncaccatcagctagtctgaccaacctgaagtattttgacctaacttactatctacaacgagtaacgttacccgtaaccccgttaacttaccgtttcggaccgagggtaaccctaaggtcggaacctaataccgaaaacgtacctggtacggaccttacggacctaaccctagttcctagttaccg

SEQ ID NO: 191488 - DNA, 638 bp, Homo sapiens
  misc_feature: GYAE6OF02JMSMM.47.70.G04.1.454.CMB.1.raw
  modified_base (412)..(412): a, c, t, g, unknown or other
  misc_feature (412)..(412): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagagtccaccatcacgttgccgggcaagtcagagcattaacgagcgtaattttaaatggttaactaccaaccgaaagaaaaccgaagggaaaccgtaccccctaaacctcctagacttctatcgcctgacctactccgtagtttcgactagtacggtcggtacccagttcgtaggttcagtggctaggtgatcgaggactagtcttcactctacnctatcagctagtctcgacctaacgtagtaacgtttcttacgtacctaaacgtttctaacgtgttaaccaaacgtacgttaaccgttaacccggttaccccgttaacttaccggtttacggaacccgtaacggggtaaccctacgtacggtaacctaacggtaaccgaaacggtcctaggttaccgggacttaccgtacccgtaactacgttaccgttacgttaccg

SEQ ID NO: 191489 - DNA, 565 bp, Homo sapiens
  misc_feature: GYAE6OF02HXF2A.47.70.G04.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggcccgggcaagtcgaggggtcgttagactaaatgctttggcctggttttcagtcagacaccgagggaacggcccctaagcgcctgatctatggtgcatacactttgactaaaggtcgggtaccagtcgtaaggttctagtggcgagtcgcgtcgtgggacagtagttcacttctccactactacaacagcctgacagtctagtaacgtntttagcttagtttatactgtacagctagtatactaagtaccgtcggcctcgtacctaccgttccggacccgtaaagggcctacggtaccgttagggaacgtaacgttaaacggaacgttcggtacggtactagtaaccccg

SEQ ID NO: 191490 - DNA, 534 bp, Homo sapiens
  misc_feature: GYAE6OF02GUZEY.47.70.G04.1.454.CMB.1.raw
  modified_base (420)..(420): a, c, t, g, unknown or other
  misc_feature (420)..(420): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccaggcgagtcaggacattagcaactatttaaattggtatcagcaagaaaccagggaaacgcccctaagctcctgactctacgatgcatccaatttaggaaacaggggtcccatcaagtcagtggaagtgatctgggacagtattttactcaccatcagcagcctgcagcctagaagatagttagacaaactagttattacgtntacaatagtatactaataacttcctaccctactttccggaccctagggaacctaagtcggtaataacgtaacaaacgtaagtacggtagctcggacctaaccattcctattacc

SEQ ID NO: 191491 - DNA, 647 bp, Homo sapiens
  misc_feature: GYAE6OF02GSQ3O.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggcaagtcagagctaattaacagacgtaattttaaatggtaatcaacaagaaaccgaagggaaacaccccctaactcctgactctatcgctgctactccgtagtttcgactagtacggttcgggtaccctagtacgttacggttcaggttggctaggtggatcggtagggactagttacttttacgaccttctaccacctatacagactagtctacgacctaacgtagtaaactttctttacgaccttaaacttaccttaacgtacgtaacctaaacgtaacggttaaccgttaacccgggttaaccccgtttaactttaccggttttacggaacccgtaacgggaaccctaacggtacggaactaactaaccgaaaccggtacgttaggtacgacttaccgacctaacccgtattccgttcgttacc
